United States Patent 7,432,049 (COMPOSITIONS AND METHODS RELATING TO OSTEOARTHRITIS) - sequence listing, part 4

SEQ ID NO: 18592 - DNA, 174 bp, Homo sapiens
  misc_feature 43, 100, 104, 119, 132, 140: n = A,T,C or G
ggtcaccaaggctgcttgagaagcctctgaagaagaagtaaantacagccactgagctgtgctaaaatctcggatacgcacttggtttcatgcataatgngtgntgcaatatgacaatntgcttccgtagtnctgtttgnatccgacttctatcttcatgcttccttaactttc

SEQ ID NO: 18593 - DNA, 144 bp, Homo sapiens
  misc_feature 43: n = A,T,C or G
tgttttggatgtatgttgaaagacatgcttttatttttttgtnaaacaatataggagctgtgtctactattaaaagtgaaacattttggcatgtttgttaattctagtttcatttaataacctgtaaggcacgtaagtttaagc

SEQ ID NO: 18594 - DNA, 472 bp, Homo sapiens
ggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagagcgcaaacctaccgagcctggtgatagctggtgccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtagggcctaaaagcagccaccaattaagaaagcgtcaagctcaacacccact

SEQ ID NO: 18595 - DNA, 437 bp, Homo sapiens
tagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatgggggttatgccagttacatacaaggatcctgcatatctcaaggccctaaagtttgtaacatcagatatcgggaataaattctatcacgttaccactaataaacttattttacagtaa

SEQ ID NO: 18596 - DNA, 126 bp, Homo sapiens
  misc_feature 56, 92, 97: n = A,T,C or G
tcatattcagtcatctcaggagaacttcagaagagcttgagtaggccaaatgatgnaggtaagttttccaataatgtgacttcttaaaagtnttatnaaaggggaggggcaaatattggcaattag

SEQ ID NO: 18597 - DNA, 381 bp, Homo sapiens
  misc_feature 64, 318, 352: n = A,T,C or G
taacaggactagcttatcatgagagccctcaggggaaagggtttaagaaaaacaactcctcttncccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggcagagcgnatttgggatatgagtatcctttgcttatctttgnaggactgaaaatttgccgaagaactggct

SEQ ID NO: 18598 - DNA, 420 bp, Homo sapiens
  misc_feature 236, 289, 290, 291, 292, 297, 339, 364, 395, 414: n = A,T,C or G
tataaaaagcctgtatattttttaaaaacacatcttaactccacgctttacgatattataaaagttgaatggtcctcttggtaaggatatttgcttacaagtgctaggaaataactcactgatacctgcgttaacatacttcgttttgcctagagaggggcaataaaaatgaaccaaaggatatttccagaaaggattaagaaagctgtttaagaaggccatgactctttaggtgngtatgtgtacctttcagcatcctaggaatttttatactaaaagcaaaatgttnnnnccagntagtcttcttcaaggaattactattgtccttttgtcacaggnaaaatcagggtgggaattataattngagaaaaatattacccagtaacattgaatgnaggatggctaaacgatctnactcag

SEQ ID NO: 18599 - DNA, 447 bp, Homo sapiens
ataatagacaaaacatagtttacttttcaggaaaggcagattcctatttcccaactatacatgagctaggtatgcttatcttataaaccaggagttactaaccaaagtattgagacactccattaggttgtaaggaatttgttcctaataataaagtattaaagtatgtgaatttacctaggtaaaggccaaattcaagattattttcagaataagtcactgtaatttattggctttcatgtttctttgttgggagaaaaaggtatggaattgtaactggatggcattgtgcaagctagaatgtggcacatatcagacagatacagagccatattctacatacaaaattgaataaaagataaaacctgaatgggaatatatagaatagctgacaactattgtgccagaatggtggggattacattttaaaaataataatacttgtcc

SEQ ID NO: 18600 - DNA, 443 bp, Homo sapiens
tatggtaagagtgagcactttggcttatgtataagttagaaataattgttagtttttaatatgcacttcgtggggaaatttcttagacgtatgcaagcaagtgaaaacaattagggccagtggtattaactactttataaaattttatttttgtttgtaagaagtcatctacttaaggcccagttaatataagtggaatcatcatagtttaaggaatacccagagattgctgctgttctatttattttacagaaagggtagctagattgaaagctcttcagtggccttgagctaatagatcttttaccactaaaagagcattattctcatgtcataatgagaataataatttacatactggcataataaatgcctaaaagacattttatttctgaatctattttttctgctataatggggatattggaaattatgcatttgga

SEQ ID NO: 18601 - DNA, 386 bp, Homo sapiens
aaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattggcaaatatcttccctatatctaaacaatac

SEQ ID NO: 18602 - DNA, 346 bp, Homo sapiens
  misc_feature 30, 31, 32, 33, 168: n = A,T,C or G
attgttggtgcaaccattaccaccatacannnncagaaccttttcactttccatgattgaaactctggctgggcgtggtgggctcacgcctgtaatcccagcactttgggaggccaaggcaggcagatcacgaggtcaggagttcaagaccaccctgaccaacatggngaaaccctgtctctactaaaaatataaaaattagcagggcgcggtggtgcgcacctgtaatcccagctactcaggaggctgaggcaggagaatcgcttgaacccaggaggtggaggttgcagtgagccaagatcacgccaccacattccagtctggacgagagtgaagactccatctc

SEQ ID NO: 18603 - DNA, 526 bp, Homo sapiens
tcttacggtgaaattgaaggtaaattcttgggacctagagaagaagtaacgagtgagccacgctgtaaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttac

SEQ ID NO: 18604 - DNA, 388 bp, Homo sapiens
  misc_feature 31, 44: n = A,T,C or G
gccaaccaagatgcaaatgttttgaaatganatgaccaaaattntaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaca

SEQ ID NO: 18605 - DNA, 463 bp, Homo sapiens
  misc_feature 37: n = A,T,C or G
ccactgagacaactgtttaagaagtacatatgacatnatattttttctttctgtattctgtagacttacctgtaaagtctaaggctaacattgactttatgctaattagtactgtgttcatttcagatgtgtaatatgccttgtacaaatataaatagataaaacattaaaggtgctactactcaaaacacacagggaataaaatattctatttgaaacatcaacatagagtttacactgagggaaatttttattcattagtttaaatgggggcaaaatacaataaatattatttggttaaaatagagaaagttaagtggaaagatgaaatgatgaagagcgcagagaaaattgttcagtttgcatacaaatggggaaattaacacctaacctgcctaggagaattcatagcgtaactaaaataatacttaacctacaagatttattagaaaaatatgaatag

SEQ ID NO: 18606 - DNA, 385 bp, Homo sapiens
  misc_feature 40, 48: n = A,T,C or G
ctctttctatgaactgagcacaaaactcaggaattggtgntttaattntagatcagtgcttgtactaggcttagttatatgaatctttataacacataattactaactttgtagccatatgtgtaattgactttgaatgttatttacctgaaattaatcttccttcacacatggaccgtaaacggttcccagttgtctgagagcctcatgagggtttctaggatttatgaccttatgaccagtttttttgatttaccaagattttattttcctacatgaaaatttaattgagtaataattattcacatgtgcattttctttttagctgttaaatgtactatgccatcatccaccatttagtaaaatgtagctggccaggacatgt

SEQ ID NO: 18607 - DNA, 301 bp, Homo sapiens
  misc_feature 39: n = A,T,C or G
accgctccaaactcatcctcttccccaggaagccctcgnccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcg

SEQ ID NO: 18608 - DNA, 366 bp, Homo sapiens
  misc_feature 50, 52: n = A,T,C or G
tgcagtaaatgaaagggtatcccttgaattctcccaaatcaagaccctgngnctttattgagtttaaaacgcttgaagcagattactgggtttcatcgtcaaagatttttaattctagagacaagtttttttcacttcatagcccatatttttaaccgcagccctgtattgcttattcatttcatctccccaaataaacgtgaagatctttggaagaaggagcactttttattcagctaagtagtatttctttcaatacatgaaaaagtcttgacacacaggcaatgctaaaatatgcatacacatgagaaattaaattgaggcaaaataatgattacctaaccagctactgtgtctggaatatga

SEQ ID NO: 18609 - DNA, 137 bp, Homo sapiens
gctgtgtgtttcattttaaattgagcattaagggaatgcagcatttaaatcagaactctgccaatgcttttatctagaggcgtgttgcatttttgtcttatatgaaatttctgtcccaagaaaggcaggattacatc

SEQ ID NO: 18610 - DNA, 380 bp, Homo sapiens
  misc_feature 184: n = A,T,C or G
attagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccattnggttgttacagaaaaattcttaactgtaattgatggtgttgccgtaatagtatattgcctgtatttctacctctagtaatgggctttatgtgctagattttaatatccttgagcctggcaagtgcacaagtctttttaaaagaacatggttacttgcacaaaactgatcagttttgagagacgtaatgccctggaa

SEQ ID NO: 18611 - DNA, 202 bp, Homo sapiens
  misc_feature 44, 67, 199: n = A,T,C or G
agcctgggcaacatagcaagaccccgtctctacaaaaaaaaganagagaaatttacccgggcatggnggtgtgtgcctgtagtcctagctactcaggaggctgaggtgggagtccaggagtccaagattatagtgaactatggtctcactgctgcactccagtgctgcctcttaataaaaaaaaaatggcacctgcctnttt

SEQ ID NO: 18612 - DNA, 354 bp, Homo sapiens
  misc_feature 80, 111, 185, 188, 253, 347: n = A,T,C or G
tgttgacatccagcagtccaaggtattgagacatattactggaagtaagaaatattactataattgagaactacagcttntaagattgtacttttatcttaaaagggtggnagttttccctaaaatacttattatgtaagggtcattagacaaatgtcttgaagtaggacatggaatttatgaanggntctttatcatttctcttccccctttttggcatcctggcttgctccagttttaggtcctttagttngcttctgtaagcaacgggaacacctgctgagggggctctttccctcatgtatacttcaagtaagacaagaatcttttgtgaaattatagaaatntactatg

SEQ ID NO: 18613 - DNA, 143 bp, Homo sapiens
  misc_feature 49, 54: n = A,T,C or G
attaacctttagcaataaacgaaagggtaactaagctatactaaccccngggcnggtcaatttcgtgccagccaccgcggtcacacgattaacccaagtcaatagaagccggcgcaaagagtgttttagatcaccccctcccc

SEQ ID NO: 18614 - DNA, 164 bp, Homo sapiens
  misc_feature 44: n = A,T,C or G
gactcagctctgacattctgattcgaatgacactgttcaggaancggaatcctgtcgattagactggacagcttgtggcaagtgaatttgcctgtaacaagccagattttttaaaatttatattgtaaatattgtgtgtgtgtgtgtgtatatatatatatatg

SEQ ID NO: 18615 - DNA, 408 bp, Homo sapiens
ataggcccttagagtttttatcttttactttcagtctaacacagcactgcctgctttttgtttttgttgcttggtttgtttttttcttaccgtgttcaccaaacttgtgtccaaatagctttgggctgatgcaaaaatatctatgtggaagagaagagttgttctcatggagggccttcagatgagtgctatagactctctaggcaactccaagaggcttctcaagcagggtgggcagtgagagctgctatggaatcaatggacaaactgacagggactgctttgaaagacagtactcagtgagtatatatattctctcttaaggctaaaagtttataatcatcccttaaacactctgtgatgggatcttcaggatcatcttttgaagtaaactatattttacattcc

SEQ ID NO: 18616 - DNA, 510 bp, Homo sapiens
atattgtttttgaccacaattatgtaaaactagaaatcaataggataaggaaaactggaaaattcacaaatatgtggatattagataatacgcttctgaacaacccaaagggcctaagaagaaatcaaatgggaaattcttaaaaatgttgagaaaaactagggtggaaatacaacatattaaaactgaagagatgcaggaaaaacagttctaaatgggaagtttatagtaattaatgcttacatgaagaaaaaaaaatctcaaataaacattcatcctaattttatacctcaagaaagttgaaaaagaacaaactaagccccgcgttagtagggaaaagataataacaaaaatcagagcagaaataaatgaaatagagactagtagaacaatagaaaaaatttaaaaaccaagaccagggtttttgaaaatgtaaacaaaatcaacaaatctttggctagactgaaaagaaagggaagactcaaataaataaaactaggaatggaacca

SEQ ID NO: 18617 - DNA, 353 bp, Homo sapiens
agatggacccatcctagtttatcttgccttgattacttattctttttttaagggttaaaatgggccgccgcggtggctcatacctgtaatcccaacactgggaggccgaggtgggcgtatcatttgaggtcaggaatttgagaccagcctggccaacatggtgaaaccccgtctctactaaaaatacaaaaattagctggatgtggtggtgcatgcctgtaatcatgtagcgcatgccagctacttgggaggctgaggcaggagaattgcttgaacctgggaggtggaggttgcagtgagccgagatcgtgccattgcgctccagcctgggtgacagagtgagactccgtctc

SEQ ID NO: 18618 - DNA, 227 bp, Homo sapiens
  misc_feature 45, 61: n = A,T,C or G
tgggaggaattcatcttcagtctaccagcccccgctgtgtcgganacacactcgaatcatngaagatccgagtgtgatttgaattctgtgatattttcacactggtaaatgttacctctattttaattactgctataaataggtttatattattgattcacttactgactttgcattttcgtttttaaaaggatgtataaatttttacctgtgtaaataaaatttaa

SEQ ID NO: 18619 - DNA, 366 bp, Homo sapiens
gggcgcaatagatatagtacccgcaaggggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactagg

SEQ ID NO: 18620 - DNA, 291 bp, Homo sapiens
  misc_feature 40, 63, 64, 74: n = A,T,C or G
aagagttatttaatcctagcagatactaaaagtcgttatntaaccataatagttaaaactaanntttgatacangaataggccagtcaagcagaatagaaggtctaaaagtagactcaaacatatacgacaatttagtatggcaaatgtggcatccagaaccagtgagcaaaaggtagactcttcattaaatagtattggaataactaagtaacctccggaaaaagtaaaattgggtctatatctcacaccataagccaacatatatttcaaaatagataatgatctaagt

SEQ ID NO: 18621 - DNA, 350 bp, Homo sapiens
atcatacccagagtctggggctgtgtgttgagcagccttaaggatgctagacactcatttagtgcccagggagtccagcgaatgacgtctgtggccaagcgaggctcaggtgcaaagcaaaaggaccatttaaagtaaaatagcttggattcaatcatgtgacttttaaattggctcagaaagcaattttgtaatttcagagagtgttttgagccatggccacgttgtcattgtgagtctatagcttgactccttggagaacaatattcatttggttgtggagactgatttgctgggagaaatctgtcctgttactttctggcatcccaggttctgacttttaccagggc

SEQ ID NO: 18622 - DNA, 353 bp, Homo sapiens
  misc_feature 338: n = A,T,C or G
gcagatttgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgangaagttgatgaaatg

SEQ ID NO: 18623 - DNA, 405 bp, Homo sapiens
  misc_feature 4, 10, 110, 364: n = A,T,C or G
ccanaatgcntacatccgggtgtaatatcccgagaaattatggaaaattataacatagcattaaggtggacagccaaacagaagctttattcgagaacaggtgaatcagntgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggnggctctcttcttaaaagcaccatattaaatcctggaaaact

SEQ ID NO: 18624 - DNA, 381 bp, Homo sapiens
  misc_feature 33, 334: n = A,T,C or G
ggagaagaccccggcgctggtgaacgctgctgngacttactcgaagcctcgattggccacattttggtactacgccaaggttgaactggttcctcccacccctgctgagatccctagagctattcagagcctgaaaaaaatagtcaatagtgctcagactggtagcttcaaacagctcacagttaaggaagctgtgctgaatggttggggccactgaggtgttgatgtggttttatgtcggagagattataggcaagcggggcatcattggctatgatgtttgaagaccaatctttaacatctgattatatttgatttattatttgagtggtgntggccatgtgtgatcaagactgctatctgaataaaataagatttgcc

SEQ ID NO: 18625 - DNA, 257 bp, Homo sapiens
  misc_feature 36, 82, 194: n = A,T,C or G
taggcctggctccaaaataaatttacccaaagaagngatgtatttgtgtccagggctaccgagcctaatctttgctgcctcngtgttattctaagttgtaattttccatgtcatctaaatttgtaataattctttaatatgatagggtttcaagtgaacaaacattctgcttgctgcatttcttctgagtgagnaattccctgacaactaccagatcttgcaagaagcaaagttggcataaggtatgctccactctc

SEQ ID NO: 18626 - DNA, 105 bp, Homo sapiens
  misc_feature 16: n = A,T,C or G
gccaaaggatctttcnccctgacacaactctgctagacctgcaaaacaacaaaataaccgaaatcaaagatgggagactttaagaacctgaagaaccttcacgca

SEQ ID NO: 18627 - DNA, 388 bp, Homo sapiens
  misc_feature 51, 58, 60, 286: n = A,T,C or G
tagaacattaactcccagctattatagaggtgcacagggtgttatattagnttatgangncacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaactngttgaaaagatcattcagacccctggctgtgggaaagtgagaaccagaataaaggagcaaactgcacacagggaagaaggccaaggagggaggagcctgtgg

SEQ ID NO: 18628 - DNA, 220 bp, Homo sapiens
tctgattacttcactaggatagcgttttccctaatttctcatagatggattattcagaagaatctgctatttccataattacttactttgattataatattcttgctattatttctgagttttaaaaattaatgctatttttattaatgtaatttatacagtttggcttccataacatggtggactgagcttattaatatgaacttctcccaataaacac

SEQ ID NO: 18629 - DNA, 155 bp, Homo sapiens
  misc_feature 62, 84, 85, 86: n = A,T,C or G
tttagtggtggtatgactggcaacattgttaacaacaaatagacccatgccagactgaaaanaacttgaaggatttcataaatnnnctttttgcatactattcatggaaataatctactctgcacttccctatgaatggatcatgatgcaaggct

SEQ ID NO: 18630 - DNA, 195 bp, Homo sapiens
  misc_feature 30: n = A,T,C or G
tccctccatctaaaaggaaatgtccaattnggaagacattttctttagtcttctatgaaagccctctcatgacctttctgcttgcaaacaaaagaatcatttcctgatcagcaccagcagtcagctcctttacaatggaacccatttaaggtcagtgctggcctataatagaactacttaaataagtgtaacttc

SEQ ID NO: 18631 - DNA, 540 bp, Homo sapiens
  misc_feature 38, 520: n = A,T,C or G
ctacaaccagtattctcagagataccatcagagaacanacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaatagggaaagcatatgcagccaaccaagatgcaaatgttttgaaatgatatgaccaaaatttaagtaggaaagcacccaaacactttgcttcacttaagggctggcccgcaatactgnaggaacaagcatgatcttgt

SEQ ID NO: 18632 - DNA, 451 bp, Homo sapiens
gaataataatttaaaactactatagaaactgcagagcaaaggaagtggcttaatgatcctgaagggatttcttctgatggtagcttttgtattatcaaacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaaaattttaagcaaatgaaagctaccaatttaaagtacggaatctaccattttaaagttaattgcttgcaagctataaccacaaaaataatgaattgatgagaaatacaatgaagaggcaatgccatctcaaaatactgctttacaaaagcagaataaaagcg

SEQ ID NO: 18633 - DNA, 413 bp, Homo sapiens
  misc_feature 51, 175, 243, 305: n = A,T,C or G
actgtaacattactgtacagagtacatcaactattttcagcccaaaaaggngccaaatgcatataaatcttgataaacaaagtctataaaataaaacatgggacattagctttgggaaaagtaatgaaaatataatggttttagaaatcctgtgttaaatattgctatattttcntagcggtatttctacagttaattacatagtcatgattgtctacgtttcatatattatatgggctttgnatatgccactaataaaatgaatctaaacattgaatgtgaatggcctcagaaaatcatctagngcatttaaaaataatcgactctaaaactgaagaaccttatcacattttcccagttcaatgctatgccattaccactccaaataatctcaaataatttcccttaataac

SEQ ID NO: 18634 - DNA, 286 bp, Homo sapiens
  misc_feature 29: n = A,T,C or G
gtttttctttcagtcatttttctatttgngggatatgtatatatgtacctatatgtatttgcatttggaattttggaatcctgctctatgtacagttttgtattatactttttaaatcttgaactttataaacattttctgaaatcattgattattctacaaaaacatgattttaaacagctgtaaaatattctatgatatgaatgttttatgcattatttaagcctgctctattgttggaatttcaggtcattttcataaatattgttgcaataaatatccttga

SEQ ID NO: 18635 - DNA, 334 bp, Homo sapiens
  misc_feature 75, 141, 182: n = A,T,C or G
aacagcaggttcacttacactgttcttgtagatggctgctctaaaaagacaaatgaatggggaaagacaatcatngaatacaaaacaaataagccatcacgcctgcccttccttgatattgcacctttggacatcggtggngctgaccaggaattctttgtggacattggcccagtctgttncaaataaatgaactcaatctaaattaaaaaagaaagaaatttgaaaaaactttctctttgccatttcttcttcttcttttttaactgaaagctgaatccttccatttcttctgcacatctacttgcttaaattgggggcaaaagagaaaaag

SEQ ID NO: 18636 - DNA, 472 bp, Homo sapiens
gaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcaggtttggggtaagctggcggtactataacacgtactggaaacc

SEQ ID NO: 18637 - DNA, 158 bp, Homo sapiens
  misc_feature 53, 54, 55: n = A,T,C or G
gctgtctcactgcccaacatcagaaaacctgacggctatgattactatgcctnnnctaaagatcaatactataacattgatgtgcctagtagaacagcaagagcaattactactcgttctgggcagaccttatccaaagtctggtacaactgtcctta

SEQ ID NO: 18638 - DNA, 329 bp, Homo sapiens
  misc_feature 158: n = A,T,C or G
aactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggntgtccaagatagaatcttagttcaactttaaatttgcccacagaaccctctaaatccccttgtaaatttaactgttagtccaaagaggaacagctctttggacactaggaaaaaaccttgtaggagagagtaaaaaatttaacacccatagtaggcctaaaagcagccacc

SEQ ID NO: 18639 - DNA, 114 bp, Homo sapiens
  misc_feature 12, 49, 81: n = A,T,C or G
gccgagacctanggcatggtgacatagcccacactttaaagtgaagtantataccatgcagtgagctgaaatcatgctgangcactccagcctggggggcacgagggactccat

SEQ ID NO: 18640 - DNA, 569 bp, Homo sapiens
tttggtctcctgctaactcagaaaggaaatgcaacacacgaaacatatgttccggaaacagtgaatcaactcaaaaatgtggaatagatgttaccctgtgtgaggaggcattcttcaggtttgctgttcctacaaagtttacgcctaactggcttagtgtcttggtagacaatttgcctggcaccaaagtaaacgcagagagtgtagagaggataaaacggcaacacagctcacaagacagactttccagctgctgaagttatggaaacatcaaaacaaagaccaagatatagtcaagaagatcatccaagatattgacctctgtgaaaacagcgtgcagcgcacgttggacatgctaacctcaccttcgagcagcttcgtagcttgatggaaagcttaccgggaaagaaagtgggagcagaagacattgaaaaaacaataaaggcatgcaaacccagtgaccagatcctgaagctgctcagttggggcgaataaaaaatggcgaccaagacaccttgaaggggcctaatgcacgcactaaagcactcaaagacgtacccactttcccc

SEQ ID NO: 18641 - DNA, 481 bp, Homo sapiens
  misc_feature 142, 154, 158, 170, 394, 421: n = A,T,C or G
tttgctctggaggaagttctccagctttagctcaactcacagcttctccaagcatcaccctgggagtttcctgagggttttctcataaatgagggctgcacattgcctgttctgcttcgaagtattcaataccgctcagtantttaaatgaagngatnctaagatttggnttgggatcaataggaaagcatatgcagccaaccaagatgcaaatgtcttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctaagaaatatctntctcttacctgtattaatcaatttttnccaagtattttatacggaaaaaattgtatggaaacacttagtatgcagtgataagaggaa

SEQ ID NO: 18642 - DNA, 422 bp, Homo sapiens
  misc_feature 16, 344, 370, 410: n = A,T,C or G
gcagttacaggccagntctccagctctccatcttagagagacaggtcaccttgcaggcctgcttgcaggaaatgaatccagcagccaactcgaatccccctagggctcaggcactgagggcctggggacagtggagcatatgggtgggagacagatggagggtaccctatttacaactgagtcaagccaagccactgatgggaatatacagatttaggtgctaaaccatttattttccacggatgagcacaatctgaagaatcaaacttcatcctgaaaatctatatgttcaaaaccacttgccatctgtaagaatgcagtcctgggaccaggcctcagactgngaagtatatatcctccagcattcagnccagggggagcacggaaaccatgtcttgcttaagccattnaaggcagagatg

SEQ ID NO: 18643 - DNA, 377 bp, Homo sapiens
  misc_feature 357, 375, 377: n = A,T,C or G
acacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattaagactggacagcttgtggcaagtgaatttgcctgtaacaagccagattttttaaaanttatattgtaaatattgngn

SEQ ID NO: 18644 - DNA, 175 bp, Homo sapiens
atataataaaatctgtgtttattttgcaaagggcttttgaacagatattagagaaacaaatttcatcatcatgttcaactttatactttgtaacattgtactttctgttccaatagttaacagcactaagttcatagttcttctcttcctgttctcttttgggagttttctattt

SEQ ID NO: 18645 - DNA, 417 bp, Homo sapiens
  misc_feature 42, 43, 260, 368, 372: n = A,T,C or G
tcagtgcacattagcatttgaactacctggggattctttatnngaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctgggttacctgtcttgctattatgacatttcatttggaaggatgtttgtgttgnagctaactgttcaagtctggtgctgctgctgtcttagccatcacaaaacgctaaatttgtgtaattggagcttcctgctgttatctggaaatagcaggaaagcgcagnttgnatattgtttcctaaagtatattaaaataaaaaaagaactattgct

SEQ ID NO: 18646 - DNA, 172 bp, Homo sapiens
  misc_feature 142: n = A,T,C or G
tcttgcagtgttgcccaggctggactcaaactctggggcttaatcatccttctgagtagctgggactacataaaggccaaagtataattgcttttgatttttaaaatcttcttgcccatcatttttataaaaataaagctgnttgccaacacggtgaaacctcatctctacg

SEQ ID NO: 18647 - DNA, 252 bp, Homo sapiens
  misc_feature 29, 79, 142, 148, 154, 173, 184: n = A,T,C or G
aattctgagaaattcagaagagacccagntcagcacaagagttttcaaaaagcaaatgagacaagtcaagaatcctttnggcttagagatcactaatccatcttcagcttcaattacaactggcataaccttgacaacagantgcctngaaganagcctccttacatgctacngggggtgcagngtcaaaaattatatgaagctctgcagaagcatgtttattgcttcagaataagcactccccaagcatta

SEQ ID NO: 18648 - DNA, 108 bp, Homo sapiens
  misc_feature 70, 88: n = A,T,C or G
aaaaattcccagataattaactagctattacagatctcacctagagggttgatgttatgaagactccagnggactgtactcacaaatngactggcaccctatgaaagt

SEQ ID NO: 18649 - DNA, 171 bp, Homo sapiens
  misc_feature 57, 98, 99: n = A,T,C or G
aaagctgtgaaaatgaccctgaagaacagagaacctgtacagctggaaacgctgagnattcgaggaaataacattcggattttattctaccagacagnntacctctggatacactacttgtggatgttgaacctaaggtgaaatctaagaaaagggaagctgttgcaggaa

SEQ ID NO: 18650 - DNA, 350 bp, Homo sapiens
  misc_feature 54, 97, 144, 320: n = A,T,C or G
ccaccttccacaagtactcgggcaaagagggtgacaagttcaagctcaacaagncagaactaaaggagctgctgacccgggagctgcccagcttctnggggaaaaggacagatgaagctgctttccagaagctgatgagcaacntggacagcaacagggacaacgaggtggacttccaagagtactgtgtcttcctgtcctgcatcgcatgatgtgtaacgaattctttgaaggcttcccagataagcagcccaggaagaaatgaaaactcctctgatgtggttggggggcctgccagctggggccctccctgtcgcagnggcacttttttttttccaccctggctcctt

SEQ ID NO: 18651 - DNA, 367 bp, Homo sapiens
  misc_feature 334, 336: n = A,T,C or G
ttcaacaacgaaatcaatatgaacgaaaaggtgaaaaggcaccaaagctgaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggctngngttttgatgaaatccggcaacagcagcagaa

SEQ ID NO: 18652 - DNA, 481 bp, Homo sapiens
  misc_feature 40: n = A,T,C or G
aaggcattatcatcaatcccatgctttccgatgagaccantatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtgcagcattcagcagtatatttataaacaggaacctggacagaagtgccctggaagaaggcctgctctaaattatcca

SEQ ID NO: 18653 - DNA, 359 bp, Homo sapiens
  misc_feature 6, 52: n = A,T,C or G
gggaanatagaggagcctaattaattggtataatttcacaaagcggaatggnattccttggagagttaaagacattctctttagtaagtgtaaaccaaagggcattttctttattcctgcttctaattccttctagcccagtgaattatttctcttttcactggtaatgtgatgaatgggaattgtttattacattgaagtgacttgaagtgaccttttgtgctttaggtgcaggtgacactgaaaaaaaaacaaaacactgaatttttcacacctatgtctgcattaaaggctgttttactaccggaagtacatagacttcctgcagcagctgctgtccccagtccttactggccttt

SEQ ID NO: 18654 - DNA, 103 bp, Homo sapiens
  misc_feature 13: n = A,T,C or G
tagtggctactgngtcttgtgaatgtaaccagtacttctttaagctctattcagtagggttccagccactgcttttttgttgtttctagccactgtttttttt

SEQ ID NO: 18655 - DNA, 404 bp, Homo sapiens
  misc_feature 400: n = A,T,C or G
aaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgcatttgtacatttaaagcagctgttttggggtctgtgagagtacatgtattatatacaagcacaacaggcttgcactaaagaattgtcattgtaataacactacttggaagcctaactcatatatgtattcttaatgcacaaaaagtcaataatttgncacc

SEQ ID NO: 18656 - DNA, 242 bp, Homo sapiens
  misc_feature 36: n = A,T,C or G
aaggcgacaaacctaccgagcctggtgatagctggntgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccc

SEQ ID NO: 18657 - DNA, 376 bp, Homo sapiens
  misc_feature 28, 40, 53, 95, 323: n = A,T,C or G
actttagtattatcacttactataccanaagctgaattgnagataaataatcntcctgctaatttaaacgctatgcattatatgcactataacanttgttaaactgttgattttatagattcataaaatatttaaattgaaaagactatagaaattgcttacatcaatctcctaattttttaagtgataaaaataagacaaagaacagtaagtaatggaagaatgatggctaaaatgtaggtctccttcatagaaaaatggccaaagtaagggataataagtcaacagcatacttaatcataaaactttgatgagacgaaggngctgaaattgattataattgaaaaataatgggactgcagcaacatgcacaggg

SEQ ID NO: 18658 - DNA, 379 bp, Homo sapiens
  misc_feature 28, 130, 355, 376: n = A,T,C or G
gacataccgcttctgacacaactgtgtncactagtaacctcaaacagacaccatggtgcacctgactcctgaggagaagtctgccgttactgccctgtggggcaaggtgaacgtggatgaagttggtggngaggccctgggcaggctgctggtggtctacccttggacccagaggttctttgagtcctttggggatctgtccactcccgatgctgttatggcaaccctaaggtgaaggctcatggcaagaaagtgctcggtgcctttagtgatggcctgctcacctggacaacctcaaggcacctttgccacactgagtgagctgcactgtgacaagctgcacgtggatcctganacttcaggctcctggcaacgnact

SEQ ID NO: 18659 - DNA, 319 bp, Homo sapiens
  misc_feature 17: n = A,T,C or G
ggtcagtaaattccggnaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaaacaaaaagaag

SEQ ID NO: 18660 - DNA, 120 bp, Homo sapiens
gaataaactactgatcttgtgctgtgtcaaagtaacagactagaaccttctttcaagtacctgaattgaaatgaaactcattttgaataataaaaactctagaaactctttatcttctct

SEQ ID NO: 18661 - DNA, 458 bp, Homo sapiens
  misc_feature 15, 16, 64, 441: n = A,T,C or G
taattagaaactaannagaaattagaattaattagaaattaattaggctagagactgaattggnattaaatgtcactaatcaaacagctcagtgctatgccatggtgatgcctggagttgaacagagtgtgatttccttagtatagcaaccttgtcatcctcgtagctgctgatgggctaatgaagtatgatcatattctgcttgtaagtacattgagtctaaaatctcaagaacaaaagatactgagagcataattaagaggatgtgtaatgttcatgtatcattgtgtgatgggaaaagccctcctttataaaataaggagctgaatcagatgattccttaagattctttcctaatccattaagagcatggctttgatgtatgacggcttaggttcaatagctgctatgtgacctcaagcaaggcatagctctttgggnctggttttcctcagctg

SEQ ID NO: 18662 - DNA, 241 bp, Homo sapiens
cctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctcccc

SEQ ID NO: 18663 - DNA, 572 bp, Homo sapiens
  misc_feature 553: n = A,T,C or G
ttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgcaaatcttcaatggaacctttgtgaagctcaacaaggcttcgattaacatgctgaggattgtaggagccatatattgcatgggggtaccccaatctgaagcagtaaatgaactaatctacaagcgtggttatggcaaaatcaataagaagcgaattgctttgacagataacgctttgatgctccgatctcttggnaaatacgcatcatctgcat

SEQ ID NO: 18664 - DNA, 364 bp, Homo sapiens
  misc_feature 97, 263, 362: n = A,T,C or G
gatcctggggccattatcctactccaagatcaagcatttgcgtttggatggcaatcgcatctcagaaaccagtcttccaccggatatgtatgaatgnctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttatntttttaaagaaaagatgaaaggcaggcctatttcatcacaagaacacacacatatacacgaatagacatcaaactcaatgctttatttgtaaatttagngt

SEQ ID NO: 18665 - DNA, 366 bp, Homo sapiens
  misc_feature 29: n = A,T,C or G
gctttgaacgtgctataggaccttctcantcacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctaacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactg

SEQ ID NO: 18666 - DNA, 272 bp, Homo sapiens
taaaatgtaaataaaatgtgaaacgtgtcctcagagactgtgccatttctattatgttgatgtatatgtacagtaccttgccagggaagcaaaaattggaattattgtagcttttcatgtatacacacttttatttaccctattttgtgtacttcttgtgaattataatttgcagactatttcagaaaagaaattatctagtttaatttcttctttggcaaggagcctaggtattatattttgagtttgatttcaccagaaataataatact

SEQ ID NO: 18667 - DNA, 223 bp, Homo sapiens
  misc_feature 13, 26, 73, 75, 94, 102, 111, 198: n = A,T,C or G
ttaaaaaaaattntgaaaagcaaggngattgaaggattgtgatgacaatctctttgcagcagctatgtatggntnatgtgaaggatccccactnattcttgnggagcaggnttggtgagacagcagtaaccaaatgacatgccaatattactggtgcaactggtattccacaaatgcataaggaacacatagacgacntccttttaggataaaatgatgcttc

SEQ ID NO: 18668 - DNA, 141 bp, Homo sapiens
  misc_feature 51, 55, 67, 110, 119: n = A,T,C or G
tgcaatgccttggaatacccaatcccagggactacgggcctgccagatcgncagngctaagggaacngagaccagagaaagaacccaagagaactaaagttatgtcagcnacccagacntaatgggccagagccatgaccc

SEQ ID NO: 18669 - DNA, 478 bp, Homo sapiens
  misc_feature 47, 53, 58, 371, 458: n = A,T,C or G
gctgtaagaattgagagatcacaatggagtgttaaaactgactgtgnctaagntgggngtaagggtttcctgggtttttttatatacatgctctccccagaatacagtaaaccacagttttagaactaaacacatctgtaaaactaaatatagcatggaaaatccaatttgaataagtcatgctttcctagaatttaaaaataaaaaagtcttcctctggaaagagaagtcacacagacaatcatgtgccctataaaagtgagtgtttataggactaaaaaacttttaacaactttttaaggaaatatttttgttcttatacaaaaacatgtaaatattgctttattactttcattttctgaccctgctgnaaactactgcaaccctcacatcctcaaaggggacttttatgtcaaactcttctgtttctccaaatataaggaaaaaagactaagcangagactggcaggtggaaaat

SEQ ID NO: 18670 - DNA, 452 bp, Homo sapiens
  misc_feature 50: n = A,T,C or G
tcgttttcatcatatagacaaaacagccctgctgcaaagatggtcaacgnacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggctattaagagatgcaagcattttgaactgggaggagataagaagagaaaggccaagtgatccagttctaaactttgggatatttttcttcaattttgaagagaaaatggtgaagccatagaaaagttacccgagggaaaataaatacagtgatattcttaagc

SEQ ID NO: 18671 - DNA, 467 bp, Homo sapiens
  misc_feature 292, 338: n = A,T,C or G
aagaaaccaaaacataccactagagaaaatcaccttctcaaaaaggaagacaggaagtaaggaaggaaagaaagaaggaaagagagaagggagaaaggaaggaagggagggagggaggaaggaaggaaggaaagaaggaaggaaggaaggaaggaaggaaggaaggaaggaaggaaggaagggcagtaaaacaaccagaaaaccagtaacaaaatagcaaaatagaatatcaatagtaagtgaattcttacttattgatactaacattgaaagtaaatggactgaatgcttnaatcaaaagactaaatggattaaaatataagactcaataaactgtngcgtacaagaaacacactttgcttataaagacatatacactgaaaataaagggatagagaaagatatttcatgccaacgaaaaccaaaaagagcagaagtagctacacttagacaaaatagatatcacc

SEQ ID NO: 18672 - DNA, 404 bp, Homo sapiens
cttatgaatagattaatgcccttcctcggggatgagtgagttctcactgtcttgggaataggctagttcctgcaagagcaggatggttaagaagagtctggctcctcaatttctctctcttgcttttcctcttggcacatgatttctacacaaacctgatccccttccggctgctgagtggaagcagctgaggccctcaccagatacagctgcccaattttggactttccaaccaccagaatcatgagccaaataaacctcttttctttataaataacccagcctcaagtattcagttatagccatggcaaatggctaagacagggaacaacgagagctttggtatctgagagtgctgagttggaaacctagctatgctctttactcttagaaccctgtttctt

SEQ ID NO: 18673 - DNA, 160 bp, Homo sapiens
  misc_feature 15, 64, 78: n = A,T,C or G
tttcttagagaacgncattcgagacgccgtcacctatacggagcacgccaagcgcaaaactgtnacagccatggatgnagcatatgccctaaaacgtcaggggcgcactctgtatggcttcggcgctgaatctaagaatacgcggtctcctgagaactcc

SEQ ID NO: 18674 - DNA, 116 bp, Homo sapiens
  misc_feature 74: n = A,T,C or G
ttagtcagaattcctagactgaaagaacctaaacaaaaaaatattttaaagatataaatatatgctgtatatgntatgtaatttattttaggctataatacatttcctattttcgc

SEQ ID NO: 18675 - DNA, 439 bp, Homo sapiens
  misc_feature 22, 77, 421: n = A,T,C or G
tccggctggaaccatggagggngtagaagagaagaagaaggaggttcctgctgtgccagaaacccttaagaaaaagngaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatgggagtgagcccaaaggttcgaaaggtgttgcagcttcttcgccttcgtcaaatcttcaatggaacctttgggaagctcaacaaggcttcgattaacatgctgaggattgnaagagccatatattgcat

SEQ ID NO: 18676 - DNA, 540 bp, Homo sapiens
  misc_feature 359: n = A,T,C or G
gatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgnggaaactttaatttgtcttgaacagtcaagaaaaacattattgaggaaaattaatatcacagcataaccccaccctttacattttgtgcaggggattattttttaaagtcttctttcatgtaagtagcaaacagggctttactatcttttcatctcaatggatcaattaaaaccattacct

SEQ ID NO: 18677 - DNA, 266 bp, Homo sapiens
  misc_feature 137: n = A,T,C or G
tgctgagagcaagatgggtcaccagcagctgtacttggagccacccgcgaaaattcggccagggttctcgcccttgtcgtgtctgttcaaaccggcacggtctgatccggaaatatggcctcaatatgtgccgcagngtttccgtcagtacgcgaaggatatcggtttcattaagttggactaaatgctcttccttcagaggattatccggggcatctactcaatgaaaaaccatgataattctttgtatataaaataaacattag

SEQ ID NO: 18678 - DNA, 519 bp, Homo sapiens
  misc_feature 44, 86, 480: n = A,T,C or G
tctagaattgaattggaaaagtaaatgctgtaatactttgaatntagaaatctctcagagtattcaagaaacttcaggaaaaaggnaggacttgattcagattttaaagaagtgtagaattttgaaagtctcaaataactgcagtaaccatattaaaggactgattgatagtatgaaaaaccctgtgaaaatgctaccaaatgcagtgaagatggaaggaagaaggtagagaatgtgcccataatactggattaacagcagaaaagattagaagttaacatggggttagagttaggaagcaagcttagaacatcaggcagaaaaatacttaattgatgatacaatacacaatagtcgcgggtatgtttttcagcaagtgtaagatatgataaaacctgaatttagagattggatggctaacatttaattcttactaagagttcctatatactagttcacttaatcttcaaaaatatctgngagaagtgctggtattttactcatcttacaggcgcaagt

SEQ ID NO: 18679 - DNA, 535 bp, Homo sapiens
agagcgaaggtaagagattcagtaagacatgtcctttggatttggcaaatggaggtaatcgataatcttcacaaaagcaatttatttttatttgtcggagcagaagtcatatcacaatggatcaggcagaaatttgatgatgagtaagtagagcctgtatatgtcggcaactcttttgagcactgtttatgaagaaggaatgaaaaatgggaaatactgagtacttaattttctggtgagaataaaggggtaaagattgattacacagtgagaacagaaggagcaaagtccctgagaaggaggaaggaaatgatatatatatattgacataatgcctttggtaagtagaggacactgccaagtcataaagagagaaaaatacaaacattagctggacatgttagcatgtcctgtaagttccagctgctcgggaggctgaagggggaggatcacttggacccaggaggtcgagggtgcagtaagccatgattgcaccactgcactccagcccgggggacagagtgagccctgctct

SEQ ID NO: 18680 - DNA, 373 bp, Homo sapiens
  misc_feature 42: n = A,T,C or G
gaaacctgcacatcgtacacatgtaccctggaacttaaaaantttaaaatatatatgtatatatatttaatatggaattttaaaaattactaatgagttcttttatctgagtaattttgcatcaacatgcttttattatggaagagaagattcagtgagtacaaaattgcagatacatgtgtcagaagatccctgaatataataaggcttagtattctgtgtcataattgcctgtttgtattcctctctggtctttaaacttcattagggcaaggatcaactccatcttactaaccatttgattccctatgtattacacgatatatgaccaataataagccttcaataaatacttgtaaaataaagaatgtta

SEQ ID NO: 18681 - DNA, 453 bp, Homo sapiens
  misc_feature 256, 312, 419: n = A,T,C or G
agattaacttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtcttngagaagacggtagcttctgcagttaggaggtgcagacacttgctctcctatgtagntctcagatgccgtaaagcagaacagcctcccgaatgaagcgttgcattgaactcaccagtgagttaagcagcacgtgtcccgacataacattgtactgtaatggagngagcgtagcagctcagctctttggatcagtcttt

SEQ ID NO: 18682 - DNA, 505 bp, Homo sapiens
  misc_feature 35, 40, 421: n = A,T,C or G
gctttggatccatttccatcggtccttacagcctntcgtnagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattgctatttaaaacttgnaattttttaatttacaaaaatataaaatatgaagacataaacccagttgccatctgcgtgacaataaacattaatgctaccact

SEQ ID NO: 18683 - DNA, 448 bp, Homo sapiens
  misc_feature 22, 306, 326, 379: n = A,T,C or G
gtactgtgggctcagaaaccgngagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatggtaaaagtcactgtgcatttattctcagcatcaaataccttgtaacgtcttctctgccttgntagtgcatatttttactttnctgatactgtaaagaatatatccagtatgtaaatgaatgttctataaatcttntggataggcattttctctgctccttaaatatcatctctattcagagtataataaaattatgaacttgat

SEQ ID NO: 18684 - DNA, 185 bp, Homo sapiens
  misc_feature 16, 42, 79, 97, 100, 101, 123, 157: n = A,T,C or G
ggaagaggaggaagangaggaagatgaagaggatgaggaggnggaggaagatgaagaagatgaagatgaagaagaagangatgatgatgaataagtnggnnctagcgcagttttttttttctnggctataaagcatttaacccccctgtacacaacncactccttttaaagaaaaaaattgaaat

SEQ ID NO: 18685 - DNA, 512 bp, Homo sapiens
  misc_feature 388: n = A,T,C or G
tctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagccaaatatgttaactaactgcattgaagagtagaagaaaacaatagcctagtaggtttttactgggattagtgaaacaactgctatgttctcagcaacccactccaaagccaaagtcaaaactaaaattgnaaaatatctcaaaaacaataaaaatgggatatatatatcagaagctctggtatatagcaaaactgtctaaaaataatttagaaaaataatttatctcatgcaaatgaataaaaaaatctaaagg

SEQ ID NO: 18686 - DNA, 441 bp, Homo sapiens
  misc_feature 343: n = A,T,C or G
cattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgctaaagttcaatcttctgctcatttagctgatgacttgggtcatgtagtccctaactccagactccaccagatgtgcagggntaagagatgtcttgatttctataatgtccctattcaagatagatctaaattggatgaactcagtgccagtaatctgccccccaatttgaaaatcactt

SEQ ID NO: 18687 - DNA, 517 bp, Homo sapiens
  misc_feature 47, 64, 69: n = A,T,C or G
ttaaatgtaacatacaataccacagcactcctagaagaaaactctangaggaaatcttcagcgnctcangcttggtgaagagttcttagatacagcactaaatgcacagtgtttaaaaagatgctaaattggacttcattgaaatttaaaacttttgctctgtgaaagaccctgttaagaggatagaagcataacctacagtttgggaggcaatgcttggaaaccatatattcaacaaaggattcatatctagataaagaactctcaaaatcaacagcttaagaaactatccaattagaaaatggaaaaatgaaggccaggcatggtggctcatgcctgtaatcccagtactttgggaagctgaggtggttggatcacctgaggccaggaattcgagatcagcctgccaacatggtgaaaccgtgtctcttcaagaatactaaaattagcgggtgtggtggtgcatgcctgtggcccagctactcgggaggctgagcagaggatcacttgaacccgg

SEQ ID NO: 18688 - DNA, 488 bp, Homo sapiens
  misc_feature 294: n = A,T,C or G
aaatgttaactgtttgaactgaatgacttctataacagccatggatccttaaattgtgtgtcacctgtgcatttatcaatggacagttcttgcaatatttatacctgttttccattgtccaggtggtaaagccaaaatctccagaacccgaagcaacgctgacatttccatttctggacaaaatgcctgaagccaaccaactacatttgccaaatctcaattctcaaggtaaagaggacatgttttattttaggtctgcatgttctggggcccatctgtagtaaactattactnaatttaaaggaagattacgtcctttatgttggctattcctttagccagggtgtttgccagagtctgtgatagctgaatttatgacttcagaatggaaagttggagccggatccctatttgagcagaccaggaccctagctgccaagccatttggtcagccagcactataggcacaatagagcctatacaagtgt

SEQ ID NO: 18689 - DNA, 262 bp, Homo sapiens
cacaggtttttttaactgtaagagcatcagctggctctttaatatatgactaaacaataatttaaaacaaatcatagtagcagcatattaagggtttctagtatgctaatatcaccagcaatgatctttggctttttgatttatttgctagatgtttcccccttggagttttgtcagtttcacactgtttgctgcccaggtgtactgtttgtggcctttgttaatatcgcaaaccattggttgggagtcagattggtttctt

SEQ ID NO: 18690 - DNA, 510 bp, Homo sapiens
  misc_feature 41: n = A,T,C or G
aagtaaagctctcctcagcaaatgtaaaagaaaagaaattntaacaaactgtctctcagaccacagtgcaatcaaactagaactcaggattaagaagttcactcaaaaccgctcaactacatggaaactgaacaatctgctcctgaatgaatactgggtacaaaacgaaatgaaggcagaaataaagatgtctttgaaaccaatgagtacaaagacacaacataccagaatctctgggacacattcaaagcagtgtgcagagggaaatttatagcactaaatgcccacaagagaaagcaggaaagatccaaaattgacaccccaacatcacaattaaaagaactagaaaagcaagggcaaacattcaaaagtgagcagaaggcaagaaataactaaagtcagagcagaactgaaggaaatagagacacaaaaaacccttcaaagaatcaatgaatccaggagctggttttttgaaagcatcaacaaaattgatagactgctagcaagacc

SEQ ID NO: 18691 - DNA, 434 bp, Homo sapiens
aaaatgcccaaccagtgcttcagtgtgacagtatatttaaaattaaaaagaaattaaaggtcatatactgtactactttcacaaagatcacacagttttgcaaaagacttgtcatatgtacaatgctatatatcaaatgagaaaagctgtaagcaattatatacgcaaaagaaatgcagtatttacagtttgtcaggagacattagaaatcatctatacattaaattacattttgcttgcaaataactggtaaaacaaaatgagccatgtccacaccaaaatataaaaatctgtattgcatttttatacctaagatgcattcacagaactgctgctgcaggaaagaaaaaaaaaatcctcatagtgccattacttagctgagtacttaatgtgtatgtataaaataatagaacattcactaaatgaatttaact

SEQ ID NO: 18692 - DNA, 380 bp, Homo sapiens
gagcagaatgagtgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggaatttaacactttgtatcaagcatatttaaaaaagaactgact

SEQ ID NO: 18693 - DNA, 451 bp, Homo sapiens
ggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattaagtctaatcatgttttctgaaaacataaccagccattgctatttaaaacttgtaatttttttaatttacaaaaatataaaatatgaagacataaacccagttgccatctgcgtgacaataaacattaatgctaacactttt

SEQ ID NO: 18694 - DNA, 470 bp, Homo sapiens
  misc_feature 334, 403, 448, 466: n = A,T,C or G
catgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgcgcaatatgcactgtacattccacaagcattgccttcttattttacttcttttagctgtttaactttgtaagatgcaaagaggtggatcaagtttaaatgactgtgctgcccccttcacatcaaagaactactgacaacgaaggccgcgcctgcctttcccatctgtctatctatctgactggcagnggaaaggaaagaacttgcatgttggtgaaggaagaagtggggtggaagaagtggggtgggacgacagtnaaatctagagtaaaaccaagctggccaaggtgcctgcaaggctgnaatgcagttaatcagagngcca

SEQ ID NO: 18695 - DNA, 423 bp, Homo sapiens
  misc_feature 382: n = A,T,C or G
agcacagtatttaccaagcatcagtcacttgggtactaactgcaagatgtatgctaaacctctcctattatttacatagtatatttatttaaattctcaatatcttaagtttgaaaaactttaaaaataatatgtgacatctataaagtgatggtttgaatgctcactattttaatatgttaaatagattaattattagaagaaaatatgggaggcaggcacagtgacttatgcctgtaatcccagcactttggaaggcaagacaggcggattgtctgaggcaggagttcaagaccagctggcaacatggcaaaaccctgtttctgctaaaaatacaaaaattagccaggcatgatggcgcatgcctgtaatcccagctttntgggaggccaaggaggagaattgcttaaaccctagaggcgc

SEQ ID NO: 18696 - DNA, 327 bp, Homo sapiens
acatagcgaaaccctgtctttactaaatatacaaaaaattagctgggtatggtggcggatgcctgtaatcccagcactttgggaggcagaggtgagcagatcacttgaggccaggagtttgagaccagcctggccaccatggtgaaaccccatctctactaaaaatacaaaaattagccaggcgtggtggtgcacgtctgtaatcccagctactcaggaggctgagtgaggcaggagaatcgcttgaacccgggaggtggaggttgcagtgagctaagatcatgccactgcactccagtctgggtgacagaatgaaactctgtatcc

SEQ ID NO: 18697 - DNA, 189 bp, Homo sapiens
  misc_feature 31, 48: n = A,T,C or G
tgcacatcctaacaataatagtttgggattngaaaaaaattcattaanttggaagaaatagtactgagtaatgtgaaattctttgcaataacagaaataacatacgactatacaggaaaacaaactctggaagaaatatttgccagatggatatgacaaaacatttatgtttgtatggacataaagatg

SEQ ID NO: 18698 - DNA, 426 bp, Homo sapiens
  misc_feature 306, 375, 408: n = A,T,C or G
tttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgcacagcccaagatagttaagtgggatcngagacatgtaagcagcatcatggaggttgaagatgccgcatttggattggatgaattccaaattctgcntgctgcttttaatattgatatgcttatacactnacactttatgcacaaaat

SEQ ID NO: 18699 - DNA, 206 bp, Homo sapiens
  misc_feature 167: n = A,T,C or G
agagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgngctcttgtatttttaagtggattaaaaaaacttactacc

SEQ ID NO: 18700 - DNA, 196 bp, Homo sapiens
  misc_feature 74: n = A,T,C or G
tctaactaaaatgtgcagtattttcagtgtcaaatatatttaactatttagagaatgatttccacctttatgtnttaatatcctaggcatctgctgtaataatattttagaaaatgtttggaatttaagaaataacttgtgttactaatttgtataacccatatctgtgcaatggaatataaatatcacaaagttg

SEQ ID NO: 18701 - DNA, 127 bp, Homo sapiens
  misc_feature 43, 44, 64, 82, 83: n = A,T,C or G
ctgtaatcccagctactcaggaggctgaggcaggagcatcacnngaacccgggaggcagagggngcagtaagccgagactgnntcacttgcactccagcctgggcgacagagcgagactccatctcg

SEQ ID NO: 18702 - DNA, 351 bp, Homo sapiens
  misc_feature 336: n = A,T,C or G
aaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttgctactatggaccactccgaagtgtgtgggttgctagaaacccacccggctttgcttttgttgaatttgaagatccccgagatgcagcttgatgcagtccggagagctagatggaagaacactatgtggctgccgtgtaagagtggaactgcgaatggtgaaaaaagaagtagaaatcgngcccacctccctctt

SEQ ID NO: 18703 - DNA, 319 bp, Homo sapiens
  misc_feature 209, 210: n = A,T,C or G
agtaacaaagagcaccaagttttaatttaaataggggatttaacactagggatcagggagtttagttatgaagagttaaaaaaatttaaaaaacagtgtaagctgttgaaatggcaagtgaattattttaatgatgtaataaaatatttttaaattttgacatagtgatcatttaatgaaaaaactcaccaaaatgtctccatttgaanngtattgataatgtgggcatatgtgtaattcaatatatacatatacccatatgtatatacagaaaattatttttaatacttcctattgatatgaaatttaaaattggaaa

SEQ ID NO: 18704 - DNA, 244 bp, Homo sapiens
  misc_feature 35, 59: n = A,T,C or G
gactagaccaatgggacttaaacccacaaacactnaggtaacagctaagcaccctaatnaactggcttcaatctacttctcccgccgccgggaaaaaaggcgggagaagccccggcaggtttgaagctgcttcttcgaatttgcaattcaatatgaaaatcacctcggagctggtaaaaagaggcctaacccctgtctttagatttacagtccaatgcttcactcagccattttacctcacccc

SEQ ID NO: 18705 - DNA, 493 bp, Homo sapiens
  misc_feature 11: n = A,T,C or G
tccgaggtcantatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggctgaatctgtgtattttttcaagagaggtggcaggcattcagcaggtatatttataaacaggaacctgtacagaagtgccctggaagaaggcctgctctaaattatccagtgtatggagaaacgacacaggttaaggagacgcgtttgaacgtgctataggaccttctcaaacacacaccatcagaatcaatattcacctgccagactggcttatcaagac

SEQ ID NO: 18706 - DNA, 425 bp, Homo sapiens
  misc_feature 342: n = A,T,C or G
ggaataaaaaaattaaaagaagtagctgaaaacttctgagatttgatagaaaacattatacactcaaaaagctcaacaatttccaagtaagataaacacaaagagacacatcatagtaaaaatgctgaaagataaagagaaaatcttaaaaagcagcaatagaaaagtgttattgcttaaaaggaaacattaagattaatagctgacttctcatcggaaacaatgaaaatcagaagtcagtgagtgggatcactttcaaaaagctgaaaaagaatttttaactaacaattttatgcaaaatgaacacatttccagatcaactgacttgagagaatttgttgntaacagatccatcttaacaagaaatactaaaggaaattatttgggataaaagcaagtaactccagacggtaatttgaatccac

SEQ ID NO: 18707 - DNA, 508 bp, Homo sapiens
  misc_feature 410: n = A,T,C or G
agggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgnagacactgatctgctagtgctgtaatattgtaaatactgggactcaggaccttttgttaggaaaaaattgaaagaccttaagtctcgaatgtaattgg

SEQ ID NO: 18708 - DNA, 265 bp, Homo sapiens
  misc_feature 58, 113, 176: n = A,T,C or G
ggtaacacagaagctaggaggacattcgcagatgatagtagaaaggcttaattacagntctgcctgatagccacaagataaagacctgcagaagtccccaacattcttttganattttgaaatggcaggcaagagcagcgttcacagaagaatcataagtccccgaggaaagggcntgaaaataaatataaaatttaactgttatcagaaaaattatgttggcctacctgtgatgaggataggtagaaagatttcattcgatgaa

SEQ ID NO: 18709 - DNA, 493 bp, Homo sapiens
  misc_feature 36, 43: n = A,T,C or G
gtcccgcgatccccgaccatgcccgccgacctcagntttactnggaccctgctcagcagcgacaacttcgagggctacatgctggccctaggtattgactttgccactcgtaaaatagccaagttgctgaagccacagaaagtgattgagcagaatggggattcttttaccatccacacgaacagcagcctaaggaactactttgtgaaatttaaagttggagaagaatttgatgaagataacagaggcctggacaacagaaaatgcaagagtttggttatctgggacaatgacaggctcacctgtatccagaagggagaaaagaagaacagaggctggacccattggatcgaaggagacaaactccacctggaaatgttctgtgaaggtcaagtgtgcaaacagacattccagagagcctgatccacatccagcagcagagcccacttgtggctgcagctttatgccaaattatattgcagactgacagacg

SEQ ID NO: 18710 - DNA, 336 bp, Homo sapiens
  misc_feature 16, 79, 80, 232, 290, 334: n = A,T,C or G
aaaaaaaaattttttngaaccacttcagctgcataaacaatagataatgcggaaaacactagtgtacccattccctagnntgaaggggaaaaataaaaaaaacagacacagttgattttgccatgtacccttctcaattttttcctccattcttctttggaagaaaacattctccttaatgtggtgcttatcagaatgctcttccaattaagcaaatgtggctgggtgtggngtctcatgcatgtaaccccagcactttgggaggctgaggtgggtggatcactgaaggncaggagttagagatcaacctgaccaacatggtgaaaccctgctnct

SEQ ID NO: 18711 - DNA, 328 bp, Homo sapiens
ggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcg

SEQ ID NO: 18712 - DNA, 279 bp, Homo sapiens
  misc_feature 18, 41, 48: n = A,T,C or G
tacaccagaaaacgctgncctgtggaggagatgttaaagtntcccatnttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtg

SEQ ID NO: 18713 - DNA, 557 bp, Homo sapiens
  misc_feature 23, 523: n = A,T,C or G
cgatgagaccaatatatgcaatntttagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactagcgttttaccaatgatataaaagatgcagggtaccccaaaccaattttcaaaggatttggaggactaactggacaaatagtggcagcgctttcaacagctaaatataagaactggctgaatctgtgtattttttcaagagaggtgcagcattcagcagtatatttataaacaggacctgacagaagtgccctggaagaagcctgctctaaattatccagggatggagaaacgcacaggttaggagacgtcgcttttgaacgtgctataggaccttctcaaacacacaccatnagaattcaatattcacctgccagactggcttatc

SEQ ID NO: 18714 - DNA, 369 bp, Homo sapiens
  misc_feature 69, 93, 357: n = A,T,C or G
gggagactgacatatgccattatctcttttccagtattaaacactcatatgcttatggcttggagaaancccttagttgggtgaattaaaggntaatccgagaattagcatggatataccgggacctcatgcagcttgcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgaggggnaacagagtcact

SEQ ID NO: 18715 - DNA, 315 bp, Homo sapiens
cttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgag

SEQ ID NO: 18716 - DNA, 377 bp, Homo sapiens
ggcaacgccgaaccccagactcaaatttctccttagtttaagggaacgtcttcatggggatgtcttgactatctttaagggaacgtctagaaagtctctgcttcctgtagcatctcgtagaccatgcctggccagtcctgccttaccggagagctcaaggcttaaaatcaatgtccatgtgcaaccgtgacaaatggaacaagagggtgcatcatgctagcttatgatcacaatgacacatttaacgaaaacttcagtaaatagagcccatggatgaaataatagaggattagcctgggacaggataccatcctcgccccaacaaggagaaaaagaattccagcttttccaaatcactttgaattagtgatagctag

SEQ ID NO: 18717 - DNA, 398 bp, Homo sapiens
attaatgtatgaattagtaatgttttatgctttaaatagatttattgagcatcactttgtgccagtcacctggtcgattctggggacgtatattagaaaagatggatactaggcctggcgcggtggctcatgcctgtaatcccagcactttgggaggccgaggtgggcggatcatctgaggtcaggagttcaagaccgcctgaccaacatggcaaaaccccgtctctactaaaaaaaatacaaaaattagccagttattgtggcgcacgcctgtggtctcagctactaggggagacggaggcaggagaaaatcacttgaacccaggaggcagaggttgcagtgagccaggattgcgccaatgtactgcagcctggacaacagggtgagactccatcgt

SEQ ID NO: 18718 - DNA, 385 bp, Homo sapiens
ggaataagactcagcctcttttggttttcagtgaagtatgccttttcaatttggaacccagccaaggaggtttccagtggaaggaggagattcttcaattgagctggaacctggctgagctccagtgctgctgtaatgggaaggagatgtcaccaaccaggcaactccggaggtgccctggaagtcattgcctgacaataactgatgttcccgtcactgtttatgcaacaacgagaaagccacctgcacaaagcagcaaggaaatgcatcctaaatagcaccattaagtcttttgcaaggtctgactaggtcaagggtaatggaccagtatcatctggtgatctggtaaacaaataaaagtggtgcaccttcaaaaaaaaaaaaa

SEQ ID NO: 18719 - DNA, 197 bp, Homo sapiens
  misc_feature 141, 161, 186: n = A,T,C or G
gggcttcctgctgggactgagaaggctcaccgaagggcatccgcaatgttggtttcactgagagctgcctcctggtctcttcaccactgtagttctctcatttccaaaccatcagctgcttttaaaataagatctctttgnagccatcctgttaaatttgnaaacaatctaattaaatggcatcangcactttaacc

SEQ ID NO: 18720 - DNA, 317 bp, Homo sapiens
ctttggaaatgatgtttgatgtcgggaaaactcaaccacctctgatgaagagagcactttccactgagaaatagaagtttgattaaaaatcaaccttgcttcatatcaaatatttaaccaattatatgcaaattgtacaaagtatgtaggatgttttgttatagaggactatagtggaagtgaaagcattctgtgtttactctttgcattaatatataattcttttgactttgtttctcttgtgtagtggaaaatggtagctggtgcttattgagatttgctgtatttatatcaataaagtatagtaaagcagttgt

SEQ ID NO: 18721 - DNA, 423 bp, Homo sapiens
  misc_feature 64, 148: n = A,T,C or G
gtaagtgggaaatgttttgggagaacaagaaagcccaagtattgcatttaggcaaatcataagngcatagtgtgccagagaaaacaaatgtttttcctgcactggttctgacatgttcacacatgaatgtgtttcattcagaaaaagnaaaggctctagaatggcacagtctggttttatgagaaacagatgtgccatggttcacccactccctgaccacctgtggtttgcccatgactcaactttcttgaatgaggggagttaactcttggattctgaacaaactctaaattacatatttattttcttcctcctcatacttcttttcaccactcattgccatgatagaaccttacaattctgagaaggttgaattctcaacaccccaaaacattttcatttaaaggtggaatccttgctaaa

SEQ ID NO: 18722 - DNA, 453 bp, Homo sapiens
  misc_feature 414: n = A,T,C or G
tttattatacctctctggaaagtaaaaataattattgtaatatcgagcttattagtattttcatttgtttttacatatttgaggaataggtgttctgtgtcacatatttgaggaataacttctgtgtgacatttgaggaatagctagccttaactgcaagtaagtttcttatgctaatttggttatcagtaattgttgagaaaggacttaagtgcttgacatttgtacatttgtacattcagtgtttttctttacactctcttctataacgctaccattttgccctattaatagttacagacagccaggcgtggtgcatatgcctggaacctcagggactcaggaagctgaggctcaagggattgcttgggcctgggagtttgaggcttcagtgagccatgatcatgccattgnactcactccaacctgggcaacacagcaagaccctcttcc

SEQ ID NO: 18723 - DNA, 429 bp, Homo sapiens
  misc_feature 346: n = A,T,C or G
atgtagacaaagtgtgagatggagaatacaataggaagtactacattccaaaagagtaaaaaatctttcctactagattttaatcactcattttttctgaaatttgtagaatatttagtgatttgctttcctgactgtgttagcagatgtcatcatacccctaaaattccactattggtaataatcaggcttcagtatctttaagagtaaacctcctctggaaatttagaaatgccatagaaaacacttcagtgcctaaagatgtgttttgcccctgtagaaaattctttgtttgacacctcctatgtgggagttgctttaacctgtatttttacttttggatttnaaagccctacctcattctgtgacctttgtgtcagagacacctccagcaatagtagagtgaccattttgagtcagcatctgatt

SEQ ID NO: 18724 - DNA, 113 bp, Homo sapiens
gggatcccagccacacttgggaggctgaggtgggagaatcacttgagctcagtgagccatgatcgtgccacatgacactctagcctgggtaacagagtgtgataccatctctc

SEQ ID NO: 18725 - DNA, 363 bp, Homo sapiens
aaaatccttaacaaaatgctagcaaactgaatccaacaatgcatcaaaaagataatataccatgattaagtggggtttactctagggatgcaaggacggtgcaacatatgcaaatcagtcaatgtgatacatcacatcaacagaatgaaggacaaaaaaagtatgatcatctcaatagatattggaatatatattggtataaatacacaaagtaatattattctgacataataaagaataaaatcctgtaattcatggcaacatggatgagcctggaggttatgatgttaagtgaaatgagtcaggcacagaaatactgaaggtactaactcatgtgtaggagctaaaaaacttgagctcata

SEQ ID NO: 18726 - DNA, 342 bp, Homo sapiens
tagggagtccctttgatactatgtaaagatactatttctcctgaaacttttaatttactcagttatttatatcagtatggatgcatgtctttattttattcagtgtgttataacttgttaatactgtcttttttaattttcgtgttcaagttgtccaatatttggtcaataagagcccctttaagctggcttctgtgtacatttagtatatacctttcattctttgagtattttcttatacaacaggataagttgtgtcttcttgcttgtctcattccttgcttgttccagtctcattcttgcttgtccagcctaattggaatcagtgattctctaaggagt

SEQ ID NO: 18727 - DNA, 321 bp, Homo sapiens
  misc_feature 34, 54, 172, 198: n = A,T,C or G
tcaaatctctggttgacttgacagcaggggacgncccaactcggcaaaaccgtnttgagattgtctacaacctgttgtctctgcgcttcaactcacggatccgtgtgaagacctacacagatgagctgacgcccattgagtctgctgctctgtggcaaggcagccaactggnatgaaagggagatctgggacatgttnggagtcttctttgctaaccaccctgatctaagaaggatcctgacagattatggcttcgagggacatcctttccggaaagactttcctctatctggctatgtttgagtacgttatgatgatgaa

SEQ ID NO: 18728 - DNA, 325 bp, Homo sapiens
  misc_feature 46, 311: n = A,T,C or G
tttatacccttggagcttcatgatcacaggatggctgttatagctncagccatcatgaccaagttcagactccaggaacaagatggaggaagctatgtcaaagggggcttttcttgatgtgtctctcgcctttaaccagtgaagaaaatcttcttagaaggacacagcagacttctccttatgtctcattatccagaagtggaccacaggacagtccctactgtaaactctttcaagtatcaggcaaaaaggaacaaaaggccccagcctggcttaaaccaaccttgagcatcacctgacactggacactntgtttatccaagca

SEQ ID NO: 18729 - DNA, 454 bp, Homo sapiens
gatttgcaatattcctttgggcctctgcttctctcacctaaaaaaagagaattagattatattggtggtctcagcaagagaaggagtatgtgtccaatgctgccttcccatgaatctgtctcccagttatgaatcagtgggcaggataaactgaaaactcccatttacgtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacaggctgggctctcaaactaaaagacatttgttattttggaaagaagaaagactctattctcaaagttcctaatcagaaatttttatcagtttccagtctcaaaaatacaaaataaaaacaaacgtttttaatacg

SEQ ID NO: 18730 - DNA, 354 bp, Homo sapiens
  misc_feature 97, 289, 295: n = A,T,C or G
attaagactgagggaaaacagaaaaaggacaggccgccatgtagaagaaatttttaaactaccagtttttaaaatgggaaaggaaccaaatggtttngtataatcccatataaaaatgtccctcataatgaatctcagactcaccttaaaggaataattctcaggattctcttccatgctggggctccagtaagagtcaagatttggggctttcttaaagcaggcttcaaaccttaaaagcataccttattgaatgccagtccagcattctcaaataactgtgcccccnagtggncacatgtacctttaaattacatgcagcaaaaaggtgcaattaaccaggtcctggactgc

SEQ ID NO: 18731 - DNA, 399 bp, Homo sapiens
  misc_feature 45, 240: n = A,T,C or G
atttcagccacttgctctgagaatttgtgagcagcccctaacatnctgttacttcactacaactgacgatatgatcatcttagtttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggngtgtgaatttgaaggcggcatctcgcaacttacaagcagctagaggcagcagaaaaattggatttcatgtctgtgctgctggatggatggctaaggcagagttggataccccattgtgaagccaggcccaactgtggatttggaaaactgcattattga

SEQ ID NO: 18732 - DNA, 372 bp, Homo sapiens
  misc_feature 34, 42, 43, 356: n = A,T,C or G
ggatccttcttgccatcctggccgccttagcggnagtaactnngtgttatgaatcacatgaaagcatggaatcttatgaacttaatcccttcattaacaggagaaatgcaaataccttcatatcccctcagcagagatggagagctaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgnatccccctgtagcagc

SEQ ID NO: 18733 - DNA, 439 bp, Homo sapiens
  misc_feature 42: n = A,T,C or G
aacctgttacaactgacaacattggttttctgcagctagggnttcttgagtcgagactgctcgccttgatgacttgctcttttttggcagatgtgtggagttggctgttacgacatccctgtgtgatcccagaggaggggcagtagctgggcagaaactgcaggcacacatttgggtggatcacctggcttccagccccttcggggtggtgctcagtgtggggtgatggtatcatagaggaccacggcgcttatcagcattgtttctttggagtctgtgtaatggaatgtatttttcaaatactgatatttgcattttctgtaacaattccttataataaaatgaagtaaaattgtgcatttaaagtggaaactttaataagacatttgtaggtacttctaatgcagaagtaccaataagcattaaaaacaaattttgg

SEQ ID NO: 18734 - DNA, 458 bp, Homo sapiens
  misc_feature 338: n = A,T,C or G
gccttcatcagtgcttctcaaaaccatgtctgtgtcttactgctgaagaaagttttgaggcacttgccctgtgaggtctcctttgacccacaggcaggattagtcacttcttggtgcttccctaaccctttcaggtatctctgtcacagcaacttgtcacacgtgagcgatctgtctcctctgttcctgtaggagctctgtgaggtctggatgcatgtcttgatccactttgagtccttactacatagtacagtgcctgaaacatcagagcgtgtaagaaaatgcttgctgaataattgcatcattatcctggcagtcattatttatatgcctgctgnacaccagccagtctcccaacttttggagatataaagagatccagaccatctctatggcaacaaaagatatgacaaccaaaggggttctggtaatagataccttttaattaaatgagaacg

SEQ ID NO: 18735 - DNA, 372 bp, Homo sapiens
ggatccttcttgccatcctggccgccttagcggtagtaactttgtgttatgaatcacaggaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggttatggatacaatgctgcctataatcgctacttcaggaagcgccgagggaccaaatgagactgagggaagaaaaaaaatctctttttttctggaggctggcacctgattttgtatccccctgtagcagc

SEQ ID NO: 18736 - DNA, 444 bp, Homo sapiens
aaatagaattaggtttattcttgcagttcttccatggtattaattacacatgaggctcttccgtctactcagtattcttggttagagtatggttatttttcttggactagtattaggaagttgcttaacaaattttaacacaaagcaaacatttatgtacttgctgtatacatgaattgtttttcttctttataggttccctggcttcaaggaagtaccgtctggtaccagggaggcatgacattgcttttgttgaatttgaaaatgatgggcaggctggagctgccagggatgctttacagggatttaagatcacaccgcccatgctatgaagatcacctatgccaagaaataacatttgggataggcggtctttaaaagacttggggtattacagggttggttttgataacattggctggggtcatttaaatagtaggagat

SEQ ID NO: 18737 - DNA, 402 bp, Homo sapiens
  misc_feature 16, 237, 366: n = A,T,C or G
gccagagcactctgtnctttttaataaggtctgacctcaggagaaactagctaaccagagcctaatctgtggggtttgatcagagcctaactgatctgggagaatggaaatactcaactctagtcatcctgtcccacctaaaaggggagaaagaagactagaaaatatttgttcaagagttcagaggcataggtgcactgaaaggctgagacctaattgtagggactatagaatgtntcccctttccccacaccttatcaccacattactaaaggcctatttacagctattgcttttacccagtatatcatgtctggctgcaagaaaaaattacaaggcatactgagaggcaaaaaacacaaggtngaagagacagagcaagcatcagaagcaggcatggct

SEQ ID NO: 18738 - DNA, 281 bp, Homo sapiens
  misc_feature 11, 12, 270: n = A,T,C or G
gagcaaatggnncgtaaaacttcagtcaagaagctgacaaaaaaggacatcgaggatacactgtcagggatccaaacagctggctgtggatcaacttttttcagagaccttggcgataaagggctaatttcattttgccattttacaacccacttggaagactttgctattgccatgcagatgttcagtttagctcatcgtcctgtcagactagcggagtttaagagagctgtgaaagtagcaacaggacaagaactctcaaacaatatnttggacactgc

SEQ ID NO: 18739 - DNA, 399 bp, Homo sapiens
cagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctgctgtggcttcatttcccaagaagcaggagtgacttcagtcatcccagcaatcgcttggtcaagtttcattcagctctctatggccagtaatctgataaataaccgagctcttctttgggggatcaatattattgacttgaagaactgccaccaataaagcagtcttaccatg

SEQ ID NO: 18740 - DNA, 134 bp, Homo sapiens
  misc_feature 49, 53, 58, 59, 97, 125: n = A,T,C or G
caaggaagccacgtgcagacatctacaaccttcgatctcctgacgagtntatngttgnncaaaaccaggctttgattgaaccaggatgaatgcgggngttggaagtagaatatatatatatacanataaaattg

SEQ ID NO: 18741 - DNA, 451 bp, Homo sapiens
  misc_feature 10, 21: n = A,T,C or G
cacagggcangacccctgtgntttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaggcgcaggacaggctgcattggggccaaacgcagaatcagcaaagaggaggccatgcgctggttccagcagaagtatgatgggatcatccttcctggcaaataaattcccgtttctatccaaaagagcaataaaaagtttcagtg

SEQ ID NO: 18742 - DNA, 266 bp, Homo sapiens
  misc_feature 34, 162, 240: n = A,T,C or G
agcatttacacctttggtgaagttggaacgactntatctgtccaagaatcagctgaaggaattgccagaaaaaatgcccaaaactcttcaggagctgcgtgcccatgagaatgagatcaccaaagtgcgaaaagttactttcaatggactgaaccagatgantgtcatagaactgggcaccaatccgctgaagagctcaggaatggaaaatggggctttccagggaatgaagaagctctnctacatccgcattgctgataccaata

SEQ ID NO: 18743 - DNA, 312 bp, Homo sapiens
ctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgt

SEQ ID NO: 18744 - DNA, 369 bp, Homo sapiens
accatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgcttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaa

SEQ ID NO: 18745 - DNA, 327 bp, Homo sapiens
aagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagt

SEQ ID NO: 18746 - DNA, 180 bp, Homo sapiens
cgcatgttgctgaatggctgaggaccttcccagcctccccagagtccgtgcctttccctgtgtgaattttgtatctagcctaaagtttccctaggctttcttgtctcagcaactttcccatcttgtctctcttggatgatgtttgccgcagcattcaccaaataaacttgctctctgggc

SEQ ID NO: 18747 - DNA, 344 bp, Homo sapiens
aacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggcttgtccagaaaacgtaatgaggatgaagattcaccaaataagctatatactttggttacctatgtacctgttaccactttcaaaaatctacagacagtcaatgtggatgagaactaatcgctgatcgtcagatcaaataaagtt

SEQ ID NO: 18748 - DNA, 128 bp, Homo sapiens
  misc_feature 15, 97, 115: n = A,T,C or G
gtacaaaataacttnattgcttaatatcaaattacaaagtttagacttggagggaaatgggctttttagaagcaaacaattttaaatatattttggncttcaaataaatagagantaaacattgaatg

SEQ ID NO: 18749 - DNA, 187 bp, Homo sapiens
  misc_feature 86, 93, 107, 155, 158: n = A,T,C or G
actacaagaacatcgggctgggcttcaagacacccaaggaggctattgagggcacctacattgacaagaaatgccccttcactggnaatgtgnccattcgagggcgnatcctctctggcgaggggaccaagatgaagatgcagaggaccattgtnatncgccgagactatctgcactacatccgcaa

SEQ ID NO: 18750 - DNA, 175 bp, Homo sapiens
  misc_feature 54, 152: n = A,T,C or G
cagagctcaggcccagggagtggaaacccttatttgtgtggctttactgtcttnatgagacagggccacacaagctcataggatctcaggaatgttctcattattgataatgcccaatgtgggaagaatctcttgcttgggatgagaggggncctaagaagttctcttggctcta

SEQ ID NO: 18751 - DNA, 453 bp, Homo sapiens
  misc_feature 9, 54, 56, 57: n = A,T,C or G
gtaccaaantaacaatcaggagagtggattctctcctgttatcctggaccagtntnnatgaaaggattcctgaaatgaaatccatatattccatgtagactggaaaaactcatgtcctaatcctttttgtactgttggaaccacttcattggacatgttgcaatagcaaaacccccagttagattagtgtttacacattttctcagttatttaatatttaatgttttccttaatactcaagtgatgtttgctctagtgtctaatgtagcacaaatcctatgtaaaatcatactatgtatttttgacattaatgttgaaatcaaatatatgcacaagtctttaattttgtgtaatgtgttaagtgctgtcatttaagtattgaaaatgagaataaaatggtgagctctttaaaagtaacacactatgcaagcatggggacttttatatctctca

SEQ ID NO: 18752 - DNA, 357 bp, Homo sapiens
  misc_feature 13, 43, 51, 61, 62, 114: n = A,T,C or G
gaaaagggaactntcatgctcacagaattagatttagctgttnctactgtngatactcatnntgactatgctacagtagcaaaccaacatctgaaaaattctataaatatgccnatcattttccgtagacatctatttttattttttgtcattacactgaatatgcaattcatgacatcatttcccacactaggacagctaaggtgtgatagagagaaaacaggatttagagacaggtattggaagctcaactttactacctgttcctatacaacacgagtgagtcatttaatgtctctgagcccctattccaactgagaaggcatgttgtagattatcaggcctatacagatgtaa

SEQ ID NO: 18753 - DNA, 363 bp, Homo sapiens
cgacggaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcaggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatg

SEQ ID NO: 18754 - DNA, 110 bp, Homo sapiens
gaaagagaaacaagtgactgagaagtcttgttaaggaatcaggttttttctacctggtaaacattctctattcttttctcaaaagattgttgtaagaaaaaatgtaagac

SEQ ID NO: 18755 - DNA, 506 bp, Homo sapiens
  misc_feature 27, 30, 33, 38, 47, 75, 100: n = A,T,C or G
aattatgtgggagaggaagaatttttngtncgntagtntgttttttncttttctgagatggagtgtcgcttttgntgcccaggctggagtgcaatggcgnagatcctggctcactgcaacctctgcctcccaggttcaagcaattctcctgcctcagcctcctgagtagctgggattacaggcatgtgtcaccatgcccggctaatttttgtatttttagtagagacggagtttctccatgttggcaggctggctcaaactcccaacctcaggtgatccacccgctcggcctcccaaagtgctaggattacaggcgtgagccaccacatccggctgggagaggaagaatttttacatggccagccagctttgtattcacacaaatgcagtaccaccatatttattattgagccttggttccaatgcccatgcccaggccaccttaagtctagaggtcagccaaacacctaagcactctacccttgaaactgagatatattgcctga

SEQ ID NO: 18756 - DNA, 591 bp, Homo sapiens
  misc_feature 521: n = A,T,C or G
aaaaaacccacttctaccaaaaagccaaaaacaatgccttagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcgggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactggttttactaggngcaactgtgaaggaaaaactttcttctttaaggattctcagtactggcggtttaccaatgatataaaaga

SEQ ID NO: 18757 - DNA, 520 bp, Homo sapiens
taaaacctaacaaacagagttagagctaatacagtagctctaattattgtatggtggagagtaaatgtaataaatattactcatttaattctaaagaagacaggaaaagaggaaagaaggaacaaagataatacatttaaaccatatgatattgatatttgcattaattacagaaggtctaaatttcagttaaaaggcagagattatcagattggctagaaaagaagatgcaactatgagctgctacatgagcccaccttaaatactaagactcagataaattaaaagtataaaaggatagaaatagatatgccatgcagacattgatctgaagaaagctggagtagctatgttaataatagacaagaagatttcagagcaaagaatttacagaggtaaagagagacaattcataatgataaaggggccaagacatcaagagacctaacaatcttaaatggttatgccagagcttcaaagacatgaagcaaaaccggatgcaattgaaagaagactacct

SEQ ID NO: 18758 - DNA, 406 bp, Homo sapiens
  misc_feature 391: n = A,T,C or G
gccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccatggctatttaaaacttgnaatttttttaatttc

SEQ ID NO: 18759 - DNA, 244 bp, Homo sapiens
  misc_feature 91, 138: n = A,T,C or G
gaagttgacttactgaagaatggagagagaattgaaaaagtggagcattcagacttgtctttcagcaaggactggcctttctatctcttgnactacactgaattcacccccactgaaaaagatgagtatgcctgccgngtgaaccatgtgactttgtcacagcccaagatagttaagtgggatcgagacatgtaagcagcatcatggaggtttgaagatgccgcatttggattggatgaattcc

SEQ ID NO: 18760 - DNA, 272 bp, Homo sapiens
  misc_feature 5, 42, 65, 66: n = A,T,C or G
gactngtagccttgtgaggcaagtaaatctctgtcatgttanccactcagactggggggttactnnagttatggttacttggttatggctgccatactctattacggtagccttagcaaactaatacatatatattaaaattctagcacatggacagggaatggactggcctgattggggagggttcgtagtagggtcataagtgtgagacagggtgaaggtttggcaggttttgagtagagaaagaggttggcataattagtgtttcaggg

SEQ ID NO: 18761 - DNA, 150 bp, Homo sapiens
gagcttgaggaaaccgcagataagtttttttctctttgaaagataagagattaatacaactacttaaaaaatatagtcaataggttactaagatattgcttagcgttaagtttttaacgtaattttaatagcttaagattggaagagaaa

SEQ ID NO: 18762 - DNA, 235 bp, Homo sapiens
gaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtg

SEQ ID NO: 18763 - DNA, 470 bp, Homo sapiens
agagctttttgtaggcatgcacaactttcagaaaatttatttcatatcattagataaaatagtgcatttgtaaggcgattagttgaatacctggcacatagtaaacacccagtaaatgctggctgtgattgtaccggtttattttatgccatgtcagaattcctgtaatgaagagagtagtggaaaaaataaccacgctgaaattcaggtgcagtcagccagcagcttaatcttcattgtaaatctattcagtttgtcagacatcctgatataaacactcagcattgccataaaatccgtggcatctgaataaaaggaaattatgtgaagagtgcacattgggcacctgttgactcttcatgattttggatgtggagtaagatccaggaggcatggggccagtagaaaggagggagagctctaatagagagtcttttatttaaatttgatgcttttgagaaaatgatata

SEQ ID NO: 18764 - DNA, 101 bp, Homo sapiens
atcaagctaccaatgactgtcttcaaagaattggaaaaaactactgtaaaggtcatatggaaccaaaaaagagcccacattgccaagtcaatcctaagcca

SEQ ID NO: 18765 - DNA, 193 bp, Homo sapiens
gggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtgataaaaaaaaaaaaaaaaaaaaaaaaaa

SEQ ID NO: 18766 - DNA, 289 bp, Homo sapiens
  misc_feature 64, 73, 123, 136, 143, 250: n = A,T,C or G
cacaaatatgatccaattaattgtaaatcaattaaaaagagactgttcatgagagacacaggantactagctnaaccaccaggcaaaccagacatccttaaaataagacaaatgaagtatacnttgatataacagntaaatgnggataatgaattctttaatttactgaaaattttactatgtgggatatgtcttcattttaataaccaaaatttataaaagtacaaattagaatgagggccattttggnaagaatatatactaatacaggtaactagtagttatccat

SEQ ID NO: 18767 - DNA, 185 bp, Homo sapiens
  misc_feature 174: n = A,T,C or G
cccactggggaggtagaggaaatgacagagaaaccagaaatgacagcagaggagaagcaaacattactaaagaggagattgcttgcaggagaaactcaaagaagaagttattaataagtaataattaagaacaatttaacaaaatggaagttcaaattgtcttaaaaataaatnatttagtcctt

SEQ ID NO: 18768 - DNA, 232 bp, Homo sapiens
  misc_feature 33, 120, 205, 210: n = A,T,C or G
tataaaagatgcagggtaccccaaaccaatttncaaaggatttggaggactaactggacaaatagtggcagcgctttcaacagctaaatataagaactggcctgaatctgtgtatttttncaagagaggtggcagcattcagcaggatatttataaacaggaacctgtacagaagtgccctggaagaaggcctgctctaaattanccagngtatggagaaacgacacaggtt

SEQ ID NO: 18769 - DNA, 114 bp, Homo sapiens
agctacctgggaggatgaggtgggaggatcgcttgagcccaggaggttgaggctgccatgaactatgattgcgccactgcactacagcctgggcaatagagtgagaccctgtct

SEQ ID NO: 18770 - DNA, 184 bp, Homo sapiens
  misc_feature 157, 173: n = A,T,C or G
aatcaaagtaaaaagaatttgggggttagtactggaagggggatgggaagcgtatatatatatatttccaaactctttagattttcaaactttgtctcctgaggactttgccacttccagaactgtttcaggagctgctgagggagaaggaggcagngcacgtccactgatgnggttgaatgtg

SEQ ID NO: 18771 - DNA, 210 bp, Homo sapiens
  misc_feature 6, 34, 127, 138, 139, 175, 187: n = A,T,C or G
gaaatntgcaacagaagctgcaatcaccattctncgaattgatgatcttattaaattacatccagaaagtaaagatgataaacatggaagttatgaagatgctgttcactctggagcccttaatgantgatctgatgnnccttttatttataacaatgttaaatgcaattgtctnggaccttgaggngagtattacacattaaagtaaag

SEQ ID NO: 18772 - DNA, 201 bp, Homo sapiens
  misc_feature 18: n = A,T,C or G
agctgaaattgctttggntccccaaatgccttggaactccagacgcacccgcaggcctgaggtaggcttcatagagttctaggacttccatgtgcgttgcaccagatcctgcccagcaatggcctttcccttctaaggcattagattcagccaaaagcgacctcttctctagtccgtggttacgaacagaagttctgagtt

SEQ ID NO: 18773 - DNA, 348 bp, Homo sapiens
  misc_feature 15, 17, 46: n = A,T,C or G
tatcacaaaaaagantntgaaggacctcaaagcacctgaacagttnatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggcaaacaagtgtctgtatctactttaataaatggtattctcc

SEQ ID NO: 18774 - DNA, 247 bp, Homo sapiens
  misc_feature 54, 84, 85, 136, 182, 206, 209: n = A,T,C or G
gacccagacaaaagaccacttctaggaaagagaaaccagcagagctttaatggntatggagggatagggtaatacactggaaanngaggccctcaaatgcagaaccaatttttcctaaaggccatttgcaaatttnggggctgcatgtgaggctgggaaggttgacccagagcttctaaagnacaaaatgaaatctctcagaaccnganggtatttggatagcatatacccaccaagaggaacaggc

SEQ ID NO: 18775 - DNA, 316 bp, Homo sapiens
aaagtgaagattgcagttgggagctaattactaatatcttttaacaactttggaacatagatttccagcagattatacatatggttgaaagaccaaattgctttattccaatctaaaatttatggagtgattctacactaaagattgcactgacagcatggattcaggcattctaaagtcactggagcagataaattgctgagaaagaagtaggtatcaacaatgggcttaaaatattcaagtaaattggatctgctgccatatggcaaacaggaacagctccagtctgcagctcccagcgagatcgacatagaag

SEQ ID NO: 18776 - DNA, 148 bp, Homo sapiens
  misc_feature 39, 83, 84, 85: n = A,T,C or G
aaatatccacagtactcactttttccaaatgatcctagnaattgcctagaaatatctttctcttacctgttatttatcaattnnncccaggatttttatacggaaaaaattgtattgaaaacacttagtatgcagctgataagaggaa

SEQ ID NO: 18777 - DNA, 382 bp, Homo sapiens
  misc_feature 33, 138: n = A,T,C or G
acattagaaaaattaaaagtagttcctctttantagaaggttggaaatttcttttaattggtttgttttagaatgatgtgctaaaaatttgactggatgatagtctcaaccgtaggaaaaatttgattcgaggggaanacttagaattatagtttgaaaagtctcatttccatcttagaacagttaataaaatcttttaaatggagaatgttggccatatttggaaattcataccaggctaatttcctagtgttcattgaaatagtaaacatggtgaagaagagaaaccattcactacaacttatgtatttggcttttaagaagccatagaaaaggcttgtttgaaaagaaaatgtgaccccggaaaatgcttctcatgttt

SEQ ID NO: 18778 - DNA, 364 bp, Homo sapiens
  misc_feature 21, 51, 104, 118, 191, 192, 195, 265, 307: n = A,T,C or G
cctggcatagtcctattaaangccatatgaagccagatatgattgggtgcngatgtggtgttcctcatattatggtacagggccaaagacttgagacgtggggntttacatggggacncacattatgaatggatttactagaagaacattgctgctccttatttattgtagtgtgctgcatggaacggatnnatntgaaagcattaaaataaatgatcctagagcatgtgcataatgagaggactgtattctctctgctgctggngagggtatattaagtccacatagcaattacagtatgccaggnccactgaagacatgaaatcttaagaggtccttgcagggaacgaaatgaattttaatg

SEQ ID NO: 18779 - DNA, 155 bp, Homo sapiens
ggggttggagcttaaagatccaaactgagaaagcaggccgggcatggtggctcatgcctgtaatcccaacactttgggaggccaaggagggtggatcacttaaggtcaggagtttgagaccagcctggccaacatggcgaaaccctgtctcttct

SEQ ID NO: 18780 - DNA, 224 bp, Homo sapiens
  misc_feature 91: n = A,T,C or G
taccccagggagaatctgagacatcttgcctacttttctttattagctttctcctcatccatttcttttatacctttcctttttggggagntgttatgccatgatttttggtatttatgtaaaaggattattactaattctatttctctatgtttattctagttaaggaaatgttgagggcaagccaccaaattacctaggctgaggttagagagattggccag

SEQ ID NO: 18781 - DNA, 338 bp, Homo sapiens
  misc_feature 297: n = A,T,C or G
gaaaaattatagccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgtnagtccaaagaggaacagctctttggcactaggaaaaaacct

SEQ ID NO: 18782 - DNA, 183 bp, Homo sapiens
  misc_feature 12, 43, 86, 99, 101, 107, 131: n = A,T,C or G
agctattaaggnactagagttgataaatgtgtacagggtcctnttgcaataaaactggtatgacttgatccaagtgtttaacaatnggggctgttaagncngaccanacatcactgtgatagaatgtggcnttttcaggggtgaagatacaagtcttaaccacagtgtaacttacagtttcct

SEQ ID NO: 18783 - DNA, 327 bp, Homo sapiens
tatatgtatagaaagagatacagtaaggaatataagtttttctattaacataggtaacccaaggtaggggatatgatgtttacattctcttatttgtgttttctaactttccaccaggcacatacactgtttctataataacacgtgctggttgaaaatgtcagactctgaaattcaatgttttataatatagggtgatagacaagagggatggatagagcaagaagaatgaaacctaatagggttagttagagccctactgagtgaatctcttgttgggtattttccatgcactgctcgtttcattcttacaataaacctatgaag

SEQ ID NO: 18784 - DNA, 271 bp, Homo sapiens
tgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactccttaaaaaaaaaaaaaaaaaaaaaaaaaaaaa

SEQ ID NO: 18785 - DNA, 252 bp, Homo sapiens
gtgagtgcacttccaccacctccaatgcaatatatcaaggaatatacggatgaaaatattcaagaaggcttagctcccaagcctccccctccaataaaagacagttacatgatgtttggcaatcagttccaatgtgatgatcttatcatccgccctttggaaagtcagggcatcgaacggcttcatcctatgcagtttgatcacaagaaagaactgagaaaacttaatatgtctatccttattaatttcttg

SEQ ID NO: 18786 - DNA, 275 bp, Homo sapiens
ctaagggacttgctcctgatcttcctgaagatctctaccatttaattaagaaagcagttgctgttcgaaagcatcttgagaggaacagaaatgataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaaccaaaaaaaa

SEQ ID NO: 18787 - DNA, 300 bp, Homo sapiens
gaagttctgttgggttggaagaattggcaaaatatctggccattaagaaaacggattttgtaactagctataaactaggccaagcaactagttttcctgcaaatcaaatttttaaagcaacttgggttagactttgtttttgacctaacatcccttccttaaatgcctctgtaggttcagatcagtagggagaccatataataatttatggacctgttcaaacatatttttctgttttataagtaagtggatattaattaaactcttggcaatatttcttctttcttaaaggaaatatcc

SEQ ID NO: 18788 - DNA, 252 bp, Homo sapiens
gaagcaccttccctgagaagggaagaggggatctttggactaggttcttggctccagacctggaatccacaaaagccaaaccagctcatttcaacaaaggagctccgatgtgaggggcaaggctgccccctgccccagggctcttcagaaagcatctgcatgtgaacaccatcacgcctttataaaggatccttattacaggaaaagcatgagtggtggctaacctgaccaataaagttattttatgattgc

SEQ ID NO: 18789 - DNA, 387 bp, Homo sapiens
taatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatggtaggcctaaaagcagccaccaaaaaaaaaaaaaaa

SEQ ID NO: 18790 - DNA, 169 bp, Homo sapiens
  misc_feature 52: n = A,T,C or G
gcagtatctagaaaaatgaaccgtagtgttttgtttttttaaatacagaagncatgttgtttctgcactttataataaagcatggaagaaattatcttagtaggcaattgtaacactttttgaaagtaacccatttcagatttgaaatactgcaataatggctgtcttt

SEQ ID NO: 18791 - DNA, 427 bp, Homo sapiens
  misc_feature 9, 53: n = A,T,C or G
cacataagngaagaaatctgtcagataggaatctaaatatttatagtgagatngcgaaagcaaccttaaagttttgaagaagactgatgagactaggtgctttgcttcctttcatcagggatctttctgtggcatttgagaacagaaaccaagaaacatggtaattactaaattatgaggctttgtttttgtttgcttttaagtagaaaaacatgttggcaacattgagttttggagttgattgagataatatgacttaactagttttgtcattccatttgttaaagatcagcaccaagaatgttttgagttttttgaaagaccccaatttaagccttgcttatttttaaattatttccattcagtgatgtgggatgtatatcagttatttagtaaataatctcaataaatttgtgctgggcctttg

SEQ ID NO: 18792 - DNA, 267 bp, Homo sapiens
gtgcctattagtttctgaatatctgtgcataaaagcttctgtttctctgcctgcacacatttgtgggtacacactatacacctatgtggggtaggaggggggaatgggcatatttgtttgcatttaccttgtgtttggcctaggaagggatcttggtgatcattccagcccagctctttcacctcaatggtgaagaaactgaggtccagaaaggcaaggtgacttgtcacaaggtaacacagctgctatggagacagaggtgacaca

SEQ ID NO: 18793 - DNA, 207 bp, Homo sapiens
  misc_feature 9: n = A,T,C or G
ccacgatanatggttgagtaaaataagcttataaaatagacttataaaatgagtcaattaaaaatttgtatagatacatagaaatctagaaagatactcttattatctaaaattgtaagtggttttatctggctagtaggatcatagatattttcattttttataaaatatgaaaaaattataaattttttattattagataaatgc

SEQ ID NO: 18794 - DNA, 202 bp, Homo sapiens
  misc_feature 32: n = A,T,C or G
ctctttaaaaataaaaccaaaacaaagcaatnaactgcaaagggctatagtaacccaaagcaaagtttacatatttaaacataggggagtaaggaagtacagaagttaaacaacaagagagataatcttgaaagtggcaaaagtgacttatctcacttaaaagagtctcaataaggctgccgctgatttctcttcagagacc

SEQ ID NO: 18795 - DNA, 364 bp, Homo sapiens
  misc_feature 254, 274, 328: n = A,T,C or G
ctgggaggctatcccagcggactccaaagattcaggtttactcacgtcatccagcagagaatggaaagtcaaatttcctgaattgctatgtgtctgggtttcatccatccgacattgaagttgactcactgaagaatggagagagaattgaaaaagtggagcattcagacttgtctttcagcaaggactggtctttctatctcttgtactacactgaattcacccccactgaaaaagatgagtatgcctgccgngtggaaccatgtgactttgncacagcccaagatagcaagtgggatcgagacatgtaagcagcatcatggagggntgaagatgccgcatttggattggatgaattccaaaa

SEQ ID NO: 18796 - DNA, 489 bp, Homo sapiens
  misc_feature 360: n = A,T,C or G
aacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggntgggatcaatagggaaagcatatgcagccaaccaagatgcaaatgttttgaaatgatatgaccaaaattttaagtaggaaagcacccaaacacttctgctttcacttaagtgtctggcccgcaatactg

SEQ ID NO: 18797 - DNA, 254 bp, Homo sapiens
acagtcagactttgaatggatgttaaatgaaagtgtgtgaaaggcatagttaaggctaaacagaaagccaagacttcagaatgatccccagctgttttggagattcaactaaagcagacatgggggtaaagtgtatgtggatagagctgtttcatgtataaaggaaaggacaataatcatggcttgtccctgaacagaagaatctaagtcttgaaggaatgagatagtgcagagcaggtaatttttgaaggggg

SEQ ID NO: 18798 - DNA, 310 bp, Homo sapiens
atcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatt

SEQ ID NO: 18799 - DNA, 124 bp, Homo sapiens
gagacactggccccactttcaggcctggaggaagcatgcacacatggagacggcgcctgctgtagatgtttggatcttcgagatctccccaggcatcttgtctcccacaggatccgtgtgtgta

SEQ ID NO: 18800 - DNA, 281 bp, Homo sapiens
  misc_feature 258: n = A,T,C or G
gcttcaccgacatagtcattatgccgaagagaaagctccagagaatacagagggcaaagatggatccaaggtaactaaacaggagcccacaagacggctggccagattgtcaagcgaaacctgctccaccaaaacctgaacccaaaccaagaaaacatctgctaagaaagaacctggagcaaaagattagcagaggtgctaaagggaagaaggaggaaaagcaggagctggaaaggaggcacagaaaactgaatctgnagataacgagggagaatgaattg

SEQ ID NO: 18801 - DNA, 224 bp, Homo sapiens
tgtccagcttctaagtcttcagtgttttttcactgatctcagatcaaggactgcaggactaatggggtcctcaagccttgcatctgtagcctggaacactctaatgggctgtatgcagtggcttatgcctgtaattccaggactttgggaggctgagacgggaggatcacttgaggccaggagttcaagaccagcctgggcaacatagcaagaccccttctgtt

SEQ ID NO: 18802 - DNA, 574 bp, Homo sapiens
ataataggaagtcaatagacaatgtctgaaattgaaaaataaggagacataagaatattacttagaaatatggaggtaaatagtaaaagatgtagtaagcagagttgaagtagttacctttaacctcttaattgcttgagggggagactgtgtcacaagggtgctattttaaattgttatacatcttgtagtactatttgacttattaaaccgtgtatgcttattactttgataagaattaaaaattacttcaaaataataacaagtcaaaataataacaagtaggaatttaccagatggaaaagaggaatgagggtgggcatgaaacaattcctcagaagtagagattaaatttaactcatctttggatccttgaaacttaaaacagtacttttttttatgtaactgaataagctggttaatttctttctttgactttaaaatgactcaaggatccagtctgaatacagtggaacaagcactcacctgtctctcccactgaatgcagctataaaacctggacagaatgcatgagctactattcaaagtccctgaaaaataaatgatagcatat

SEQ ID NO: 18803 - DNA, 343 bp, Homo sapiens
  misc_feature 122, 267, 284, 306, 343: n = A,T,C or G
aagttcctggagacggtggagtggcagatcagcttgaagaactatgatccccagaaggacaagcgcttctcgggcaccgtcaggcttaagtccactccccgccctaagttctctgtgtgtgncctggggggaccagcaagcacttgtgacgaggctaagccgtggatatcccccacatggacatcgaggcggctgaaaaaactcaacaagaataaaaaactggcaagaagctggccaagaagtatgatgcgtttttggcctcagagnctctgatcaagcagatnccacgaatcctcggccaggttnaaataaggcaggaaagttccctttcccttgctcacan

SEQ ID NO: 18804 - DNA, 334 bp, Homo sapiens
  misc_feature 208, 238, 271, 294, 299, 326: n = A,T,C or G
cagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatcatactaatgcttattttattttaattgnatagaaagaaaaaaatgcctaaaataaggntttcttgcataaatactggaaattgcacatggnacaaattttttcttcattactgnacagngatgatggtaatgctttgaagcactgnaagtactg

SEQ ID NO: 18805 - DNA, 336 bp, Homo sapiens
  misc_feature 310, 327: n = A,T,C or G
cagccgtctcagtccatttgcggaggaacattggtgttacagcagtggcatttaataaggaacttgatcctatacagaaactctttgtggacaagattagagaatacaaatctaagcgacagacatctggaggacctgttgatgctaagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggnaatttgcacggattagntgtacaact

SEQ ID NO: 18806 - DNA, 421 bp, Homo sapiens
  misc_feature 78, 83: n = A,T,C or G
aaaagagaggacctttcactgcattggatggatgaacatcagggccctaactccatccatcatgtagggcagggaggnctggncactatttggcaggatgtactccagaatataatcaaagaattttctgtacatatttcactaaagacaagtttttgggctggatgtggtagcttacacctataatcccagcactttgggaggctgaggtgagagggcacttgagcccaggagttctagacaagcctgggaaacatagcaagatctcatccttacaaaaaataataatggtgtgtgcctgcagtcctagctacttgggtggttgaggcaggaggattgtttgagcgagggaagttgaggctgcagtgaactatgattttaccactgcactccagcttggcaacaaaatgagaccctgctc

SEQ ID NO: 18807 - DNA, 382 bp, Homo sapiens
  misc_feature 60, 258, 262, 269, 316: n = A,T,C or G
aacatggagagaatcatgaaagctcaagccctaagagacaactcaacaatgggttacagnggcagcaaagaaacacctggagataaaccctgaccattccattattgagaccttaaggcaaaaggcagaggctgataagaacgacaagtctgtgaaggatctggcatcttgctttatgaaactgcgctcctgtcttctggcttcagtctggaagatccccagacacatgctaacaggatctacaggatgatcaaactngggnctggggnatttgatgaagatgaccctacttgctgatgataccagtgcttgctgnaacttgaagaaatgccaccccttgaaggaagatgacgacacatcacgcatggaagcagtagactaa

SEQ ID NO: 18808 - DNA, 420 bp, Homo sapiens
atattttaatctatccttttcctttgtttttgttcttattatctcttctgatatataaccaaaaaatgaaaaaatctgtacacttggtgtttgatttacctaagcacctagttaatttaatctttgtaacactttggatggttaacttaacctttactcaagttggtttttgttttgttgaaaatgacttacttggtggaaccactactactgaaagaacgaaactttgatattacattgttaagtatcagagctgttacagagcaagtccttttaaagagatgtaaaaattaagacctgtgccaaactgatttttattaagaaaccctgttttctttaagtaaaagtatatctaccagcatggcttggtaagaaaaatcccctatctttttttccctgtcctcaaaatcagaattttcg

SEQ ID NO: 18809 - DNA, 373 bp, Homo sapiens
gcattttacacttacagcacatctcagttcagacaagccacagtcagatgctcaataatcacacgtggctagtggttgccggactgtacagctcaccttttgaaaggctaccttttcaatctagatcaccaataattttttaaattaatttcatgtgaaactttaaagctcttctaagaaccctttttcatttgttcggtattaaatcaaaacttcaatccagtcacctttaactctttcatgaccatttccacatgcccttaccgttggctatcttagctcgatgtgctaatcaagttccccctaatttgacatactagaatctaatactagaggcagcatgacattattatgggggaggaggttgagaagc

SEQ ID NO: 18810 - DNA, 330 bp, Homo sapiens
ccttagcccaatcccagctatacagtcaccccaatttccacaaatgatgtgatggtaccgtataatcctgtaattgggaaatttcacatttttcctgtcctaatctcagaggtgggagaagcaagtctagaacatctccaggctcagactaaacgagagtacttggactgcaaccaagtaatcactgcaaagtagttccaagcagcaagaaataccagattctcatggaggctactatagggtacagaataacaacatgaaagcaatcaaccctgtataaataatgtttcttgcattttttttttaattaaagaaatccagtgctcgaaa

SEQ ID NO: 18811 - DNA, 329 bp, Homo sapiens
ctacggttgttgtttggcgactgtgcttcaagcggtgtctgcttttggggcagagttttcatcggaggcatgcagagagttaggcttttctagcaacttgctttgcaagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggt

SEQ ID NO: 18812 - DNA, 199 bp, Homo sapiens
  misc_feature 181: n = A,T,C or G
gaatatgaattcacaaggaagtacttgacaactgcacaccattatttggaatacacgtcaaaccttcaggcagaataagcatgataatgggtaggttggcatgaccattaacaactacacttgaataatacaccaggctgatagacagagacctctgcacccacgctctgtttcctgtctnttcttttaatatccagtg

SEQ ID NO: 18813 - DNA, 289 bp, Homo sapiens
gatggagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatga

SEQ ID NO: 18814 - DNA, 396 bp, Homo sapiens
ctgatggtacttgttttcgccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagat

SEQ ID NO: 18815 - DNA, 432 bp, Homo sapiens
  misc_feature 42, 43, 44: n = A,T,C or G
ttttttcctcatctgaaaaaggagtctcttttcttccccctnnnaatatctctggttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcataaaagtgaagatctggctgaaccagttccacaaggttactgtatacatagcctgagtttaaaaggctgtcccacttcaagaatgtcattgttagactttgaaatttctaactgcctacctgcat

SEQ ID NO: 18816 - DNA, 486 bp, Homo sapiens
  misc_feature 44: n = A,T,C or G
gaggcagccagcgcaggggcttctgctgagggggcaggcggatnttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtcaaacttagaagaaaattggaagatagaaacaagatagaaaatgaaaatattgtcaagagtttcagatagaaaatgaaaaacagctaagacaagtattggagaagtatagaagatagaaaaatataaagcc

SEQ ID NO: 18817 - DNA, 433 bp, Homo sapiens
  misc_feature 65, 404: n = A,T,C or G
tgctagtttatgaaccacgaactgatgtctgttaactttacggagaacttggatatcatatttgntatttctctggagtttctaaaatcgaggtggagagccggcacggtggcccacggctgtaatcccagcactttgggaggcgaggcgggtggatcatttgaggtcaggagttcgagaccaccctggccaacatggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttccatatccatatatgaatgggacgccttcatttgggacacacgttttctttatccaaatgtgantttgctggagggtaccagcgattgaaagg

SEQ ID NO: 18818 - DNA, 181 bp, Homo sapiens
cagttatcaactatcagaacataaattaattctagttgaaattcattttatgaaagtctgccaaacacattttaatgaagtatgcttacgatgtaaaagcaaatgaaaactaataattcacttttaaatgcaagaaataatggaacaaaatgccaaaatgaaataagaaaatgtagatatg

SEQ ID NO: 18819 - DNA, 242 bp, Homo sapiens
  misc_feature 64, 104: n = A,T,C or G
ctctacatatttatgaaaactattaacccattctctactttataaagggaaagttttcattatncctaccctctctgccatactttgacatttaaaattgtagngccaccattcaagggaaagagtttttgagagcacgaccaggagagtatggtcagcttttgctccccataccccaaattgtgaggcctttacttgtggcattgtgaaggaacaagtgctcaaaggcctttgagcttggt

SEQ ID NO: 18820 - DNA, 383 bp, Homo sapiens
gagcagagaagagggagaaagcagcatcttgcctggatgagccaggggacacagaagagaagcccagggtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcactgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgccca

SEQ ID NO: 18821 - DNA, 218 bp, Homo sapiens
ctttttgaagacctgggacatcattttttgcattttctaatttggaaagaaataagtgagcatttgatgatttgaattttcaagaattgcaaaggaataagtgttattcacactgtaagagggtataaataggcacaaagtggtactttgaatataaagcatgttcacagatttagcaataggatttgttatgtggaaagcctgtagtgggaaattct

SEQ ID NO: 18822 - DNA, 169 bp, Homo sapiens
  misc_feature 35, 37, 60, 91, 92, 107: n = A,T,C or G
atttgcgcgattgcaataataaagtttggtttggntnttacagtcatgcgcagggacganccttgttctctgctgtaaactgtaaaaagtnnatggagacttaaagncttgatgttgtgaagcagaggttattttgtggaaagattaaaaggattttgttggtacctgg

SEQ ID NO: 18823 - DNA, 209 bp, Homo sapiens
  misc_feature 15, 19, 37, 153, 190: n = A,T,C or G
cacagggattaaaancaanattttgatggcaagatancaatgtaggaacaaataattggagatgtttagcaaaattatgaattaagtagatgtataaacggcagattatgaaagggaaacaaagattacctgggaagagttttgtgttttagncaactgaattaccagaatgggcagaaaaaggaagtancaaagaagggtctgctgat

SEQ ID NO: 18824 - DNA, 483 bp, Homo sapiens
  misc_feature 42, 59, 62: n = A,T,C or G
aaaataaagcttacatagttttcttcctttgaaagactgtgntgtcctttaacataggnttntaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgcatttcattagtattcctcattctgcatcctggcttgaaaaacagctctgttgaatcacagtatcagtattttcacacgtaagcacattcggccatttctgtggttctcatgagctgtgtcacagacctcagcaggcatcgatggaccgcaggaggcagatcgaccactaggcctgaaatgacatttcactaaag

SEQ ID NO: 18825 - DNA, 379 bp, Homo sapiens
ccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagataccagatgacacttaagacctacttgtgatatttaaatgatgcaataaaagacctattgatttag

SEQ ID NO: 18826 - DNA, 158 bp, Homo sapiens
  misc_feature 10, 111: n = A,T,C or G
ggaggaagcngaagaaaaaagacaagctaggaaacaaaaagctaagggcaaaatgtacaaacttagaagaaaattggaagatagaaacaagatagaaaatgaaaatattgncaagagtttcagatagaaaatgaaaaacaagctaagacaagcattgg

SEQ ID NO: 18827 - DNA, 290 bp, Homo sapiens
  misc_feature 171: n = A,T,C or G
aggccgaggagggtggatcatttgaggtcaggagtttgagaccagcctgtccaaaatggccaaaccctgtctctactaaaagtacaaaaattagccgggcgtgattgtgtacacatgtaatcccagctactcaggaggctgaggcaagagaatcacttgagccggggaggngcgggttgcagtgagccaagattgtgccactgcattccagactgggcgacagaacaagattctgtctaaataaataaataaaaattttaaaatagaaaaaaaaaagaggccggcacgca

SEQ ID NO: 18828 - DNA, 368 bp, Homo sapiens
ggtgcttctgagatgtgggcttgcacacgcggttgctataatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgccagcttcttggggaaaaggacagatgaagctgctttccagaagctgatgagcaacttggacagcaacagggacaacgaggtggacttccaagagtactgtgtcttcctgtcctgcatcgcatgatgtgtaacgaattctttgaaggctcccagataagcagcccaggaagaaatgaaaactcctct

SEQ ID NO: 18829 - DNA, 191 bp, Homo sapiens
  misc_feature 66, 67: n = A,T,C or G
gagccctcagtcgcccaaacatgaggagagacccaactccagcagccagaatttagtatttacatnngccttcccaagttgagaatagaatgtggtgttctgtgctttctgtttttattattccaaaatatttttttaaagaagtgttatttttcaacagattcataaattagttcctgatgtacggaaat

SEQ ID NO: 18830 - DNA, 495 bp, Homo sapiens
ttacaaataccctggcactgattttccctgggtttgtaggagtagccttacctgtgcttttaaatcagcattccccaacatggtctaatagtttctcaagatgatccatgaaaataaagtgtttttttcattagtttgggaaatgatgtataggatagctcttcaacccactctcaaataggtacaacgtatgttagcatattaaggttcgtgatcaggccaggctcggtggcttatgcccataatcccaacactttgggaggccaaggtggacagatcacttgaggccaggagttcgagaccagcctaggcaacatggtgaaaccccatctctattaaaaatacaaaattaggccaagcgtggtggacgcacctgtaatcccagctactcggaggctgaggcaggagaatcacctgaacccgggaggtagaaggttacaatgagccacgattggccactgcactccagctgggcaacagagtgagagtcctctc

SEQ ID NO: 18831 - DNA, 140 bp, Homo sapiens
  misc_feature 48, 53, 92, 100, 103, 117, 120, 126: n = A,T,C or G
tcaatgagcaaatctccatactgtttctttcttttttttttcattacngggtncaattatctttatcataaacattttacatgcagctattncaaagggngtnggattaattaggancancccttnggttaataaataaa

SEQ ID NO: 18832 - DNA, 410 bp, Homo sapiens
ttccacacacaggaggctgggaaatgtggtagagctctgccctaagaaaggggacctgactttggcagccacagacattgtcaagcataaagtgtttccagtcatttgccctcccattttataatctaccaggtatatggttaattcatttaacagaagatgctggagatggaatttgtcattctgtttactctgttgcagctctgcagctattatactagcttctcgattttcattaaatatatctcacactattttgacggggcttttaacctttctgtttctccatatactaactgcattctccaccttattacttgaaagggagattctctccactgagcattgaaagggtccaactttgaaaatgtttatgtcagtaagcttggatggtgacaagcatgcctgtg

SEQ ID NO: 18833 - DNA, 309 bp, Homo sapiens
tggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgcaggaagttactgggatcacattcattgcacacaagatggatggtcgccagcagtaccatgcctcagaaaatgt

SEQ ID NO: 18834 - DNA, 490 bp, Homo sapiens
  misc_feature 388, 474: n = A,T,C or G
tgatgatgctttggaagatgcagaagcaataataaagtacttgactacctactggtgtaatctcaatgcaagccccaactttcttatccaactttttcatagtaagtgcgaagactgagccagattggccaattaaaaacgaaaacctgactaggttctgtagagccaattagacttgaaatacgtttgtgtttctagaatcacagctcaagcattctgttatcgctcactctcccttgtacagccttattttgttgggctttgcattttgatattgctgtgagccttgcatgacatcatgaggccggatgaaacttctcagtccagcagtttccaagtcctaacaaatgctcccacctgaatttgtatatgactgcatttggggggnggggggggggttttcagcaaattccagatttggtttccttttggcctcctgcaaagtctccagaaaaaaaattgccaatctttccnacttctatttttatga

SEQ ID NO: 18835 - DNA, 520 bp, Homo sapiens
  misc_feature 123, 128, 402, 409: n = A,T,C or G
atatatacaagcaattatctattctcaagtggtaagtccactgacttattttatgacaagaaatttcaacggaattttgccaaactattgatacataagggttgagagaaacaagcatctatngcagnttctttttgcgtacaaatgatcttacataaatctcatgcttgaccattcctttcttcataacaaaaaagtaagatattcggtatttaacactttgttatcaagcatattttaaaaagaactgtactgtaaatggaatgcttgacttagcaaaatttgggctctttcatttgctgtagaaaaacagaattaacaaagacagtaatgtgaagaggcattacactattcttatcttagtacctgggtaggactggaatatttttaatcatctaaagnatgattngatataatcttattggaaatacctatcatgtcttagagcccgctttatgtttaaaactaatttcttaaaataagcctcagtaaatgtcattaccacctggaaaaagccact

SEQ ID NO: 18836 - DNA, 497 bp, Homo sapiens
atcattattattattaatagtttgtatttacaaatgtggcattaagtagaacaacgtattcttgcaattaatgacaggaagcctacaatttctcattaagcacaggacagtgagaacgaacagaatttcagagacatgtttcttaacattaaaaacaacaaaaacaacaacaacaacaaaaaaccaagtaggaagcaggcagagttgcaatatgaagaacaatttcaatcatatgttgtttaattgagtttaacaagtaaatgtatatcccagtgtgtgtggtcaccaaagcataatgacaagttgtcatcatttaattagagatttgcttattgaaacgactgaaataggtaggttgaaattttgcccttggacaagggagtaatttgtgatttgctacggtcatttcgtgagactttgggggaagacatctccttctcatatgtttaggcagcgtgatgacatcaacctagccttttatttaaatcccttgcaac

SEQ ID NO: 18837 - DNA, 241 bp, Homo sapiens
aggcggggggatcacctgaggtcaggagttcgagaccagcctggccaacatggggaaaccccctctctactaaaaatacaaaattagccaggcatggtggcccacgcctgtagtcccagctactcaagaggctgaggcaggggaatcacttaaacctgggagacagaagttgcagtgagccaacaactgcactccagactgggcaacagaagaagactccttctcaaataaataaataagt

SEQ ID NO: 18838 - DNA, 280 bp, Homo sapiens
gattcataaaaatgtcatatttatttctaataacaataggacctagatacagagggaaggtgataaggagggataaaaaaacgctctatcttattctacttatttattcattttgagacggagcgggactctgtttatgaagaaaagcccggtgagatggtgacatctgaggctcccgctacttgggaggctggggcaggaaggccgccagaacccaggaggcggatttgcagaggctggaatcgcgccactgtactccaggttggtgagcaagactgct

SEQ ID NO: 18839 - DNA, 318 bp, Homo sapiens
aacaacgcaaacaattgttttaaaacctctattagtctgcttttagagtgtcataacttgcattgccttgtcacttatgtgaaacacttactctgtagatgctgatctactgctttagaatatcaaattgtgacagttactttatttcattggatataaattgtcattgattaaaagatattatgattttattaaggaaaggaaaagacaaaaacaaactgtggcaatacttttgtatcacttataatttttattttatatatattgacttattttatatttactatacttttatttcatacaaggaaggaaaaggca

SEQ ID NO: 18840 - DNA, 193 bp, Homo sapiens
gagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcct

SEQ ID NO: 18841 - DNA, 138 bp, Homo sapiens
aaataggattaaaaataatacctgttatgaattattatgagggtcaaatgagttaagacatgtaaaatacatagaacagtgctctattctgaataaagttctcaataaatgtaaaaaaaaaaaaaaaaaaaaaaaaaa

SEQ ID NO: 18842 - DNA, 315 bp, Homo sapiens
cgctccgtggccttagctgtgctcgcgctactctctctttctggcccggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctgtctatctcttgtactacactgaattcacccccactgaaaaagatgagtatgcctgccgtgtgaaccatgtgactttg

SEQ ID NO: 18843 - DNA, 428 bp, Homo sapiens
acattttaaataaacagacaaagtgaactgcatagaaatgatgaagaatgaaatggcagaaatagaaattaaagagcaatggggactacagaagctatttctgtctctcactgagaattcctcatggcttaggttaaatgtttatttctaagggagtggattatttttaatgtctgaacagaacgcctccatgacatccattatttcaaaatgcctaagacatgcttctcagatctaaacgtcaccgaaggattgaggagcagcttgaggctcacgctaaacgtgcttgcttcccttcaccttctgccatgactctaagtttcctgaggcctccccagaagcagaagcctgtacagcccacagaactgttggatcacagaccaatggaacagaagggagactagaaatagacccatgcaagtcagtgg

SEQ ID NO: 18844 - DNA, 272 bp, Homo sapiens
taaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgattttttttttttgcaccagtgaaacaataaagatgctttta

SEQ ID NO: 18845 - DNA, 422 bp, Homo sapiens
  misc_feature 45: n = A,T,C or G
atgcttaaaatagagtatacaagttttttagacccaaagaaaaanacagcagagtctcagcatgatcagtcctgattgaatttcattatgtcacagtgatgcatgtcttagcactgattattggttttacttaatattccctaaaaacttgaggaaggaagatgatagaacatgagatactctttgttttgtacatactagaaaatacagctatcttctgatgagcaattgtgttgattttctttgcttttttcctcttatggagctctcagtgtgtgaaagttctaaagccacaagaatcaatgatgttttagctgctaatatttagtattgatcggttcttttaaaaatgatttggggaacttgatctgtactgtaattttactaattccttgtgcagaggtgggtatggcaattagaag

SEQ ID NO: 18846 - DNA, 347 bp, Homo sapiens
  misc_feature 326: n = A,T,C or G
gttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaccaagctgggctataaggaattgcacatgagatgcacacatatttatgctgtctgaaggtcacgatcatgttaccatatcaagctgaaaatgtcaccactatctggagatttcgacgtgttttcctctctgaatctgttatgaacacgttggttgctggattcagnaataaatatgtaaggcctttc

SEQ ID NO: 18847 - DNA, 317 bp, Homo sapiens
  misc_feature 13, 35, 37, 121, 160, 169, 171, 249, 264, 269, 275: n = A,T,C or G
tgctaagatttgntttgggatcaataggaaagcanangcagccaaccaagatgcaaatgttttgagatgatatgaccaaaattttaagtaggaaagtcacccaaacacttctgctttcacntaagtgtctggcccgcaatactgtaggaacaagcatgancttgttacngngatattttaaatatccacagtactcactttttccaaatgatcctagtaattgcctagaaatatctttctcttacctgntatttatcaattttnccagnattttnatacggaaaaaattgtattgaaaacacttagtatgcagttga

SEQ ID NO: 18848 - DNA, 379 bp, Homo sapiens
  misc_feature 42, 43: n = A,T,C or G
gaagaacgcaaagctgagaacatggacgttaatatcgccccnntccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccgggatgaagaagcgctaccccacgacgtcgttatggtggcatgttgcgagctatttccttatctccatgtttggaggagcatgg

SEQ ID NO: 18849 - DNA, 358 bp, Homo sapiens
taagttgatatcaatttaaaataataggttgagatactatttgcaagctccatggtaacctccaaccaaaaaacaatacactgcgaatatacaaataataaaaagcagaagactaaatcacatcagaaaataagaaaaacttcaaataaacaatttaataatgcatcttaaggaactagaaaatcaaaaacaaacaaacccaaaattagtggaagagaaggtatgataaagatcagagcagaagtaaataaagctgaagaaaacaatacaaaagatcagtgaaacaaaatgttagtttttttgaaaagttaaacaaaattgagaaacctttagacaaagaaaaaaagagagaagattc

SEQ ID NO: 18850 - DNA, 236 bp, Homo sapiens
  misc_feature 28, 47, 61, 85, 107, 119, 123, 147, 187: n = A,T,C or G
ataaaagactgtgtgtgagtgtgtgtgngccgtgtgtgtgatcaagngcctaaatcttgtncacctatcactttaaaaaaataantgaagtgtaagctaaataaaangcttggagtttngccngggctagagagagttggcgcaaantcttgtgtgtgttccgcataggaaggtgagatgaccatcnactaaagaggaagtagctaaacacagatctgtgggtgtttttaaaaaaa

SEQ ID NO: 18851 - DNA, 174 bp, Homo sapiens
  misc_feature 29, 36, 37, 40, 57, 145: n = A,T,C or G
taggtgtttagagattagaagctccatgnctctatnnctncctcctttttgctaagnctcaactcagaatctgaaaccacattgattgtaagatgtacaattacatgtgccaccaaaaaagaaaaaaaattgattgtaaccgggngtggcggctcatacgtgtaatctcagtac

SEQ ID NO: 18852 - DNA, 421 bp, Homo sapiens
  misc_feature 114, 116, 123, 137, 148, 149: n = A,T,C or G
gtacaatgatgccgaacattaggaattgtttatacacaactttgcaaattatttattacttgtgcacttagtagtttttacaaaactgcttcgtgcatatgttaaagcttattntnatgtggncttatgattttatnacagaaatgtnnttaacactatactctaaaatggacattttcttttattatcagttaaaatcacattttaagtgcttcacatttgtatgtgtgtagactgtaactttttttcagttcatatgcagaacgtatttagccattacccacgtgacaccaccgaatatattactgatttagaagcaaagatttcagtaagaattttagtcctgaccgctacggggaaaatgcattttcttcagaattatccattacgtgcatttaaactctgccagaaaaaataacta

SEQ ID NO: 18853 - DNA, 129 bp, Homo sapiens
ttgtgaagtgagcacagtccttttaatcttaacgcaaatcagcttcagggacttggaattaacagaagaatgttttatttggtctcagaatttaggaggtcatgatggtggaggtgatttttttttttt

SEQ ID NO: 18854 - DNA, 213 bp, Homo sapiens
  misc_feature 61, 96, 186: n = A,T,C or G
ccttgatcagccctttttcccatcctgccctatggttctctagccacctgtgcatgcatgngtatttctgcctggttctatggtgtgtggatgtgnggcatgaatctgtcatataagagggggccgagctggaatcctagagcattgctgccctggggcctgatgttcttggcttcctcagagcangtaacaggaaattaaatgggatgaggg

SEQ ID NO: 18855 - DNA, 425 bp, Homo sapiens
gaaaaattataaccattcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaaccgttagtccaaagaggaacagctctttggacactaggaaaaaaccttgtagagagagtaaaaaatttaacacccatagtaggcctaaaagcagccaccaattaagaaagcgtcaagctcaacacccactacc

SEQ ID NO: 18856 - DNA, 290 bp, Homo sapiens
  misc_feature 114: n = A,T,C or G
aaaaactttcttctttaaggattctcagtactggcgttttaccaatgatataaaagatgcagggtaccccaaaccaattttcaaaggatttggaggactaactggacaaatagnggcagcgctttcaacagctaaatataagaactgcctgaatctgtgtatttttcaagagaggggcagcattcagcagtatatttataaacaggacctgtacagaagtgccctggaagaagcctgctctaaattatccagggatggagaaacgacacaggttaggagacgtcgctttg

SEQ ID NO: 18857 - DNA, 467 bp, Homo sapiens
  misc_feature 42, 432: n = A,T,C or G
ttagtgaaggtggcttttgctttatagtttggctggggagcncttaattcttcccatttcaaaaggtaatgttgcctggggcttaacccacctgccctttgggcaaggttgggacaaagccatctgggcagtcaggggcaaggactgttggaggagagttagcccaagtataggctctgccagatgccatcacatccctgatactgtgtatgctttgaagcaccttccctgagaagggaagaggggatctttggactaggttcttggctccagacctggaatccacaaaagccaaaccagctcatttcaacaaaggagctccgatgtgaggggcaaggctgccctctgccccaggctcttcagaaagcatctgcatgtgaacaccatcatgcctttataaaggatccttattacaggaaaagcatgagtggnggctaacctgaccaataaagttattttatgattgc

SEQ ID NO: 18858 - DNA, 490 bp, Homo sapiens
  misc_feature 42, 43, 72, 85, 89, 96, 97: n = A,T,C or G
aaaacctacagtctcagctaaagctaagggaaggggaaatcnntcatttacaggtattggaaaaattaaatncggctatagaagnaaangaagctnngaggcctaataaatagcacccttcatttccatctgaattctgagcaaattgagaaacaagatgacatagtggcatgtgaagcccaaaatgtatcacatatatcaatgataaaggctaaaaagagaaattagctaaggataacagccaactgaacctgctaattgccagaattaggcatattcggctgatctgcacaggaaatgctgggctggagcaggcctcccatgttttacaacctgcctacataagacataagcatctaggagcagagaatccctcctcctttcaagcagctctttcccaacagaataaaggggaagcactgagctgtgaatgcctgtctattcaggatttacctcttagataagttggtccagctaccccgggaaggag

SEQ ID NO: 18859 - DNA, 489 bp, Homo sapiens
  misc_feature 78, 460: n = A,T,C or G
gaggcagccagcgcaggggcttctgcttgagggggcaggcggattttgaggaaaccgcagataagtttttttctcttngaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaaggttagtttaaaagttgaggggattaaaataatttgaaggcgatcttttaaaaagagattaaaccgangtgataaaagccttgaagtccatgacgca

SEQ ID NO: 18860 - DNA, 234 bp, Homo sapiens
  misc_feature 25, 96, 97, 99, 136, 154, 203: n = A,T,C or G
atacgtctccctttttctttacagnattagtaaaaaggaaaaattgcacactttctgattttaacttcactaatgtaattactctctcaagaagcnntnaaaatttaaattaccatcacacaaccttttttatagnaaagccaacatttgttcnctcaccaaaccccatgccaaattcatcatgaagaaagctcagcataagnaattcaaatactgcttataattttagagggg

SEQ ID NO: 18861 - DNA, 209 bp, Homo sapiens
  misc_feature 16, 73, 106: n = A,T,C or G
cagcctgggcaacacngataaaaccccgtctgtacaaaaaacacaaaaattggctgggatgtggcaggcacgngcctgtggacccagctactcgggatactgaggnggggggatagctggagcctgggtggtcaaggctgcagcgagttgtgatcacgccagtgcactccagctcaagtgacagagtgagacctgtctcagacaaaaac

SEQ ID NO: 18862 - DNA, 240 bp, Homo sapiens
  misc_feature 22, 31, 63: n = A,T,C or G
ggaggcagatgagggagacagngagtgagangctagaagagtaagcagtggccattctaaggngctgcagtttgatttttaggctatgggagaccttaaagagttttaaagagcaatggaggaaaatcacttactgggtacaatgatcactactggggcaatgagtacactgcaagtccagacttcaccactttgcaatgtatgtatgtaacaaactgcccttgtactccttaaatctgc

SEQ ID NO: 18863 - DNA, 210 bp, Homo sapiens
taaattctgattattaaactgaggctttaattgatgttaatgccttatgtcaaatgtaaagttaagaatttgctaggctgggcatagggagtgatatttctaggacctagacattgaaaactaattcagctgtagtaacctggatggtgtcaatggcacggatagcaaattcatggtttaaacttagaagcagctttcgggggagagggt

SEQ ID NO: 18864 - DNA, 314 bp, Homo sapiens
agtttttgctacgtcctctaggttcctctttatttgtttctctgggtgggaaatgacgtgaaacttgtcctttctctgacaacacattcctgaattgtccctgaaaaagccccacatagtcaacccctctagacttctgtttctagctttcgagctttcaatttatgcctgaagtgaacctagccacattatttcctagattgtaacaaggataatgattctcatcagcatcaagcactgtacatgcactatatgatcaatctccttatcctaagtctttttcttattttttaaacatgtatttttttctggag

SEQ ID NO: 18865 - DNA, 440 bp, Homo sapiens
tacagtggatggaactggaggcatgttatgttaaatgaaataagccaggcacagaaagataaatattgcatgttctcactcatatgtgagacatacaaaacgtaatttgaacttgtggagatagagaatagaatgaagattactagtggatgggaaacctaatagagagaaagggataaacgggatggttaatgggtacaaaactacagtttgatagaaggaataagatctagtgtttggtagcacaatagggtgcaatggttaacagcaatttattgtacatttcaaaatcattaagagtgaaattgtaatgattttgacacaaaaattatgaatactggatgtgaatgatatcccaattatgctaatatccattacacattattttgtgtatcaaaatatcacttttaccacatacataggtacaccattatgtatcc

SEQ ID NO: 18866 - DNA, 150 bp, Homo sapiens
taagagccagaactcagctgattgtggtggcttacgcatgtaatcccaacactttgggaagccaaggcgggtggatcatttgaggtcaagagttcgagactagcctggccaatatggtaaaaccctgtctctactaaaaatataaaaaat

SEQ ID NO: 18867 - DNA, 180 bp, Homo sapiens
cctaaattcgtagtaaattctgtggcagttttaaaaagataagctgctatagtaagttactgggcattctcaatacttgaatatggaacatatgcacaggggaaggaaataacattgcactttataaacactgtattgtaagtggaaaatgcaatgtcttaaataaaactatttaaaatt

SEQ ID NO: 18868 - DNA, 388 bp, Homo sapiens
tagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttgcctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctacgcctcaggctcctcatctg

SEQ ID NO: 18869 - DNA, 401 bp, Homo sapiens
tataattaataaatacttactatacttcaaatacaaggaatgaatactacagattgcctgtattgaatgctactggaaactagagagagaacgaatttcgttagcagaggactagagcctgggagactgattgagaagctcttataatagaaagacatgtagacctaggagtttaaaggaaaagatcttcatgatttattggccgtggagggtgaaagggatggagaaatcaaggttactttcatatttgtagtctgggtgactgagtgtcactaagtgttataagaacaccaggagtagaagcagcttttggaagaaagaagataaattgcattttgtacatgtgaaggtggagcttattgtgggacagctagggagaattgctcaaaaaaaaaaaaaaa

SEQ ID NO: 18870 - DNA, 116 bp, Homo sapiens
cacgggtgacggggaatcagggttcgattccggagagggagcctgagaaacggctaccacatccaaggaaggcagcaggcgcgcaaattacccactcccgacccggggaggtagtg

SEQ ID NO: 18871 - DNA, 353 bp, Homo sapiens
  misc_feature 316: n = A,T,C or G
ctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgacaacgaaggccgcgcctgccttncccatctgctatctatctggctggcagggaaggaaag

SEQ ID NO: 18872 - DNA, 146 bp, Homo sapiens
tcatcaccaaactgtgcaccagaatgtaactgccctgaaagctacccaagtgccatgtactgtgatgagctgaaattgaaaagtgtaccaatggcgcctcctggaatcaagtatctttaccttaggaataaccagattgaccatat

SEQ ID NO: 18873 - DNA, 118 bp, Homo sapiens
  misc_feature 58, 69: n = A,T,C or G
aaaagaaaattgagagaaaggactacagaccccgaagtaataccaatagaagggcaangcttttagatnaaaatgaagggtgacttaaacagcttaaagtttagtttaaaaagttgta

SEQ ID NO: 18874 - DNA, 265 bp, Homo sapiens
  misc_feature 68, 118, 149, 157, 164, 190, 192: n = A,T,C or G
gagggtgacaagttcaagctcaacaagtcagaactaaaggagctgctgacccgggagctgcccagctncttggggaaaaggacagatgaagctgctttccagaagctgatgagcaacntggacagcaacagggacaacgaggtggactnccaagagnactgtgncttcctgtcctgcatcgccatgatgngnaacgaattctttgaaggcttcccagataagcagcccaggaagaaatgaaaactcctctgatgtggttgggggg

SEQ ID NO: 18875 - DNA, 294 bp, Homo sapiens
atcactttgaggccaggagtttgagaccagtctggccaaaatggtgaaacaccatctctactaaaaattcaaaaattagccgggcatggtggcacacacctgtagtcccagctactcgggagtctgaggtaggagaatcatttgaacccaggaggcagaggttacagtgagccagcctgggcaacagaacaagactccatctcaaaacaacaacaacaaaaggactggcacaactgaagaaagaatcaatgatcctgaagacatgtcagtagaaactttcaaaatagaaatgct

SEQ ID NO: 18876 - DNA, 350 bp, Homo sapiens
  misc_feature 153, 193, 266, 321: n = A,T,C or G
agaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccangaatgttgcagattacatgcgctacttaatggaagaagangaagatgcttacaagaaacagttctctcaatacataaagaacagcgtaactccagacatgatggaggagatgnataagaaagctcatgctgctatacgagagaatccagtctatgaaaagaagcccangaaagaagttaaaaagaagaggtggaccg

SEQ ID NO: 18877 - DNA, 402 bp, Homo sapiens
  misc_feature 284: n = A,T,C or G
gcaccctcctgaaaactgcagcttccttctcaccttgaagaattatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagncactgcagatgacaggaaagtcaagagcaccataaccttagatgggggtgcctggacatgtgcagaaatgggatggaaaatcaaccaccataaagagaaaacgagaggatgataaact

SEQ ID NO: 18878 - DNA, 291 bp, Homo sapiens
  misc_feature 67: n = A,T,C or G
gaggcagccagcgcaggggcttctgctgagggggcaggcggagcttgaggaaaccgcagataagttnttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtat

SEQ ID NO: 18879 - DNA, 337 bp, Homo sapiens
  misc_feature 23, 37, 44: n = A,T,C or G
gaaactcagatgaaaaaccaagncctaatcttaatgncgggttnaaggtcagttaagtccgagtgtggtggctcacacctgtaatcccagcactttgggaggccagggtgggtggatcacctgagactggcagttcgagactcacctggccaacatgacgaaaccccatctctactaaaaatacaaacttagctgggcgtggtggcatgcatctgtaatcccagctactcagaaggctaaggaaggagaataacttgagccctggaggctgaggttgcagtgagctgagactgcgccattgcactccagcctgggcaacagagcaagactccatcgc

SEQ ID NO: 18880 - DNA, 445 bp, Homo sapiens
  misc_feature 281, 282: n = A,T,C or G
atcatgaactcgttctgcaggagagatttggtattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctnngagcatagagttagcaaccatgcttctcattcccttgactcatgtcttgccagggatggttaagatacgcagcatgtttgatttgtcactaaaaagaagaaaaggctaacaagcttcacttttatgaacaactattttgagaacatgcacaatagtatgtttt

SEQ ID NO: 18881 - DNA, 306 bp, Homo sapiens
  misc_feature 102: n = A,T,C or G
tgtctggctaattttaaaatattttttgtagagacaaggtttcatgtttcccaggctggtcttgaactcctgagctcaagtgatccacccactccccaaagngttgggattgtaggcaggagccaccacacctggcagttttttccttcttgttttgagatggggccttgctccatcacccgagctggagtgtaaggtacgcatgatcatagctcgctgcaaccttgaaatcctgggctcaagcgatccccctgcctcagccttccaagtagtggggactattggtccatgccaccatgcttagct

SEQ ID NO: 18882 - DNA, 491 bp, Homo sapiens
tctcagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaagataccagaattgctgttaacaaataaaatactggccagatgtgttggttcacgcctgtaatcctagcacttcgggaggctgaggcgggaggattacttgagcctaggagtttgagaccagcctgggcaacatagcaagatcccatctctacaaaaaagtgaaaaagttagctgaacaaggcggcatgcacatgctactccagacgctgaagtgggaagatcacttaagtccgagagatcgaggcttcagtgagatatggctgagacactgctctcagcctggatgacagagtgagaacctgctcaaacaagagaaaaaaataaatcaaatgctattca

SEQ ID NO: 18883 - DNA, 354 bp, Homo sapiens
  misc_feature 17, 18, 19: n = A,T,C or G
tatgattactatgcctnnnctaaagatcaatactataacatggatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcccctgtttattcctcctctccctcc

SEQ ID NO: 18884 - DNA, 491 bp, Homo sapiens
gagctggatctgtcctataacaagcttaaaaacataccaactgtcaatgaaaaccttgaaaactattacctggaggtcaatcaacttgagaagtttgacataaagagcctctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgcagttttcatagtatccatattttattactgtttattacttccatgaattttaaaatctgagggaaatgttttgtaaacatttattttttttaaagaaaagatgaaaggcagcctatttcatcacaagaacacacacatatacacgaatagacatcaaactcaatgcttattggaaaattaaggggttttttaatttct

SEQ ID NO: 18885 - DNA, 361 bp, Homo sapiens
ttcaatattcacctgccagactggcttatcaagacaaaggtgtcctgtcataatgaagttaaagtgagtatactgtggagaggacttccaaatgtggttacctcagctatatcactgcccgacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacataaaaaaa

SEQ ID NO: 18886 - DNA, 301 bp, Homo sapiens
gatcagaatcatggtctcccgcagtgaagtggacatgttgaaaattaggtccgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgc

SEQ ID NO: 18887 - DNA, 470 bp, Homo sapiens
caaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgcaatatgcactgtacattccacaagcattgccttcttattttacttcttttagctgtttaactttgtaagatgcaaagaggttggatcaagtttaaatgactgtgctgccctttcacatcaaagaactactgacaacgaaggccgcgcctgcctttcccatctgtctatctatctggctgcagggaaggaaagacttgcatgttggtgaaggaagaagtgggggtggaagaagtggggtgggacgacagttaaatctagagtaaaaccaagctggcccaaggtgtcctgcaggctgtaatgcagttaatcagagtgccatttttttttt

SEQ ID NO: 18888 - DNA, 215 bp, Homo sapiens
gattctgtcatcaccatctccatggacttccagaatgccttaatcatcatcagagtgtcctacacaaagttgtctctgaccaaggaactcatttaatggtaagtgaagtgcacatccaaagattcactagtctttactacttactttaccatgcagaagcagcttgcttacacaaaaataaataacttactggaaaaaaaaaaaaaaaaaaaaaa

SEQ ID NO: 18889 - DNA, 349 bp, Homo sapiens
gtgtattgaggggagctacttcagaagataactcccctttactgcttactttaccatgcagaggcggtcctctttgccgtggtgccaacatactgtgcagaggaccattgtcatccgccgagactatctgcactacatccgcaagtcaaccgcttcgagaagcgccacaagaacatgtctgtacacctgtccccctgcttcagggacgtccagatcggtgacatcgcacagggggcgagtgccggcctctgacaagacagtgcgcttcaacgtgctcaaggtcaccagggcttgcggaccaaaaagcagttccagaagttctgaggctggacatcggccgcttcccaca

SEQ ID NO: 18890 - DNA, 159 bp, Homo sapiens
actggtgataaaaaattccaggcactgttataagtgctggggatacagtgatgaacaagacacaagatttctgcccttgcagagcataagttctggtgtctcatgtgtttgtgacagacaagaaatatgtatttttcaaaaaaaaaaaaaaaaaaaaaa

SEQ ID NO: 18891 - DNA, 430 bp, Homo sapiens
aattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggcactaggaaaaaaccttgtagagagagtaaaaaatttaacacccatagtaggcctaaaagcagccaccaattaagaaagcgttcaagctcaacacccactacctaaaaaatc

SEQ ID NO: 18892 - DNA, 336 bp, Homo sapiens
actttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatattaaaaaaaaaaaaaaaaa

SEQ ID NO: 18893 - DNA, 300 bp, Homo sapiens
  misc_feature 238, 293, 299: n = A,T,C or G
caagacttttgactgccattttgtttgttcagtggagactccctggccaacagaatccttcttgatagtttgcagggcaaaacaaatgtaatgttgcagatccgcagcagaagctctgccttctgtatcctatgtatgcagtgtgctttttcttgccagcttggccattcttgcttagacaggcaagcatttgtctcctcctttaactgagtcatcatcttagtccaactaatgcagncgatacaatgcgtagatagaagaagccccacgggagccaggatgggactggtcgnggttgng

SEQ ID NO: 18894 - DNA, 295 bp, Homo sapiens
  misc_feature 30: n = A,T,C or G
tactgccattagttattatgcaatattttncaatttcctatgatgagctattacattcactagcaaaccttaactgaagacctcaaggtattgctttcttttagtttttaataccttaaaaactaatcagatattcatcacatataataacacatgaaattttgtattctatttaatccaaggactttttttcatttcaaatatacaatttaatattttttacaatttggggttgtgcacccatcgtcacagttaatttcagagcattttcatcactccaaaaaaaaaaaaaaaa

SEQ ID NO: 18895 - DNA, 300 bp, Homo sapiens
  misc_feature 111, 114, 216, 258, 271: n = A,T,C or G
ggatctgggactgtctgatagtataaatttgcaggaatcagatacggttttactagctgaagacatgtcacataaacggtagatgatagggtaaaaacacatttatttcgnagngaggctgtaatgagacaatggaaatagagaatgtggataataacaaaactgagacagaggcagaagaactcttggattaaatttcaaatggcctccacttgngaatgatgacatccatgccctggacatctaaaagcaggttgnctgatagccttgnatgtatatctgaaaaaacttgcaggacac

SEQ ID NO: 18896 - DNA, 231 bp, Homo sapiens
gcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatct

SEQ ID NO: 18897 - DNA, 162 bp, Homo sapiens
  misc_feature 14, 21, 30, 99, 119, 123, 153: n = A,T,C or G
aggaccgaaaaggncgagaantgatatgancaaaattttaagtaggaaagtcacccaaacacttctgctttcacttaagtgtctggcccgcaatactgnaggaacaagcatgatcttgntacngggatattttaaatatccacaggactcacnttttccaaa

SEQ ID NO: 18898 - DNA, 143 bp, Homo sapiens
  misc_feature 80: n = A,T,C or G
acataatcaaggtctatgtttaaaaccatcggttctatatatctagctttaggaagttgcccttacaggtgggacctttngtgttaatctgttttctccccagtcatcttatttggctatgtcagaaaaaaaaaaaaaaaaaa

SEQ ID NO: 18899 - DNA, 336 bp, Homo sapiens
gcatactgttttcagcttgctgaaggttttctagtttaatctgtatttctgaacagtgataaatcaattgtcctatgtatgatgattcttgcatgatcatataaatctctatgtcaattaactctgtgatagatatatcaacataattatgggacttttgggttgatttacattattattttagatacttgattataggatttctagtgtgccaataaatgtttttctgcactgagtttggctgccaagcgagaaattgcttcttcaccagtgcaatataaccctaacattgcagggattttcatagcattatgtactagtttttccagattttaa

SEQ ID NO: 18900 - DNA, 300 bp, Homo sapiens
  misc_feature 56, 109, 113, 263: n = A,T,C or G
tgaggcaggaggatcgcttgagcccaggagttcaagaccagcctggccaacatggnaaaaccctgtctctactaaaaaataaaaatacaaaaaattgaccgggtttggngggncggtgcctgtggcccaagctacttgggaggctgagatgagtggcttgaacccaggaagcagaggttgcagtgagctgagatcacgccactgcacttcagcctgggcgacagagccagaccttgcgcaaaaaaaaataaaagttaccattngacctacaattccactcctggagatccaagagaatgc

SEQ ID NO: 18901 - DNA, 185 bp, Homo sapiens
caaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacagtgatggttt

SEQ ID NO: 18902 - DNA, 300 bp, Homo sapiens
  misc_feature 28: n = A,T,C or G
ttgagcatgaagcaaaaattacagtggntgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaat

SEQ ID NO: 18903 - DNA, 300 bp, Homo sapiens
  misc_feature 32, 33: n = A,T,C or G
attcaaaagtatgacaattaggctgagagaanntaaacgtaaaccaaattctatacccagggaatacatttttccagaacaaaggcacaataaagaatctttctgaaaaacaaaaaccaaaaacagagagtttatcaacctcacttaaggagattctaaaagatattcatcaggacaataggaagagtatactaagtgaaactctgaaatgcaaaaagaaaagaagagcaaagaattggtaaatacgtagatgcatgtaaatgaactctgtaaaataatattttgtggaatgggaaaata

SEQ ID NO: 18904 - DNA, 199 bp, Homo sapiens
cctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaa

SEQ ID NO: 18905 - DNA, 198 bp, Homo sapiens
acatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggttcc

SEQ ID NO: 18906 - DNA, 226 bp, Homo sapiens
acgtcttatgaagagaggcaaagatgtttgaggacagagcagaagtcaaatgcagtgcttctgctacttggctagctgcatgatcttgtgacagttatttagcctctccaaccttcagatttctcatctgtgaaaagggactaacacctacttcatagggtaattttgatgggcaagttataataataatttccggctgatagaaagtatccgggaggtattaatt

SEQ ID NO: 18907 - DNA, 265 bp, Homo sapiens
gttttctaaaatgtaaatatttgccacaatgtaaagcaaatcttagctatattttaaatcataaataacatgttcaagatacttaacaatttatttaaaatctaagattgctctaacgtctagtgaaaaaaatatttttaaaatttcagccaaataatgcattttatttataaaaatacagacagaaaattagggagaaacctctagttttgccaatagaaaatgcttcttccattgaataaaagttatttcaaatcgaaaaaaa

SEQ ID NO: 18908 - DNA, 138 bp, Homo sapiens
  misc_feature 9: n = A,T,C or G
gctgtggcnccagctactggggaagttgaggttgaggatcacttgagcctgggaagtcaaggctgcagtgagccttgatctcaccactgcaccccagcctgggtgacagagccagaccctgtcttaaaaaaaaaaaaa

SEQ ID NO: 18909 - DNA, 283 bp, Homo sapiens
agttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagttgtacaagcagctttcgttgaagtt

SEQ ID NO: 18910 - DNA, 300 bp, Homo sapiens
  misc_feature 129, 275: n = A,T,C or G
atcatgtgaccatcaatggaggaatagataattatatacataaacatgatgcaatgtaagtcatctttaaaaaagaaaatgctgttatttgtgacaacatggatagacctggaggatttttaaagtganataagccaggtacagaaagacaaatgctgcatgatctcacttatatgtggaatctaaaaaagcaagctcatagaaacggagagtataatgttgggtaccagaggctgggatgagagactggggagctgctggcaaggggacaaaanttcacttagacaggaggaataagtg

SEQ ID NO: 18911 - DNA, 343 bp, Homo sapiens
ctaaaacaacattctttaggggaaaaacatggataccttatctagcattgctcataaaagtactcatgttcatcctttttggaaactattaatcatgctagccttagatgattttaagctcctttgctcaaaccaatcattgatgtgcagtatgaccagcagctagtaagtctgtggtgctaccagtatagcttggaagatggttctgaattaatacctcagaatgatatcaaaagtaaaagagtggttctattgctaaatatattgactagctttcttataacaattttactttgaaattcaaagttccaaagctaaatgtctaaaagaagtaactgcagct

SEQ ID NO: 18912 - DNA, 104 bp, Homo sapiens
  misc_feature 23, 28: n = A,T,C or G
gtttttttaattagatacatatnttgtnaagtgttactatattttaaagttatttttatatgttttaaaatgttactcttatttaattattacaataaacagaa

SEQ ID NO: 18913 - DNA, 113 bp, Homo sapiens
attacagacgtgtgccaccacgcccagctaaagactgttttataaacttcatttttaagctcatattttgcaagacaacataagtgggtttggattcagttgttctcggtgtg

SEQ ID NO: 18914 - DNA, 116 bp, Homo sapiens
ggctgtgcgcacgcacacaagacgggagtcaccctgtgcttcctgcccaagatactgacccattgaacccccaaagcatctttctctccacaaagtccgtggtgccttcctggtgg

SEQ ID NO: 18915 - DNA, 365 bp, Homo sapiens
gaatataaaagcatttgtacttaaaggtcttgtgtattcattaagaaatatagtaatgtcttttaatgttttaagagttgatcagggtttactatgatgcaagtaataggatgattaataagggaaggtttttatgaattcaaaagtcaattattcaaaagcagggaaagattttgagagagggaacaaagtattcttagattgcgtagaagctgctaggttccagttttaatttttaggtttagttggctctgttatgaaaagataggttatgggtgggcgacaggttgatacagtcttaagaaaaagcaggtaatatcaaagtattggaaagctagcatgcatgccctcttacctgggtatct

SEQ ID NO: 18916 - DNA, 275 bp, Homo sapiens
taaatagattttctggtattcttgttcacttgattacatttgtataaagttctgattgccagttgctcagataacaagtgacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatgtacagtaaattttgtaaacttgcatcaag

SEQ ID NO: 18917 - DNA, 362 bp, Homo sapiens
ggctatacaagaagcgtgacaccagcgtctgcatctggtgagggtatcaggctacttccactcatggtggaaggcaaaagctagcctgagtgcagagatcacatggcaaggtagtaggagggggaggaaaaagagaaggaagagagggaggtgctgagtgagaactcactcactcccttgagaataacaccaagccattcatgaggaatctgcccccacaacccagacaccttccactaggccccatcaccaacagtgaggatcagatttcaacatgagacttggtaggtacaaacaaaccatatgtaaccactggacaacttctataaagaactactactcattttgggaggccaaggtgg

SEQ ID NO: 18918 - DNA, 333 bp, Homo sapiens
ttttaccatgtatattatcctgttaggtggtgatatgctattctttgacatttgtgatcttttctatttgaaaaaagcactcattcgacatctcaaacctacctaagcattctggttcaaaaatgccacacagtacatgcagagggaatgttttgagtattaaggagaagcttgaaacaagaaaacatttggaaagataaaaacatgacgatacatcccaagcaacagatataaaggaatccacattatggaccatcaaagataatgccacaaaaataaaagtgtatgtatggctggccaggttcgagtgctggaaagtccataagaacaagg

SEQ ID NO: 18919 - DNA, 300 bp, Homo sapiens
  misc_feature 31, 148, 161, 215, 230, 289, 294: n = A,T,C or G
catgtctgacaaacccgatatggctgagatngagaaattcgataagtcgaaactgaagaagacagagacgcaagagaaaaatccactgcttccaaagaaacgattgacaggagaagcaagcaggcgaatcgtaatgaggcgtgcgcgncaatatgcactgnacattccacaagcattgccttcttattttacttcttttagctggttaactttgnaagatgcaaagaggntggatcaaggttaaatgactgtgctgccctttcacatcaaagaactactgacaacgaangccgngctgcc

SEQ ID NO: 18920 - DNA, 283 bp, Homo sapiens
gaaagcgttcaagctctacacccactacctaaaaaatcccaaacatataactgaactcctcacacccaattggaccaatctatcaccctatagaagaactaatgttagtataagtaacatgaaaacattctcctccgcataagcctgcgtcagattaaaacattgaactgacaattaacagcccaatatctacaatcaaccaacaagtcattattaccctcactgtcaacccaacacaggcatgctcataaggaaaggttaaaaaaagtaaaaggaactcggc

SEQ ID NO: 18921 - DNA, 300 bp, Homo sapiens
  misc_feature 12, 182, 202, 276, 294: n = A,T,C or G
tctgatgatgangatgagggatcttgctctttcacccaggatggagtgcaatttgtgcagtcacaactcatggcaagcctcaacctcccaggccgaagcacgcctctcacctcagcctccaagtagctgggaccacaggcacacaccaccatgcctggctaattttttaatttattttttgnagagacagagctcactgcgntgctaggctgctcttgaactcctggctcaagtgatccacctgctttggctccaaagtggtgggcttataggtgngagcactgcacctggtgngaactt

SEQ ID NO: 18922 - DNA, 296 bp, Homo sapiens
agatgttttctctttgaaagatagagattaataccaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttt

SEQ ID NO: 18923 - DNA, 319 bp, Homo sapiens
ccagcaaaaagctccgcaacaagatagcaggttatggcacgcatctgatgaagcgaattcagagaggcccagtaagaggtatctccatcaagctgcaggaggaggatagagaaaggagagacaattatgttcctgaggctcagccttggatcaggagattattgaagaagatcctgcactaaggaaatgctgaagcttttggacttcggcagctgtccaaccttcaggtcactcagcctacagttgggatgaatttcaaaacgcctcggggacctgttttgaattttttctgtaggctgtattattttcaataaatctg

SEQ ID NO: 18924 - DNA, 338 bp, Homo sapiens
ggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgagaaggcctttgagaatgtaactgatctgcagtggctcattctagatcacaaccttctagaaaactccaagataaaagggagagtttctctaaattgaaacaactgaagaagctgcatataaaccacaacaacctgacagag

SEQ ID NO: 18925 - DNA, 178 bp, Homo sapiens
  misc_feature 76, 114, 115, 120, 134, 141, 143, 155, 166: n = A,T,C or G
aagcatattaactaaaatatgaattacacttccaaagttagatttctgcttcagtaggtttgtttgctgagaagantacttctcaaaagacagatgttcatattaagcttaatnntcggnttaaatatgtttgnaaatgangnaatatatttctnttgctaaatgnggaaaagtaatg

SEQ ID NO: 18926 - DNA, 327 bp, Homo sapiens
ccttttactctgaacctttgtttccatgatatggtccctgaaccacctgtgttagaatcctttaggtgaattgcttaaaatgctgattcctggatcccaccacagaggtatgaaacccaatttctagggttggggcctatgaatttgcattttaaacaacttcctgggtaattctaatgaggagccactttgattatgagctgttttcccagactagtggtttccaatgaaagttggatcatgtacccttctcagaaagaattttttaagcatgtaccctcaacatatgttggcaatatatttattaatttcttatatgtgctaatg

SEQ ID NO: 18927 - DNA, 300 bp, Homo sapiens
  misc_feature 285: n = A,T,C or G
tgtggtttggtggaagtgggcctagcttattaggtcccctaagacggagaaaccaggcctaatcaaaaaccaaaaatctgaaattctccaaaattcaaaactttttgagcaccaccaacataatgccagaagtggaaaattccactttggggacacctttgctttctgatggttcaatgtacacaaacttttttcatgcacaaacttatttaaaatattgtataaattacctttaggctctgtgtaaaggtgtataggaaacataaatgaattttgtgttagagntgggcccaacaccaa

SEQ ID NO: 18928 - DNA, 267 bp, Homo sapiens
agctcaactgattcatacgtattaatgaccattctagcaaaggcctacaagtggtgtgggaatcagggaaaggctgcctctttggtatctcaactggtattgattattgctatcaactatttggggagaaaaaatcaaaatgaagccctgtcaaattttagaagtactatctttggtccttcaaacactttgtgatgacaccttaagaaaaataaagttgaagttcaggtcttgccattgccattacagacaaattaggagacttgg

SEQ ID NO: 18929 - DNA, 268 bp, Homo sapiens
  misc_feature 84, 177, 183, 224: n = A,T,C or G
ctcgcgacaccctgtacgaggcggtgcgggaagtcctgcacgggaaccagcgcaagcgccgcaagttcctggagacggtggagntgcagatcaagcttgaagaactatgatccccagaaggacaagcgcttctcggcaccgtcaggcttaagtccactccccgcctaagttctctgngtgtgncctgggggaccaagcaagcactgtgacgaggctaaggccgnggatatcccccacatggacatcgaggcgctgaaaaaacccaaca

SEQ ID NO: 18930 - DNA, 358 bp, Homo sapiens
tgaggcccgtggaaggagtcaaacttgcgggaattttgcagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagag

SEQ ID NO: 18931 - DNA, 420 bp, Homo sapiens
cccgttctggacaggtaacttggcaaacgtttcaagtacaaggggtccagaacttgcagaatttgcaaatacagaatactgctgcccaacaaataactttgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgcagtcctgcagatattaggatcaaggaagaagaacctgatcctgaagagtgcagctcagtggtgattctaccttgaataccaatgccctaacacacttaagagtacaggtgggaagatgaagaaggggccaacaacatcaagaaggaaaaagacttcgg

SEQ ID NO: 18932 - DNA, 300 bp, Homo sapiens
  misc_feature 268, 280, 288: n = A,T,C or G
agctgtgctcgcgctactctctctttctggcctggaggctatccagcgtactccaaagattcaggtttactcacgtcatccagcagagaatggaaagtcaaatttcctgaattgctatgtgtctgggttcatccatccgacattgaagttgacttactgaagaatggagagagaattgaaaaagtggagcattcagacttgctttcagcaaggactgggctttctatctcttggactacactgaatcaccccactgaaaaagatgagnatgcctgcgggngaccatgngactttggcaca

SEQ ID NO: 18933 - DNA, 165 bp, Homo sapiens
acgacacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttc

SEQ ID NO: 18934 - DNA, 229 bp, Homo sapiens
aataagcataaccctgagattcttactactgatgagaacattatctgcatatgccaaaaaattttaagcaaatgaaagctaccaatttaaagttacggaatctaccattttaaagttaattgcttgcaagctataaccacaaaaataatgaattgatgagaaatacaatgaagaggtaatgtccatctcaaaatactgcttttacaaaagcagaataaaggagaaaaaa

SEQ ID NO: 18935 - DNA, 420 bp, Homo sapiens
tctgagttactgaggggaagactcagcctggatttcaaaactgaacactgaagtggtttgcaacagttacctggctcttggcctcaatccagctggatcaaactgagacctgaaaagagatattgactcctgtggcagtggaaagacccaagaatgccagtcaagaagacagatactgaccgagctttatcattactggaagaatactgcaaaaaattaaggaaaccagaggagcagctgttgaaaaatgcggttaaaaaggtgatgggtatctttaagagcagcttattccaagctttgctaggtatgtattatgaaagttattcatcattttaatggtcagaattggcttgatagtttgaataatgtggtcaaagaacctgatgttaaccaagttcaaactgggataatttctttaat

SEQ ID NO: 18936 - DNA, 255 bp, Homo sapiens
gaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccg

SEQ ID NO: 18937 - DNA, 357 bp, Homo sapiens
ttatatgtggcaggaattatttggagagttgtagttattgttcttgtttttgttgttatcatataaacagaaataacgctttaaaacttcattgaacaactgtcaaaatgaagtgtaatgtcaacatttagggaaagagggagaaaaggtgatcttatgatatcttaatggggagaagccttaaatactctacagctcaatccccgccccaacgaaattcaacaaattgagtcaattaagttaggttttccctagataatatcaaagtatccagcttatctttgagaattaaaaaatggttatgttagcttagtatcatgtaagaaaaaaatgattaaatatttttctttttctcag

SEQ ID NO: 18938 - DNA, 150 bp, Homo sapiens
gctaatggatctggagataagaatccctttactaaggcaaagatttaattgaaatccaaattgatttatagaacgaagggcatttcccatttgtggcttctgccgaaattctgattggcctacacacatgaaggatatggatggtttcac

SEQ ID NO: 18939 - DNA, 300 bp, Homo sapiens
  misc_feature 52, 92, 118, 121, 143, 182, 208, 268, 280: n = A,T,C or G
cctttgatgttaggtcagtagaaaaatgaactgaactttaacctagttgatngagtttaagacattaaaatatccacaaataaaaccatagntgagtcaggtttggtagacattttanaancagttgggtaacatgatacctntagttttgtctttttatcccggttgcaaatgacatgatnccatatctagaaaaccccacagctgngcccaaaagctccttaatctgacacacacttggcaaaggttcagaacacaaaatcaatgnataaaaatcagnagcattcctatcatcaactt

SEQ ID NO: 18940 - DNA, 173 bp, Homo sapiens
tgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagctttaccata

SEQ ID NO: 18941 - DNA, 163 bp, Homo sapiens
gctgttatgggcaaccctagggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgg

SEQ ID NO: 18942 - DNA, 184 bp, Homo sapiens
acacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgc

SEQ ID NO: 18943 - DNA, 260 bp, Homo sapiens
gcttactttatggaaagatgttaaatgtggagaaaaacatgcctaaagttgataagtcaaacaatattaccagacacataaacttttagaagtatgctgctaaatactagaaaataatgccagcattgattttgagaaatgagattccttttgagtagcaggaatcaagaatgtggtatggcaaaactctttttaattataaaccattctgagcactttttcaagccatgggtatgtatatattttgaaaaaaaaaaaaa

SEQ ID NO: 18944 - DNA, 314 bp, Homo sapiens
gaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattg

SEQ ID NO: 18945 - DNA, 170 bp, Homo sapiens
tttcatttcacatggttctttttattcattgtaaataaaagtaaacttggataaatttgagaataaactttgaattgttgcaaactatgattatcaatttgtaaatttaccctttgacataataatgtacatttttaaatgtagccattaaattctctatatttaaccta

SEQ ID NO: 18946 - DNA, 104 bp, Homo sapiens
  misc_feature 32, 90: n = A,T,C or G
aaattgtttccactgaaaataactacttgacntctagatattaaatacacacacacacacacacacacacacacacacacacacacatanacacagtggaccaa

SEQ ID NO: 18947 - DNA, 190 bp, Homo sapiens
  misc_feature 14, 47, 55: n = A,T,C or G
cagcgccacaagcncagagctatgtcttggttccaccttcatcctgngacattgngataatgtgcctcaaaagtagggattgatatttcttaaggaaccctcaagctgctctagcatagaaaacattaaatttacctattaacattgatttgaatgtgtaaaccattctgtaaaaaaaaagaaaaaaaaa

SEQ ID NO: 18948 - DNA, 217 bp, Homo sapiens
aggaaggcccatttttaaaaaaaaatttttcttttgatagtgacttattgtttagagctttttaagatcaacttttaagatcaagataagcaataaggtggtcaaataaacaatataaagtcagggacaccttcctactcaagaaggattttttttcttttttactattttacatatactcttgaaatgaagacaatgaactaaaaaaaaaaaaaaa

SEQ ID NO: 18949 - DNA, 270 bp, Homo sapiens
  misc_feature 34, 60, 70, 114, 137, 148, 168, 218, 227: n = A,T,C or G
ttcatacattctgctaattttttatgattaagcnttatgcagaagggccccacttacaanggatccactnaagattatcaactttaagagggacaaaagcaatacacatcaggnaaaaccatcctcggatttggaanttggaaatttnccggatgcaggaggaactcnctctcaatgcgggcagggggagggagccggagctccaagcagcacgcaancaagagggnaaacaaggaacccacagacgtggggtgccagaagatttggccc

SEQ ID NO: 18950 - DNA, 171 bp, Homo sapiens
ggaaaccgcagataagatgttttctctttgaaagatagagattaatacaactacttaaaaaatatagtcaataggttactaagatattgcttagcgttaagtttttaacgtaattttaatagcttaagattttaagagaaaatatgaagacttagaagagtagcatggggg

SEQ ID NO: 18951 - DNA, 277 bp, Homo sapiens
caattaattaactgtctttcagaatacccatgtctgtttctcaagatgaaatagcaaataagaaaagcactgggtaaggagtcagaagacatgttattcaacagctgggtggctctctttggacctcattttccttatcagtaatttagagatgtagggctggtggatctccaaggtcttaggacgtatctctacatgattatctaaaaatgagaccattagccaattaataaattctgagctctcaaaataatctctatattatacatgtgccaag

SEQ ID NO: 18952 - DNA, 300 bp, Homo sapiens
  misc_feature 76, 266, 277: n = A,T,C or G
gagggtgacaggtgaaagacccctacagatctgacctctccctgacagacaaccatctctttttatattatgccgntttcaatccaacgttctcacactggaagaagagagtttctaatcagatgcaacggccaaattcttgatctgcagcttctctgaagtttggaaaagaaaccttctttctggagtttgcagagtcagcaatatgatagggacaggtgctgatgggccaagagtgcaagcatacacaactacttattatctgnagaaggtttgntttggtgatctgagcttctatga

SEQ ID NO: 18953 - DNA, 344 bp, Homo sapiens
gatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccaca

SEQ ID NO: 18954 - DNA, 300 bp, Homo sapiens
  misc_feature 91: n = A,T,C or G
agagctcaccctcccgagttgaaaaaatttatggacaagaagttatcattgaaattaaatggtggcagacatgtccaaggaatattgcggngatttgatccctttatgaaccttgtgatagatgaatgtgtggagatggcgactagtggacaacagaacaatattggaatggtggtaatacgaggaaatagtatcatcatgttagaagccttggaacgagtataaataatggctgtcagcagagagacccatgtcctctctccatagggctgttttactatgatgtaaaaattaggtcat

SEQ ID NO: 18955 - DNA, 366 bp, Homo sapiens
ggatatattttcttaaaacaagaaaaatttagtgaattcttaaataaaataatattttcataaaatctttcttcagtctgggtgtggtggctcacgcctgtaatcccaacactttgggaggctgaggtgggcagattgcttgaggtcaggaatttaagaccagcctggccaacatggtgaaaccctgctctactcaaaatacaaaaaatagctgggtgtggtgcacgtgtctgtaatcccagctagtcgggaggctgaggtgtgagaatcgcttgagcctgggaagtggagggttcaatgagctgagatcatgccactgcacttcagcctgagcgacagagcaagactctgtctcaaaaaaaaaaa

SEQ ID NO: 18956 - DNA, 243 bp, Homo sapiens
  misc_feature 9, 37, 69, 85, 123, 165, 176, 180, 187, 205: n = A,T,C or G
gagagaccncggagcaagaacccaacctccgagcagnacatgctaagactttaccaggcaaagcgaacnactatactcaattgangcaataacgtgaccaacggaacaaggtaccctaggganaacagcgcaatcctattgtaagagccatatcaacaataaggngttaccgaccncgangttggancaggacatcccgaggggncagccgctaacaaaggtcgtttgttcaccgattaaagg

SEQ ID NO: 18957 - DNA, 139 bp, Homo sapiens
ggggggtattttgggtactgtgatggggtcatcaaattattaatctgaaaatagcaacccagaatgtaaaaaagaaaaaactggggggaaaaagaccaggtctactgtgatagagcaaagcatcaaagaatctttacgg

SEQ ID NO: 18958 - DNA, 320 bp, Homo sapiens
aacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgcatcttgagctcttcatttattttgactgtgatttatttggagtggaggcattgtttttaagaaaaacatgtcatgtaggttgtctaaaaataaaatgcatttaaactaaaaaaaaa

SEQ ID NO: 18959 - DNA, 300 bp, Homo sapiens
tcacagcgctaagctcgcactgattttttacctgagtaggcctagaaataaacatgctagcttttattccagttctaaccaaaaaaataaaccctcgtccacagaagctgcatcaagtatttcctcacgcaagcaaccgcatccataatccttctaatagctatcctcttcaacaatatactctccggacaatgaaccataaccaatactaccaatcaatactcatcattaataatcataatggctatagcaataaaactaggaatagccccctttcacttctgagcccagaggttaccc

SEQ ID NO: 18960 - DNA, 194 bp, Homo sapiens
aagtgtttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggagg

SEQ ID NO: 18961 - DNA, 300 bp, Homo sapiens
  misc_feature 64, 173, 242, 257, 286: n = A,T,C or G
gaaccttgtggagaagaccccggcgctggcgaacgctgcttgtgacttactcgaagcctcgatnggccacattttggtactacgccaaggttgagctggttcctcccacccctgctgagatccctagagctattcagagcctgaaaaaaatagtcaatagtgctcagactggnagcttcaaacagctcacagttaaggaagctgtgctgaatggttggtgccactgaaggtgttgatgtggnctatgtcggagagantataggcaagcggggcatcattggctatnaaggttggaagacc

SEQ ID NO: 18962 - DNA, 499 bp, Homo sapiens
actaaattctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtgaccaagttctcttttgtgttttctgctggtattctggaggtgggaaggacttggagagagttaagaaacacctggtacctcaaagatgactcatctacaggttgtttcctattgagactttcccagggaagcctgatttcactttgcctgttaatttcactctgcctgttaggtgggttttcaaaccctgattaggata

SEQ ID NO: 18963 - DNA, 300 bp, Homo sapiens
  misc_feature 31, 63, 94, 140, 233, 264, 271, 279: n = A,T,C or G
ccgaacgccagaagatctgaatggaatgttntggattgaagaaagtgggaaatggcctcaatncacaaagtcacagcctgatagaaaccagtgngactttactgccagtgaacccatctcgtctccagcctttaggaggngttgcgttctctcttgggttgagtggcgaggtctctcccgagtcccagggccacagtgcaatgtcacatctcctttgggggaaagtgactggnaaaagagaacaaaactggaggaacctaaagncttcggncacctggnttaatttattcaagagtgatt

SEQ ID NO: 18964 - DNA, 414 bp, Homo sapiens
accaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgtcaagctcaacacccactacc

SEQ ID NO: 18965 - DNA, 389 bp, Homo sapiens
ctgggaggcccaggcggcttcgcgttctgagaataaacagaacctctgttgctctgcgacttgcaggcactgggagattcgtagctaagacgccagggcatcccggaagctgggaaatgggactgttgacattcagggatgtggccgtagaattctctttggaggagtgggaacacctggaaccagctcagaagaatttgtatcaggatgtgatgttagaaaactacagaaacctggtctctctgggtcttgttgtctctaagccggacctgatcacctttttggaacaaaggaaagagccttggaatgtgaagagtgaggagacagtagccatccagccagatgtgttttcgcattataacaaggacctgttgacagagcactgcaca

SEQ ID NO: 18966 - DNA, 366 bp, Homo sapiens
cgtctagacgtgcacccacagccaccttccatgacagtaaacataacattgtgcatgtgcatttcgatgcaaccagaggatggttactgacttctggaactgacaaggttattaaggtaagatgccatcttattaagaagctttccatctttggcctcatataaatatacaggagcatcaagaacatgggaggcactgttctaaaggttatccttgggtagccggcatggtggcatgtgtctgtagtcccagctactcaggagatttaggagggaggattgcttgagtccaggagttgaaggctacagtgagctttgatcacatcactgcactctagcctgagcaacaaagcaagacctcatctct

SEQ ID NO: 18967 - DNA, 115 bp, Homo sapiens
aggaagagcctcccaaattgcttgagattacagtttatgctttttaagcaacagtctcacccatttataagaatttcttcaacaagagcaaaactccatctcaaaaaaaaaaaaa

SEQ ID NO: 18968 - DNA, 300 bp, Homo sapiens
  misc_feature 31, 87, 202, 264, 292: n = A,T,C or G
gagctaaaggacagtattccagttactgaantttcagcaagtggaccttttgaaagtcatgatcttcttcggaaaggtttttcttgngtgaaaaatgaacttttgctagtcatccccttgaattatcagaaaaaaatttccagctcaaccaagataaaatgaatttttcacactgagaaacattcagggctatttgctccgntaaaattacagatggaattcaaggcagtgcaagcaggtcagcgcttcatttctttcaagctnaaatctttcactggatggtttgaggggnaatgatga

SEQ ID NO: 18969 - DNA, 357 bp, Homo sapiens
gtgccctctggagaaggccctggatgtgatggagccaccttccacaagtactcgggcaaagagggtgacaagttcaagctcaacaagtcagagctaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctcctgtcgccagtgg

SEQ ID NO: 18970 - DNA, 300 bp, Homo sapiens
  misc_feature 29, 31, 214: n = A,T,C or G
aatttgtctaagcactgggccagtctgtngngggcattgttttctacaaccaaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgnaatcataaaataacagtaaattccaaacctcaaaaactattatggcctgagcacagctgaaatctagcagagttaaactcttctgc

SEQ ID NO: 18971 - DNA, 325 bp, Homo sapiens
acaataattcagtattcatgtcaaaattgagaagtgccctaattgaatgtgtttgaatgttatccttgcacaattctttaaattgaaagataaaatgttttacctcactgttggacatacattccaagcttttcaactctaggagaaaaagaaaatcatgttttcctgtattgtaaattttagactatttcatatacattgtattaaaactgccatatcaattttaatgtatagattttgcaaatattatgctatatgtaatacctaactgtatctgtagtgtatatgtaatatatttatgcccaataaatgtttaattcttaat

SEQ ID NO: 18972 - DNA, 203 bp, Homo sapiens
cccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgt

SEQ ID NO: 18973 - DNA, 223 bp, Homo sapiens
tccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttg

SEQ ID NO: 18974 - DNA, 261 bp, Homo sapiens
ggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatg

SEQ ID NO: 18975 - DNA, 300 bp, Homo sapiens
  misc_feature 153, 252, 277, 293: n = A,T,C or G
tcaaaaaatcaaaattcaagcaaagtaatttgttatcttttccaaaatattagtagggaagcaatttgttttctttcaccaagatttacagagcagttcattaaaatatcacttgtttaaccatggtaaaacaattacttgtttaattgaggntttcaccttttaatgacttttgcatattgaaatttgccaagaaattagcaaggctacaactttgattcttgcatactattttaatacttttaggtggangccaatcctttaattctttatttgnccaacacttagtatgngcaaatt

SEQ ID NO: 18976 - DNA, 300 bp, Homo sapiens
  misc_feature 146: n = A,T,C or G
gatgttttctctttgaaagatagagattaatacaactacttaaaaaatatagtcaataggttactaagatattgcttagcgttaagtttttaacgtaattttaatagcttaagattttaagagaaaatatgaagacttagaagagnagcatgaggaaggaaaagataaaaggtttctaaaacatgacggagggtgagatgaagcttcttcatggagtaaaaaatgtatttaaaagaaaattgagagaaaggactcagagccccgaattaataccaatagaagggcaatgcttttagatta

SEQ ID NO: 18977 - DNA, 329 bp, Homo sapiens
aaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatgcc

SEQ ID NO: 18978 - DNA, 300 bp, Homo sapiens
agtggaatcttctacatggaaagaaaactgcaggataaacatttgctccagaacagtgaaacatcagatccctgaactactagcagaacagctcactcataatgtttattctgctgatgtccttaactttggcaacatctgctgaatcaataatgaagtcgtgctgtagaagctatgccttaagactctggattttggaggagagaatggggcttgggaggagaaatactagcaagaatcaccaaatattccagagacagaagataagaatgctgctagtggccccaagacaaaagaaat

SEQ ID NO: 18979 - DNA, 201 bp, Homo sapiens
ctgaccaacatggtgaaaccctgtctgtactaagaatacaaaattagctgggcatggtgacacatgcctgtaataccagctactcgggaggctgaggcaggagaatcgcttgaacctaggaggcggagattgcagtgagctgagattgcaccattgcactctagcctgcgtaacgagcaaaactctgtcacacacacacac

SEQ ID NO: 18980 - DNA, 220 bp, Homo sapiens
tctacccagtcagaagatcacaccatgtagactttctactagaggacttgaaagagaactgaggggccacaaaataaacttcaccttccattaagtgtcaagcatgtgtgcatactcagtaggcgagctagaaacagtctttttcatcctttgtgatgaagcctgatttgtgccggcgttgccttatatgaatatgcagtctgggacttcgaaataatga

SEQ ID NO: 18981 - DNA, 288 bp, Homo sapiens
cgcgccagagcccagcgcgcctcgtcgcatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggcatcactgacaaagagaaggcagagaaactgaagcagtccctgcccccggtttgcaggtgaaggaactgaaatgaaccagacacactgattggaactgtattatattaaaatactaaaaatcct

SEQ ID NO: 18982 - DNA, 191 bp, Homo sapiens
ggagaaaagtgcccaagatcctttcaggattaatttattcaaaaaggaaataaaaaatactcaatatgcaaaagtcttgtgaagaaaatgagggaaaaccacagaacatgccaaaggccgaggaagatcgccctttggaggatgtaccacaggaggcagaaggaaatcctcaaccttccgaagaaggcgta

SEQ ID NO: 18983 - DNA, 300 bp, Homo sapiens
  misc_feature 32: n = A,T,C or G
cggagcttgaggaaaccgcagataagtttttntctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaatacc

SEQ ID NO: 18984 - DNA, 277 bp, Homo sapiens
  misc_feature 30: n = A,T,C or G
cttccaaatgtggtacctcagctatatcantgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagcaactaatgaagaaatgaataataaattttgacactgaaaaacattttattaataaagaatattgacatgagaaaaaa

SEQ ID NO: 18985 - DNA, 398 bp, Homo sapiens
ttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaaggtta

SEQ ID NO: 18986 - DNA, 300 bp, Homo sapiens
  misc_feature 32, 62, 71, 135, 249, 258: n = A,T,C or G
agctggatggatcatgaaaatattttgtttcncaccatatgcttttgttggcattatgcagnaaccattgncatcgttggaatgaattatgctttcattacctggtggttaaatctagacttaagaggctctgcncctcagaagttggacttctgaaaaatgctgaacgagaacaagaatcagaagaagaaatgtgactttgatgagcttccaagtttttctagataaaccttttcttttttacattgntcttggttntggttctcgatcttttgttggagaacagctgctaaaggatga

SEQ ID NO: 18987 - DNA, 410 bp, Homo sapiens
ttccagtctttgaaaaagcgggaaaatgtgggaagacagtaaaatctgttcccagattcctcgggtgcctgctggtgcctcctttggtctcctaagtccgtgctgtctccagtaaggaaagatttgtgtcctcccatcaggcagatgcaggccgggccagggggttccttggcattgtcaatgtctttcacttaacgatcctcaatagtttggagaaaagtattttggtttccttcaggtgcaggaaacctctgggataggcattggatgagatatgtgagtaatcaggttagctaagctatgatacagtgacaggtaaccccaatatcccagggctcataaggcagagtttattcttccttcatgaagccactgaaggctacagctctgtaggcagcttcctccagctg

SEQ ID NO: 18988 - DNA, 227 bp, Homo sapiens
tggtttgtcctaaggccatagttaaaaagtaccagctctggctggggtccgtgaagcccaggccaggcagccaaatcttgcctgtgctgtcatacaaccctctgctttcacatctctgagctatatcctcattagtgaaggtggcttttgctttatagtttggctggggagcacttaattcttcccatttcaaaaggtaatgttgcctggggcttaacccacctgcc

SEQ ID NO: 18989 - DNA, 300 bp, Homo sapiens
  misc_feature 17, 33: n = A,T,C or G
gtttcccattatgccgntggagatgagtgggancgaatgtctgaatcaggctttaaactgttgtgccagtgcttaggctttggaagtggcatttcagatgtgattcatctagatggtgccatgacaatggtgtgaactacaagattggagagaagtgggaccgcagggagaaaatggcagatgatgagctgcacatgtcttgggaacggaaaaggagaattcaagtgtgaccctcatgagcaacgtgttatgatgatgggaagacataccacgtaggagaacagtggcagaaggaatatc

SEQ ID NO: 18990 - DNA, 157 bp, Homo sapiens
  misc_feature 36: n = A,T,C or G
tgttctcaacttggttaaggaggaagaaaacccagncaatgaaattcaatgaaattcttggaaatttccattaagtgtgtagattgagcaggtagtaattgcatgcagtttgtacattagtgcattaaaagatgaattattgagtgcttaaggaaaa

SEQ ID NO: 18991 - DNA, 293 bp, Homo sapiens
gcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattg

SEQ ID NO: 18992 - DNA, 143 bp, Homo sapiens
agacatgaaagtgcagatgcctgtttgaaatactaagtttctttccttaggatgtatacctagcagtgagactaccggatcatgtggcagttctattagatggccgaggaatcttcataacgtaggcacaatcgctgaactac

SEQ ID NO: 18993 - DNA, 111 bp, Homo sapiens
  misc_feature 24, 28, 50, 52, 61: n = A,T,C or G
gcttagcgataagttttcaaccgnaaantttaatagcttagggatttgangngaaacaccngcggcttaggaagagtagcgtggggaaggaaaagataaaagggtccgaaa

SEQ ID NO: 18994 - DNA, 313 bp, Homo sapiens
actttaaaggaaaagagaaaactgcatcacagtcccattctccagtgtccatgcaatgaattgctgagcatttaggaagcagcaccaagtctattacaggcatggtgtgaaacttgatgtttgacctgtgatcaaaattgaaccattgtacagtttggcttctgtttgcttcaaaatatgtagaattgtggttgatgattaatttgcgagactaactttgagagtgtaacagttttgaagaaaacattgaatgctttgcaaatgaaggggcttcacggaatgttacaatgttactaatataatttggcttttg

SEQ ID NO: 18995 - DNA, 300 bp, Homo sapiens
ccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgataactggttgtccaagatagaatcttagttcaactttaaatttgcccacagaaccctctaaatccccttgtaaatttaactgttagtccaaagaggaacagctctttggcactaggaaaaaacct

SEQ ID NO: 18996 - DNA, 220 bp, Homo sapiens
tggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttctgtgttgtgtgataaaaaaaaaaaaaaa

SEQ ID NO: 18997 - DNA, 121 bp, Homo sapiens
aatcttgggacatatttgggcactggttggcaagtgtacaatgggtcccaatatcagaaacaaccatcctagcttcctagggaagacagtgacagttctccattatatcaaggctacaagg

SEQ ID NO: 18998 - DNA, 162 bp, Homo sapiens
taattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaacacgt

SEQ ID NO: 18999 - DNA, 199 bp, Homo sapiens
  misc_feature 35: n = A,T,C or G
acatgaactatataattttgttcatgctacattgntttatacagcatattaaattgtcatctgttaatttcatagatttttagggtttgaggcataattagaacatttcattactttaatttttaagaaccaaagaaattcattactattccttgttaggtcagtcagtaccaaatttagaaataaaattaggtgaaaa

SEQ ID NO: 19000 - DNA, 380 bp, Homo sapiens
ctcttcaataactggtgctggaaaaactggaaatccatgtgcagaagaatgaaacaagacttatttttcaccgtatataaaaatcaacttcagatggattaaaagcttgaacataaggcccaaaactattgaactcatgcaagaaaacatgggagaaacacttcagggcttcggtctaggaaaagattctatgactaaaacaggcaacaaaaataaaaataatagataaatgggactatattaaactaataggcttctgcaaagcaaaggaaacaggagcaaagatacaagctgttgaatggaagaaaatatttgcaaactcttcatctgacgagggactaatatttagattataaaaggaattcaaacaacttaacagc

SEQ ID NO: 19001 - DNA, 404 bp, Homo sapiens
cagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaatttatatgcacagtaatttcccttttatatgtcaagtaactatttgtaaaagttatactcacaaattattataatgatacta

SEQ ID NO: 19002 - DNA, 372 bp, Homo sapiens
gagctacacaaatcaacacagacgatgtcacagtattgcactaaagaagcaagccataaaagattacataaaatataactttcttgtattcttatacagtttaaaacaagttaaaactaaactatgtagtttaagtttgtgcacataggtagtaaaactaaaggagcaaaaggaatgatcacagaagtcagattagtgttccatctggtggtaggagagggacaatgaacttggaggaacatatggaggacttcaattattggcaacattctatttcttaatctgttgctgatctgattgttccctttataattattatttaaattgtacatatgcttttagatacattttttgtgagcaggtaatagaaac

SEQ ID NO: 19003 - DNA, 403 bp, Homo sapiens
gcgcctcgcttcgcttttcctccgcaaccacgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtgg

SEQ ID NO: 19004 - DNA, 437 bp, Homo sapiens
ccggataagttcaggaaaacattctgcatgttgaatctagtctgatgtacttatccatctcattacaaacaaaaacacacagactgcatttgtagctctgtaatccttgaatacggaagtaaattttcttctttcctgactttgacattgtagctatactgtttccatttttgtttttacaaatcctttgggtctaattctgtgagcctacctatagcactggattaaaatgtctgcatcatttctttagttatccagttaactttaaaactgttgtaaaagtgtaaaccagcccatgacaggtttttgtacatgttaaagaacttcattgtcagttttcatgattattgtgtaaggaagactgatgtagatgttctgtgctgtcctggaccatgttaattacacttacgacgtattttagttccacatcacaatga

SEQ ID NO: 19005 - DNA, 247 bp, Homo sapiens
aagaacagcctgggcaacatggcaaaaccctgtctctacaaacaatgcaaaaattagctgggcatggtggcgcctgtagtctcagctacttgagagctgagatcaaggatcaattgcttgagcccaggaggcagaggttgcaatgagccgagatcatgccactgcactccagctgaggtggacacaagcaagtcctcatctctcaaaaaaataaaaagaattacatgaatgaaaaaaaaaaaaaaaa

SEQ ID NO: 19006 - DNA, 110 bp, Homo sapiens
ggtgacctatggcctggtaccactgtcaaaaatctacagacagtcaatgtggatgagaactaatcgctgatcgtcagatcaaataaagttataaaattgccacaaaaaaa

SEQ ID NO: 19007 - DNA, 440 bp, Homo sapiens
attatcaaagaataaaagactcaagaatatgcaatactggggaggatgggatgagacaggcactctctgaaactgctggtggaaacataagttgattcacaaaaatattcaccatagcattcatagcattataaaataatgttacaaagcatctatgtataaactataaactatgatacagctatatgcagcccttaatgtttaggaaccatttctagttcacatagaatgatgttcacaaagtgggatacaaacatatatatttatgtaatcccaacagtgtaaaacaatagtgtaaaaagaagtgtgctgttcagagtggttatttctacgacctgaagtatagatgacttttagcttttctctgcactttcatgtattttctagttcctacaatcagcatgtgttattataaacaggaaaagggttatctaaaaatg

SEQ ID NO: 19008 - DNA, 210 bp, Homo sapiens
tgtcttctggtaacagctgatattagcaagcagcatcttatgtcctgatttcatatagtagaaaacaaacattgggtcatttaaagatggaaaggtgggaaaattctttgatatttgatgtcattgtatccacatttgttgtaagacatattgcataccaattataattatatcaattaaagttgataaaagcttcaaaaaaaaaaaaaa

SEQ ID NO: 19009 - DNA, 300 bp, Homo sapiens
  misc_feature 222, 259, 286: n = A,T,C or G
ataaatactgccggttaaatgatcacaagaggcccatttgtagaaggctggttgacaacggctggagcaaattaaataaataaaatagctctgtctttcaatgaaacactcacgatgactactgcgccttctctttcgaaaaactcttaatttaggtgacttatggcaaaattttatcttaaatcaatgtgattctttcttgttttgggagacgggggaggnatcctcattagttctttcttcaggcttgtgctttagntgcgtggctgcgcagcctccatatganttaagccatctctt

SEQ ID NO: 19010 - DNA, 300 bp, Homo sapiens
  misc_feature 164, 290: n = A,T,C or G
caaggacatctctacaaattactatgcgagtgagaagaaaacatttgaaattaatcccagacacccgctgatcagagacatgcttcgacgaattaaggaagatgaagatgataaaacagttttggaccttgctgtggttttgtttgaaacagcaacgcttcggncagggcatcttttaccagacactaaagcatatggagatagaatagaaagaatgcttcgcctcagtttgaacattgccctgatgcaaaggtggaagaagagcctgaagaagacctgaagagacagcngaagacacaa

SEQ ID NO: 19011 - DNA, 312 bp, Homo sapiens
aatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcacgtctttcacccagatatatcaaatgttagaagaccagtgtgcttcattagataacgtt

SEQ ID NO: 19012 - DNA, 340 bp, Homo sapiens
acttttgtatacaaaattaatgaaactgacggtgtattctgatcataagtagatgagtgctacatttgataattgattatttacagcttagaatattgatttcttgaataccgtataagcacatttgactgtctttgatatatggactactgcattccattgattcttatttcgtggtcggctttatttctttcacaactgtgtaagcctaaagagctaaagctctaaaactgtctgagaaacaatgaatagtacatgtatatgtatattttaaactgccttattgctcaatgaggtgctgtcctggagtatctaactttcagttgactcaaaaactttg

SEQ ID NO: 19013 - DNA, 119 bp, Homo sapiens
  misc_feature 95, 111: n = A,T,C or G
agaacgtcgtatgagatcctacaatggaagaataaaatcacctcattcttcatttcagatctgaacattagcagtgatctagatttttttttttnaaacaaaattaagggngcttagag

SEQ ID NO: 19014 - DNA, 141 bp, Homo sapiens
  misc_feature 18, 35, 99, 119: n = A,T,C or G
ggaataggaataagcacnagttcttaacaaccganacgtcctacaagatttagaaaaaagttgacaacataatctagtttacagaaaaagctggcgctngaatacttcttaaaaggcanatagaataccatcaaaactgct

SEQ ID NO: 19015 - DNA, 513 bp, Homo sapiens
tcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaccatgtgactttgcacagcccaagatagttaagtgggatcgagacatgtaagcagcatcatggaggtttgaagatgccgcatttggattggatgaattccaaatctgcttgcttgctttttaatattgatatgcttatcacttacctttatgcacaaaatgtaagggttataataatgtaacatggacatgatcttcttataattctactt

SEQ ID NO: 19016 - DNA, 220 bp, Homo sapiens
caaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaaaaaaaaaaaa

SEQ ID NO: 19017 - DNA, 270 bp, Homo sapiens
ccaagaaggtgagacagttctgcttgaagaactgaaactggccacccagctgaccggaccggtcatgcccgtccggaacgtctataagaaggagaaagctcgagtcatcactgaggaagagaagaatttcaaagccttcgctagtctccgtatggcccggtgccaacgcccggctcttcggcatacgggcaaaaagagccaaggaagccgcagaacaggatgttgaaaagaaaaaataaagccctcctggggacttggaatctaacaaaa

SEQ ID NO: 19018 - DNA, 296 bp, Homo sapiens
tgaaaatgtcttcatgattaaattcagcctaaacgttttgccaggaacactgcagagacaatgctgtgagtttccaacctcagcccatctgcgggcagagaaggtctagtttgtccatcaccgttatgatatcaggactggttacttggttaaggaggggctaggagatctgtcccttttagagacaccttacttacaatgaagtacttgggaaagtggttttcaagagtataaatatcctgtattctaatgatcatcctctaaacattttatcatttattaatcctccctgcctg

SEQ ID NO: 19019 - DNA, 505 bp, Homo sapiens
catttcatgtgcatgggataggattgattcattattgttaaagtgggcataactgcccaaaacaacttacagattcactgctattgctagcaaactaccagatttcatttttctcagaaattcgaacaaactattctaaaatccatatggaaccaaaaaggaggcagaatagccaaagcatcctaagcaaaaagaccaaagttggaggcatcacactacacaatttcaaactatacaacaagactagagtaaccaaaactgtagtactggtacaaaaacaggcacacagaccaatggaacaagttagagaatccacaaataaagctgccagcagcaaccatctgctttttgacaaagtcgacaggaacaagcagtggggaaagtgctcattattcagtgatgctgggataactggctagccaaatgcagaagattgaaaccgaccccttcctttcaccatatgcaaaaatcaactcaagatggattaaaagacttaattgtaggc

SEQ ID NO: 19020 - DNA, 277 bp, Homo sapiens
  misc_feature 40: n = A,T,C or G
cagaagaggagaagaggaaacacaagaagaaacgcctggngcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgaaaaa

SEQ ID NO: 19021 - DNA, 110 bp, Homo sapiens
ggggaagacaggttgagcccaggagtttgaggttgcagtgagctgatcatgccactgcactctagcctaggctacagagcaggaccccatctccaaaaaaaaaaaaaaaa

SEQ ID NO: 19022 - DNA, 310 bp, Homo sapiens
attgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgactcacatactatagaaagatattagtatgcatttaataaaacatattcactc

SEQ ID NO: 19023 - DNA, 150 bp, Homo sapiens
  misc_feature 17, 29: n = A,T,C or G
cgactcacatactcgtncagagccggacnaagcctcttcgcgcagaagtctcccggagccatggccgagtactcctatgtgaagtctaccaagctcgtgctcaagggaaccaagacgaagagtaagaagaaaaagagcaaagataataaa

SEQ ID NO: 19024 - DNA, 331 bp, Homo sapiens
ctgaagcttattagtgattaaccttgtttgtcagcttttatattttgaaaggaaatcttttacagttaaaatatttacctttcttgttcttttctactcccatatgaaaaagtaattttttttctgtatgatatggtgtagctttcatcctatagtgtgttcaagatgctcatattcaaatgtaaatgtacatttaaaaggtagtgatttttcaacaagggtgccaagaccattcagtgggagaaagaacagtcttttcaacaaatggtgttggaaaagctagatatccacatgtaaaagaatgaaattgggtccttatcttacaccatct

SEQ ID NO: 19025 - DNA, 300 bp, Homo sapiens
  misc_feature 116, 211, 224: n = A,T,C or G
agatacagccatccaccttcagatgtgctacgtgcgctctgccattcaactcggaaactataagtaattctcaagaaagccctcatttttataacctggcaaaatcttggtaatgncattgctaaaaaataaataaaagctagatactggaaacctaactgcaatgtggatgttttacccacatgacttattatgcataaagccaaatttncagttaagtaatngcctacaataaaaagaaatttgcctggcattttcagaacatcttttgagccttctgtgatgtaactgactactaga

SEQ ID NO: 19026 - DNA, 323 bp, Homo sapiens
tcatgaaaccgataaaaatgggagctccattgaacatgagagacattgattcgtagtttctaacatcctccaaatgaggagcccatccctaatttagatgcttctttcaaaggaggctcctttccttcgttatccataatatagtcacgccagtcctgaaaaaacatggaacagactccagatctttatatttcatactctaaagtcgtacaagccaatctgcatttcctctagtggaaactgtatagctggtcatctttccaggacccttttatcaagaaacaatgcagcttctacatttgtgctgcttctacaccaaaaca

SEQ ID NO: 19027 - DNA, 300 bp, Homo sapiens
  misc_feature 110, 120, 132, 159, 165, 170, 205, 247, 261: n = A,T,C or G
atggtggatgttttacccacatgacttattatgcataaagccaaatttccagtttaaggtaattgcctacaataaaaagaaattttgcctgccattttcaagaatcatcntttgaagctntctgttgatgtnaactggagctctagagatattcttatntcactnaatgnaaaattgggggaaaatatatatggcaatatttagnaaagcttttcttttttaatttccaggaaaaaataaaaagagnatgagtcttctggnaattcattgagcaggtagctcatttgagataaaggcaaa

SEQ ID NO: 19028 - DNA, 335 bp, Homo sapiens
tggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaag

SEQ ID NO: 19029 - DNA, 251 bp, Homo sapiens
  misc_feature 58, 73, 94, 116, 126, 161, 173, 220, 226: n = A,T,C or G
gcacatccacattgcttggattaaaaggcagattggagctactagagataagcagtgngagaagagcagagtnaatagctggtggatacctganggagagccaagcaattaaagtntaaacagcangaataaaacctttaaaactatatttgggacaaatntaactctgctgnctttcataaggcccaagatgatgtctatttggaaacaagctctatcnttgagntttatattgatactcatatgaataa

SEQ ID NO: 19030 - DNA, 310 bp, Homo sapiens
ttcacttaagtgtctggcccggaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcc

SEQ ID NO: 19031 - DNA, 237 bp, Homo sapiens
taaagtgtttcctagacaaacaaaaactgatgggatttgtcaccactagactgactatatgagaaatgcttaagaaagacctacatctggaagtgaaaggatgttctccatcaccgtgaaaacacactaaaatatataacttattgaaagagcagatacgtatatgagaaaccgaaaggaatgaaatgttattactacagaaagctaccaaatctcaaagataaacatcagagaggc

SEQ ID NO: 19032 - DNA, 194 bp, Homo sapiens
  misc_feature 75, 155: n = A,T,C or G
gtagcttgttggtcacgtgaagatgacagacgatgagcttgtgtataacattcacctggctgtcaacttcttggngtcattgctcaagaaaaactggcagaatgtccgggccttatatatcaagagcaccatgggcaagccccagcgcctatatnaaggcacatttgaataaattctattaccagttaaaaaaa

SEQ ID NO: 19033 - DNA, 310 bp, Homo sapiens
cattgcctagctaaaataatattaaagtcaaacatctttagtggattataggcaaaaatacatgtgaacacagcacatgtacattttttaattgagattttttaagagttcaaatgctaaacatgtatctgcaactctaatgtaccgttttcctggaaacatgctttaaataataattatatatgcccatctgcttctctagatcataaactacttatacatgtatacatgtatatgcataacatagcatgacagttataagggacagtacattctacatgtgaattgggtgtgcccagatgcattttgt

SEQ ID NO: 19034 - DNA, 300 bp, Homo sapiens
  misc_feature 57, 100, 106, 288, 295: n = A,T,C or G
accgacgtaggctttcctacaatacagcctgtaacaaaactaggctgcccgaacccntggtaatagaattgtttacctttataccaagaaggttgggaangcaccnaaatctgcatgtggtgtgtgcccaggcagacttcgaggggttcgtgctgtaagacctaaagttcttatgagattgccaaaacaaagaaacatgtcaagcaggcctatggtggtccatgtgtgctaaatgtgtcgtgacagggatcaagcgtgctttcttatcgaggagcagaaaatcgttgngaaaggntgaag

SEQ ID NO: 19035 - DNA, 156 bp, Homo sapiens
  misc_feature 106, 127, 129: n = A,T,C or G
aagttatttaaaatatatgcaaacaaaatgttcattctcattttatgtttgaggaaactgagaactgcatagattagttgacttatttttgaaatatttatttatntgagacagggtccagcctggncnacaagagcgaaactccatctcataaag

SEQ ID NO: 19036 - DNA, 330 bp, Homo sapiens
gattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacaga

SEQ ID NO: 19037 - DNA, 300 bp, Homo sapiens
  misc_feature 14, 227: n = A,T,C or G
caggcaagcaatgnggctggcacaaggtcggtggccaaaaagagtgctgaatttttgctgcacatgcttaaaaacgcagagagtaatgctgaacttaagggttagatgtagattctctggcattgagcatatccaagtgaacaaagcacctaagatgcgcgccggacctacagagctcatggcggattaacccatacatgagctctccctgccacattgagatgatncttacggaaaaggacagattggtcctaaaccagaagaggaggttgcccagaagaaaaagatatcccagaagaa

SEQ ID NO: 19038 - DNA, 195 bp, Homo sapiens
  misc_feature 22: n = A,T,C or G
gcgagacccggcatcataaaanctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtg

SEQ ID NO: 19039 - DNA, 194 bp, Homo sapiens
ccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctg

SEQ ID NO: 19040 - DNA, 300 bp, Homo sapiens
  misc_feature 34, 45, 59: n = A,T,C or G
aatgatttaatcttgttgttgttgttgttgttgntcacttgtggntctacattcctggngaatgatgaatgttgctgcaaagggctgccccctaccttataagggttgctgggcatttgaagcaggaagattttaaagatagattgaggttggttaaaattattcctgtaaccaacaataaagcaaagaagaggtcatttttggaaataacactggttcaaatagtgatgtagacttacctaattataaacaagagataatatctcatgcatagtttagacaaaaaaagatgttcaataa

SEQ ID NO: 19041 - DNA, 242 bp, Homo sapiens
gagtccaaattttagacatgtatacaaaggcagtaaatgaattggaaagaagagggaagttaatacttttagcttttctcttttagagagattagctttccattattttaacagaatagcttaccaatatgttctttccctattttgtgatgaacgtaactgaaatcttgtatctaattaaattcaattcctacctaaaagttttcacaaaaaagattatagtcatgtttgtgactaaagaa

SEQ ID NO: 19042 - DNA, 278 bp, Homo sapiens
  misc_feature 31, 117, 233, 241: n = A,T,C or G
aagagagagcagacaagcgggactagcatgnaattgacatttagtgcattctagtttctcttcattgtccatccttacctttttaaaacatcatatttctacctgtaaatttgcagngagtataatgataataaaaagcattcatataaatgaatgatgatatgccaggattatctctgaaaggattcatcactgggcatcactgaaggcagctgattcagcatgaatcttangctttggnggggaatgcagccccaaagtacactaaaaaaaaaaaa

SEQ ID NO: 19043 - DNA, 357 bp, Homo sapiens
atcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttggggggcctgtgtcctggtgcttgaagccacatggagggagtttcattaaatgctaactacca

SEQ ID NO: 19044 - DNA, 372 bp, Homo sapiens
tttcccaaaagacattcactctaccactgagaggctaatctggctatgtaaaagtgggctagattagctccctttatttctgataaagtaatatgcctattttggaaaggacttggaatataaacaaacatatatgtgtgtatgtatatgtatatgcacacatatatatcacatataaaatatatatcatatatataatgtgtgcattatatatcatatataatgtgcatatattatatatatgcacacatatacaatgtgcatataatatatgcacattacaatatgagctgtgtttatagatgtaaatgaatatacatgtattcatatatatgaatatctgcatatatacacataaatgaaaggacaaag

SEQ ID NO: 19045 - DNA, 152 bp, Homo sapiens
ctcacgatggattaaagaattaaagcccccaaactataaaactattggaagaaaacatatggaaaacacttcagggcattgaactaggcaaagattttacagctaaaatcacaaaagcacagactaaaaaaaaaaaaaaaaaaaaaaaaaaa

SEQ ID NO: 19046 - DNA, 146 bp, Homo sapiens
tacctctgatttccagtactggaactaaataagcttcattgtgccttttgtagtgctagaatatcaattacaatgatgatatttcactacagctctgatgaataaaaagttttgtaaaacaaaaaaaaaaaaaaaaaaaaaaaaaa

SEQ ID NO: 19047 - DNA, 302 bp, Homo sapiens
agcctgaagaagggaacttgtaagaatcaccattaattaatatgcattcctaccctacttacatatggctctgtcaataccagtggtgagtctgattgttttaaccaactgttttgagcttgtcttagagctcaccccaattaaaatttgtactcttcaaaagcattgacatagatcttggccttctatttccattttgctctgctgttttgttacaaagtaacaagttctacatactgtggctcctacaggtaggctttatttgtatctatgtacacacacacacacacacacacacacag

SEQ ID NO: 19048 - DNA, 312 bp, Homo sapiens
atcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttg

SEQ ID NO: 19049 - DNA, 305 bp, Homo sapiens
ctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgtctggaggaagt

SEQ ID NO: 19050 - DNA, 110 bp, Homo sapiens
gagcgctgcttctcaaacggccgaagttgcctcttttaggaatctctttggaattgggagcacgatgactctgagtttgagctattaaagtacttcttacacattgaaaa

SEQ ID NO: 19051 - DNA, 300 bp, Homo sapiens
  misc_feature 9, 22, 291: n = A,T,C or G
aaaaggggncgcaccataaagnacacttgtttctgttttcccagcccataccagaaagcagtctcttgaccttctggacaaatcattagcaaagattaaaagctgagacttagtactctttaatcttatttttcaaagtctgtcttgttttcaaactttctgtgacaatgatttctattgttgataataaaatataaaaagtaatcctaattctttacccttggtatcaactttaaaattgattttacaattttacaaaattgtaattagattacaaaaactggaatttgnagtcatttt

SEQ ID NO: 19052 - DNA, 300 bp, Homo sapiens
  misc_feature 38, 40, 92, 145, 209, 241, 243, 277: n = A,T,C or G
aaaagcgaatgagacagagatcagaatacattgactgntnttgaaaatagtaatttccccttaaccccttttcatttggaaaagaaacaatngtgaagacattaaattctcactaacagaagtaactttggtaattattttttgnatatcctcccaatcttttgacttatgcacatattttttcccaatatggagatcatatggaatgnactattttggaatgcttttttcattttacaangnattatcaaccttttccctctcaaaaatacattgngaatgactgcataggattcactt

SEQ ID NO: 19053 - DNA, 120 bp, Homo sapiens
cagttgaaaattcgggtataatttgattccctgactcaaaagcttaactactaatagcctactgttgactgaaaatcttaccaataacataaacaattaacccacataagctagacaaaa

SEQ ID NO: 19054 - DNA, 300 bp, Homo sapiens
  misc_feature 20, 47: n = A,T,C or G
taagatgatccaggaatgtnaacatacttttcttctgtaaattttgntaacaatttagctgcattaattaaatatttatgtagctaattttaatagtgatattttaatacaattcttaattttactcctggctttcaatcattcatatatgtttttaaaaattgctttttccattgctttacttcttaattacttttatcaaagtcttaattgtgtgtgggtgattttaaaagttaaatatttctataagatttataaagacaaactgggtacagtgactcacacctgtaatcccagcac

SEQ ID NO: 19055 - DNA, 330 bp, Homo sapiens
  misc_feature 279: n = A,T,C or G
agctgaccacatactgggtaaacattccttatatagcaatatattgttataagtagaattgaaaaataatctaacttaccaaaacttataaagcaactaagaatatatttagcatgaaatatactcagcctcactaagaaacagaataaacacttacttaaaagaccctcacaaagagatatattatatgtgtagatatcctaaaaatcccacttgtctcatgttatatcaaaatctgattaaattgcaatgagaattgcaaataaattaaattacagngggagttcagaagaataaatgtttgaaagtaaccaataccagtttgaggaa

SEQ ID NO: 19056 - DNA, 300 bp, Homo sapiens
  misc_feature 93, 244, 264, 276: n = A,T,C or G
ctcaaaagagcaatttgtataatcactttaaaacatgtatcaggttattacctttttctgtgtaaaactctgatctctcgtttcattcattgnaaaagtcagaatcttgcacaatgctttataggatgctccaccacatgaagcccccaattcttctatggacttccctccttccactatgtaattttctcactcagcttcacgtacagtattttcttgggtattactaaacatgcaacaaganacgggttggtctatatcttnctaagctttggncaagagccattatcccaagggaag

SEQ ID NO: 19057 - DNA, 284 bp, Homo sapiens
acacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctgg

SEQ ID NO: 19058 - DNA, 300 bp, Homo sapiens
  misc_feature 107, 145: n = A,T,C or G
ctagtgtggttatccctctgtcactgctgatggcccagcctcctatttgccttgctgggcctgtctggttcctgctgggctctgggacatgggacccttctccaagnccccaggaggctgcactcactatacaggccatggatcncttcaggatttgctgcttttcttgggaatccttttcctcttttaagatcctatggtcttaaaagatagtattgtagggctccccatacccacctttctctcaaaaatgtgtcaaatgggctggaggcagtgggtcatgcctataatcccagcact

SEQ ID NO: 19059 - DNA, 310 bp, Homo sapiens
ctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggccagcgatgcccccgctgtggagcccattacaagctggtgccccagcagctggcacactgagcacctgcactaaattactcaaaatgtgctgtaaagtttcttctttccagtaaagactagccattgcattgctccttctcc

SEQ ID NO: 19060 - DNA, 300 bp, Homo sapiens
  misc_feature 194, 196, 226, 264, 270, 284: n = A,T,C or G
gaaattatttaacaaactgaaaggagattttgattaaaattttgcagaggtcttcagtatctatatttgaacacactgtacaatagtacaaaaaccaacatagttggttttctagtatgaaagagcaccctctagctccatattctaagaatctgaaatatgctactatactaattaataagtaaacttaaggngnttaaaaaactctgccttctatattaattgnaaaattttgcctctcagaagaatggaattggagattgnagacgnggtttacaaaatgngaaatgctaaatatct

SEQ ID NO: 19061 - DNA, 350 bp, Homo sapiens
  misc_feature 214, 270, 288: n = A,T,C or G
gtatatagagtggcctgttactttcaaaacactcttctccaatttatcatgttaaaagctaggaattgggctgggtgcagtggctcacgcctataatcccagcactttgggaggccaaggcgggtggatcatttgaggtcaggagtttgggaccagtctgaccaacatggttaaactccgctctactaaaaatacaaagttagccaggcgtggnggcacacacctgtagtcccaacaactacttgtgaggctgaggcaggaaaatcattngaacccaggatcagaggntgtggtgaactgaggttgcaccactgcactccagcctggcaacaagagcaagactctatctc

SEQ ID NO: 19062 - DNA, 105 bp, Homo sapiens
taaagtccgcatcagaagactgaaggagttgaaagaccagtagacgctgctctactctttgagacatcactggcctatcataaatggggtaatttatgttacaga

SEQ ID NO: 19063 - DNA, 113 bp, Homo sapiens
tgaagtggaaaactggaagacagatgtacgggaaggcgaagaaaagaatagagaagatagggaaattagaagataaaaacatacttttagaaacaatttggaaaaaaaaaaaa

SEQ ID NO: 19064 - DNA, 140 bp, Homo sapiens
gcctgagtttgaattctgctccatcgcttctctagggtgtatgactcccaacaagtttcttaactcctctgtgcttcagttttctcatctctaaaatagagacaataattgtcactgtttttaagagcctggtgaggggt

SEQ ID NO: 19065 - DNA, 104 bp, Homo sapiens
tttgacccctacacagtttcccattatgccgttggagatgagtgggaacgaatgtctgaatcaggctttaaactgttgtgccagtgcttaggctttggaagtgg

SEQ ID NO: 19066 - DNA, 300 bp, Homo sapiens
  misc_feature 267: n = A,T,C or G
aggtcaacacagtattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggcaccgtgaagcgtaaacatttatcctatgtggtttctccttagaccttggggtcatggttcagcagaggttacataggagcaaatggntctcaattttccagtttgattgaagtgcagaga

SEQ ID NO: 19067 - DNA, 399 bp, Homo sapiens
  misc_feature 301: n = A,T,C or G
gagtctatacgcttgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgctngtgtgaggcaatcatgggggcatcacccataaagggaacacatttgacttttttttctcatattttaaattactacaagattattaaagataaaatga

SEQ ID NO: 19068 - DNA, 520 bp, Homo sapiens
tgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaaggttgtagggtgattaaaataatttgaggcgatcttttaaaaagagattaaaccgaggtggattaaaagaccttgaaatccatgacgcagggagaattgcgcatttaaagcctagttaacgcatttactaaacgcagacgaaaatggaaagattaattggg

SEQ ID NO: 19069 - DNA, 300 bp, Homo sapiens
  misc_feature 4, 101, 118, 137, 199, 287, 292: n = A,T,C or G
gaanttttcgaaagggattctcctaaacccacccacttctcttgcccaggctgctttttaaaaatatttttttattttttacttatttttaaattttctcnttttatttatttttggntttcttgttagccacctgntatatgggagaccgaaaattggtatattttgaaagtacttattacattatttttattttagnatcttgatgctcctggcaaaagggaaatgaggcttttaaaaaaaaagaccctaattctttattgactttttgccctaaaatgctaggnggganccagcaat

SEQ ID NO: 19070 - DNA, 440 bp, Homo sapiens
aggtgacaagccaacttgtgatggcctgcttttgcttttgcagttgggatgagaacaattgactctcccattggttgttagatagctgaaatggtgcgttggtggtcatacttagtgttctaggctgtgaaatcatggagttcttccacttccaagaatgactcatttgctgttggattctagtacagaatttagcagcctgatgtgtccccaaactgatttaatttctactgaagtgcccttgtgtacatttgttttgtaatttaccaaagtactacctgagtgtataatgactcctgcagtgagttaatgtaattgctgctttgccattgttttaaatctgggactagagaactgtgagcagaatgaaatcacattatctcagggtcaaaatatcattctaataaagtccatgcattagacaattttaaaaatcaaaa

SEQ ID NO: 19071 - DNA, 300 bp, Homo sapiens
  misc_feature 144, 161, 200, 209, 286: n = A,T,C or G
aaaatggaacttccagattatagacaatggaagatagaagggacaccattagaaactatccagaagaagctggctgcaaaagggctaagggatccatggggccgcaatgaagcttggaggtacatgggtggctttgcaaagagnggttccttttctgatgnattctttaaaggattcaaatggggatttgctgcatttgnggtagctgnagggagctgaatattacctggggccctgaataaagataagaagcatcactgaagataatacctggaagcatcatagngggttcttaactct

SEQ ID NO: 19072 - DNA, 344 bp, Homo sapiens
tctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattgcccagtctgtttcaaataaatgaactcaatctaaattaaaaaaagaaagaaatttgaaaaaactttctctttgccatttcttcttcttcttttttaactgaaagctgaatccttccatttcttctgcacatctacttgcttaaat

SEQ ID NO: 19073 - DNA, 509 bp, Homo sapiens
ccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcaagcaacccggccagtactgggagatacagccatccaccttcagatgtgtctacgtgcgctctgccattcaactcggaaactataagtaattctcaagaaagccctatttttataacctggcaaatcttgtaa

SEQ ID NO: 19074 - DNA, 300 bp, Homo sapiens
agcacttaattcttcccatttcaaaaggtaatgttgcctggggcttaacccacctgccctttgggcaaggttgggacaaagccatctgggcagtcaggggcaaggactgttggaggagagttagcccaagtataggctctgccagatgccatcacatccctgatactgtgtatgctttgaagcaccttccctgagaagggaagaggggatctttggactaggttcttgctccagacctggaatccacaaaagccaaaccagctcatttcaacaaaggagctccgatgtgaggggcaaggc

SEQ ID NO: 19075 - DNA, 300 bp, Homo sapiens
cacagataaagaacttacaaatacagtgactccattacttagcagggagattttggggaagaaaaatagggaagcgaactaacagttaaggaagtaacttgccagaatcacagctctgtatgtgacaaaccaaggtctgattccaaagctctacttttacagtaaaatcacgttgtcaccatggaggtgtatgattgaagatgaaattctgttttttaaccctttaaccagcaacccaagaacaatagtttgtgtaaaatggtatcaagttttctagttcattagtagtaggtaatgccc

SEQ ID NO: 19076 - DNA, 300 bp, Homo sapiens
  misc_feature 176, 225, 229, 259: n = A,T,C or G
aaaacagtgatacaagccatttagtccatccctaaagactcgatggttctggaactatatccatgttaagcagtctttttcacataattaactgaaacaatgggtaccctttgtaagattttttaaaattaggcaaaagaaagaagtcaggagaaggcaaaccaggactttaatgnaggaatgctcaaagatttcccataaaaattctcacaaaattgtttttgnctgntgagaggaatgagcaggagcattgtctggnggaggaggactctctgatgaaggtttcctggcatttttctg

SEQ ID NO: 19077 - DNA, 373 bp, Homo sapiens
tgacaagaagggccttactccttcacagatcggtgtaatcctgagagattcacatggtgttgcacaagtaccgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgctgattctaatagagagccggattcaccgttggctcgatattataagaccaagcgagtcctccctcccaattggaaatatgaatcatctacagcctctccctggcggcataaatttgctgtgtctcaagcaataaaatgattgttttccc

SEQ ID NO: 19078 - DNA, 300 bp, Homo sapiens
  misc_feature 29, 68, 89, 156, 178, 263, 266, 275: n = A,T,C or G
atgtaacgactgttataaaactgcatatngaaattatttgaattatagtgaaaaaaaagtacagcaanctggacagctgcaaatgtaanacctgagagtaataacactactcttttatctacctggaatacttttctgcataaaatttatctttgnaagctaactctattaatcaggnttcttctagcctctgcaacctacttcagttagaattgtctaatactgctctattaatcaggtttctaccctctacaacctacttnagntaaaattgnctaatacagcaatatttaaaaaaaa

SEQ ID NO: 19079 - DNA, 457 bp, Homo sapiens
ttggaggaaacccgcagataagtttttttctctttgaaagatagagattaatacaactacttaaaaaatatagtcaataggttactaagatattgcttagcgctaagtttttaacgtaattttaatagctcaagatgctaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttaagattaaaatgaaggtgacttaaacagcttaaagtttaagtttaaaagttgtaggtgattaaaataatttgaaggcgatcttttaaaaagagattaaaccgaaggtgattaaaagacttgaaatccatgacgcagggaga

SEQ ID NO: 19080 - DNA, 219 bp, Homo sapiens
tttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattccgaa

SEQ ID NO: 19081 - DNA, 143 bp, Homo sapiens
  misc_feature 17, 20: n = A,T,C or G
gggaggacagccaggangcnaccgtcataccatcattggacaagtagcatccgtactatacttcacaacaatcctaatcctaataccaattatctccctaattgaaaacaaaatactcaaatgggcctaaaaaaaaaaaaaaa

SEQ ID NO: 19082 - DNA, 338 bp, Homo sapiens
aaaagatgagaaaaaaggaaatttgacataaaattattattttatttacaccattttctcttcatttctgaataattcaaggaatgtcccagaatcatctctcaaaatagaagcttgaaaaatcctcattgaaaaatcagttttcaaacattttacatatttcatattgaaaaacatggattttcagatttctttagcaaatcatttatgggctgggccccttttagtgaaatgtaaggagttttcctgccaatttataaaagcatagaaaaacaggctgaagacacagctgacagcctttcggctttagtatcgctagccatctgttttctataagg

SEQ ID NO: 19083 - DNA, 230 bp, Homo sapiens
cagctttcacatttcttagcatttaccaccacctgacacatttttatatttggtttctgtttatcccactagaaatgtaagccccatgagaacagagactttacctctttatctatgtacctagtgcccagaacagtatttggcatatggcaaggactcagtagttgagtgaatgaatgaatcaaggctgaaggttaagtatgttggttaatgaatgccaggagaggcgc

SEQ ID NO: 19084 - DNA, 124 bp, Homo sapiens
  misc_feature 31: n = A,T,C or G
attgtaacatggaccatccaaagttatggcngtatcaaatggtagctgaaaaaactatatttgagtactggtctctcttggaattagatgtttatatcaaatgagcatctcaaatgttttctgc

SEQ ID NO: 19085 - DNA, 174 bp, Homo sapiens
acatgtacgtaaactgtggtgtcatgtaacgctttaacatgcctagcctatggtaactgatagcaattcttagtacaaggtagaactaagatattttagtgataaaagatctttacaaattaccttccatgaatgtttttcaggaagctattgagctaaagtaggaaagtatcc

SEQ ID NO: 19086 - DNA, 163 bp, Homo sapiens
  misc_feature 14, 15: n = A,T,C or G
caaagataggctgnnacaaaacaccttctaattggacttgcatgaagtctgttaaagcgtgcatgaaactggacactacatcagtggatgagtaagaggtgggattgagggttttgatgtcgtaaatgggcatgccctgcacaaggttattgtaaaaaaaaaa

SEQ ID NO: 19087 - DNA, 198 bp, Homo sapiens
ttaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaatta

SEQ ID NO: 19088 - DNA, 266 bp, Homo sapiens
tcaagaagcagctgatttcctgccagggcttatattaggggggtgattcttaaaggacattaggattggtgctcagaaatggttaatcatgctgtgtgctagccagggccagctggtaccttctttgccatgagcattcaagggacggctaacctttattgacaatctatattgcaaaagttaggaaagaggttgtgagctgattggattaaagacctgcacttcagtaactcagcacgcttccacttcactcaacttaagagggt

SEQ ID NO: 19089 - DNA, 319 bp, Homo sapiens
agatcatctgtatccctgggactggacgttacatcgagcctccttacttccccctgtgcccagcttcccttccatattactgaacaaacatggtatatggtgtggtgagcccagtactcattctaaggcgcaggaagatgcctggaagcaaattctagccttcttctgcaaacacctgggaggccccagaaaacagctgtgcctaaattgtaatacatttgtctggtgccgcatgagagattcaagatcagattctagtgttcagtaaccctatgtgaatcagatgtctcctggataacattaaagccatgtctttgcc

SEQ ID NO: 19090 - DNA, 300 bp, Homo sapiens
  misc_feature 198, 223, 252, 268: n = A,T,C or G
ttgagatgagtgtgtaggggcatatgagaattgcaaagaagagaaagggcaggaagaaaagactgaaaagaaatgtgtgctttgagaaatacacacatttttgagtttgaatagaagaaaagaaggtggcagaagtggcaaatcagggagaaagaaatcaggacagcatattattaggaagtctctcttgaggtgtgngaccttgttttactccaactactgnggttttcattgccttgcagactcttctgnactccatgggtatagnaacgctctaactcaaattaattccatggtctt

SEQ ID NO: 19091 - DNA, 210 bp, Homo sapiens
  misc_feature 38, 41, 109: n = A,T,C or G
gtgagcaacctgctctattaccagaccaactacctggnggnggctgccatgatgatttccattgtggggtttctgagcccttcaacatgatcctgggaggaatcgtggnggtgctggtgtcacagggtttgtgtaggcagcccacaataaagacgccttcgccggatgaagaagcgctaccccacgacgttcggtatggggggcatgttg

SEQ ID NO: 19092 - DNA, 300 bp, Homo sapiens
catatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcatatttccactgcaggcaccgaagcctcggggacaggcattattgaagttcatgctaaa

SEQ ID NO: 19093 - DNA, 300 bp, Homo sapiens
  misc_feature 198: n = A,T,C or G
atatttggtaacttctagaaagccagaaaatggactctgatttcatagcattttgataaaatgccacaaaataagggctatagagagatttttacaagtcaagattttttgttccccaaatcttttaaatgaagccagtgactcccagtctcaacacatggccccaggcaagacagaacaccatggaaaaaaccctgnaagtattatggcactctccgaatcctcctgaaggcatttcctctacagacatagggtacaggaagtgaaatgcaaatgtgcaattttttttaaaggagcttt

SEQ ID NO: 19094 - DNA, 363 bp, Homo sapiens
tgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagc

SEQ ID NO: 19095 - DNA, 350 bp, Homo sapiens
  misc_feature 202, 210, 245, 270, 288, 344: n = A,T,C or G
gggcaataagaagcagcctgttatagtgcccatgtatgcagcaggattgggtatgttagagcccaccaaggaaccactgaaaccactttctgctgcagaaaaaatagcttccatcggcagacagccaccatgtcaccagatatgaacacatgtacatctgatcagttccaggtaaaaatatctatatgtgataaatatgttnatgcgggnatatacacatatatccacacatactgggctttttncttcatttatgactgtttaaaaaanattgggaaagctggattnaatgatggacatgattttgattaattaacatcccttggaatacaatggacaaaatnggctta

SEQ ID NO: 19096 - DNA, 300 bp, Homo sapiens
gaggctgccagcttgactgtgcatgcccagactcccactctctgaaacctttgctctgcctgcttgagaattagcagtttccagattttagaacttacgtgagtacatataccattgattagaaacattaatatgtattcaggtgagcagtatgaatagtcttcccaagcagaataactaaaacctataaacagcccttagatcagacaagttatgtttgctattgaatagattaagagaaacctcagctttcagagttctggacctaagaatatgatgaaggccctgttgcaggaaatg

SEQ ID NO: 19097 - DNA, 330 bp, Homo sapiens
tgctttttctgtggaatgaagggtttggattagataattttaaaaattaagttcggttccaagattctgtgagtctctttttacagcacctgcttgactctcaggatagatctcttgctctatagaatatgtgatctcttgttgaggaaacacctaaaacctgatgtgcagaatggggcaggggcagaaacagttgtggtgaacagaaatagcacctgaatttcaggaggcccatatgtcagaacagtaggccttgaataaggcagcatgatttattgtgcaaataaaaatggatggaaatgatttttttataaagcaataagaatgggg

SEQ ID NO: 19098 - DNA, 354 bp, Homo sapiens
aagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagcg

SEQ ID NO: 19099 - DNA, 301 bp, Homo sapiens
aggtaagtcactactggtgttttcagtgataacaattcatagaaagttgttttaaccatcttaggaataattattaaatgctcaagttaactttggtagaggctgttttagggaccttataggtaagaaatgttaatacaggcatcacttagagtattactgttacattaggaaaatttccctacctactactacttaggctataaactttcaactgacagtaaaccttttctaccactgactacaaaacaaagttattttccttctctgaaatcacctgtttaaatgaaaaaaaaaaaaa

SEQ ID NO: 19100 - DNA, 366 bp, Homo sapiens
caagacctacctggagtggcccatggacgaggctcagcgggaaggattttgggtaaatctgagagctgcgataaagtcctaggttcccatatttaagaccagtctttgtctagttgggatctttatgtcactagttatagttaagttcattcagacataattatataaaaactacgtggatgtaccgtcatttgaggacttgcttactaaaactacaaaacttcaaattttgtctggggtgctgttttataaacatatgccagatttaaaaattggtttttggtttttcttttttctatgagataaccatgatcataagtctattactgatatctgaatatagtcccttggtatccaagggaattg

SEQ ID NO: 19101 - DNA, 386 bp, Homo sapiens
tgttcaaatgaatgaataaagtgatagggaggatgctaaagtcaagattgaatgtaaccattgttagtggcatccattttgggattaccctaaaatggttgatataggcagtgtttgcagcaaggctgacgccacttgactcatggttaagaggtcaaggatggcagagaaatgaagtatgtagctattcttatttccttttagtaaatttagaagatagaataactctttatagttattctaaaaaaacatcttaggtttcttctttctctagactgtggttagaggtaaactaatgtcttctaaagattcacattgatttcagtctggagtttatccctgcagagtgctgtgggcatggaggaatatgtcaatcattgaagctt

SEQ ID NO: 19102 - DNA, 303 bp, Homo sapiens
tataaagacccaattacagaatttgttgaatgtttatatgttaactttgactttgatggggctcagaaaaagctgagggaatgtgaatcagtgcttgtgaatgacttcttcttggtggcttgcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattag

SEQ ID NO: 19103 - DNA, 308 bp, Homo sapiens
attattcaccagacctgcctccagacatctacttctttcaaaaattagtgttttccatcaaggagcatgttccagagcatttcccagagatgtcccaaagaacactgtccggtgctgtggcgtacagtggcaacagcattagactaagtggaacatcccagcaggctgctttagaatccgctcatttgactagatacgatgtaattggctgtctttaaaaaacgcgcacacacacacaatctgataggcatatctcatgcccattcaatatggaatgttcttcgcttgctgaatttaagcctgtattt

SEQ ID NO: 19104 - DNA, 315 bp, Homo sapiens
ggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggcctgaggttggaggaagctgaatggaatctgacggttgggagtggtggaaattggaaggataccaggaggtatttgggaag

SEQ ID NO: 19105 - DNA, 318 bp, Homo sapiens
agaccattcttagcccctttgatttgtgtgtgataaaaagatatttgagactttgagcaaggaagaagtaacctgaacttgtttgtagttttaaaaggtaatgttggcatatatgaagagaattgactgtaggaaagcaagagtagaaacggcaagatcagttagggtcatctaagaaaatattgcaatactcaggtgaaaaataagaaaggattttgaacttgggtgatagtaatggagataagaagaaatgcacagtcagtataaattttaaagatggacttacatgatttggcagaatgaatgtaggctttgagg

SEQ ID NO: 19106 - DNA, 324 bp, Homo sapiens
catagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctgg

SEQ ID NO: 19107 - DNA, 336 bp, Homo sapiens
taagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtg

SEQ ID NO: 19108 - DNA, 330 bp, Homo sapiens
gaatggaagaataataagagccaaaatcattgacattgaaagcaggaaacagtagagaaaatcagtgaaataaagagatttttccctctaaaagatttataaaatggacagacctccaacatgactgacaaagaaaaggaaagaataaacagattattgatattagacataaaactaaaacagggaatatcaatagagacactattgatatggaaaggataataagagaacactgtgaacaactctacatacataaatttgacagtgtaaaagacattggttaattctctgaaaaacacaaactatcacaattcacccaatatgaaatgg

SEQ ID NO: 19109 - DNA, 183 bp, Homo sapiens
gtgttcatttcactgaggaccttatcttccttatatttcagaacaaagaagcaacaagcgtgaataaaaagacaaatgtatttgactccctcataatccccatctgtatgtgctacccttccttcaaatatataaatgtgcatctttttttttaaaaaaaaaaaaaaaaaagaaaaaaaaaaa

SEQ ID NO: 19110 - DNA, 337 bp, Homo sapiens
ggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaagg

SEQ ID NO: 19111 - DNA, 292 bp, Homo sapiens
ttcagaattaaagggatgctttatatgttaggtattttgtacgtttgttctggtttgtccagttgcagagagaaatacacaaatatgtcaacattgcttaaatgctaagcagttatggggaacattttgtaagaacagatacaatattggttaaattccatgagggggttgagtgagaactaaggaaatttgaaattcgagcttgaaatctccatttggatgtagaattgatatctcaaatttgaaatgctctaaactgaattcatgattgccccacccccaaaaaaaaaaa

SEQ ID NO: 19112 - DNA, 346 bp, Homo sapiens
gcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggggctctctaaatacgtgcagattctgcgataatgtgtggacttttgtactgaatgatgttgaattcagagaggtgacagaacttattaaagtggataaagtgaaaattgtagcctgtgatggtaaaaatactg

SEQ ID NO: 19113 - DNA, 360 bp, Homo sapiens
aagagatcatttgtatattatttatcacactgttgtaatgatgttttgagatacttttataacaaaattaacatcaaaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccgaaaaaaaaa

SEQ ID NO: 19114 - DNA, 304 bp, Homo sapiens
ctggcagtctttcagtgactggattactaagtatatttcaagtcacacactagaattctccaagggtacgacttcattctcatagttgtaactaaggaactactacacatctcctgcgattttctgatttatgttcagatttactcccagccatcactggaacaggacagtcttaatgatagtaggaaaaatgtgagttgcattatttagcattctcaataaacgtaactgaattattaatcatagagacactgaatgccagagaaactttgaataattaattatcaagcattatatgacttag

SEQ ID NO: 19115 - DNA, 290 bp, Homo sapiens
gtcaaagactgaatgaccattaagatcattcagtatcaggaacaacagaagcatatctgctgtcatcacgcctatttaatattataccagatgttttaaagaaagtaaaactatctctgtttgcagatgacataatcatgtatcctagggaatccactaaaaatcagttagaactagtaagtgagttcagtgaggttacaggatataagatcaatataaaaaaacaaattgtatttctatcactatcagtgggcgatctgaaaacaaactataaaaaatcatgtataatg

SEQ ID NO: 19116 - DNA, 304 bp, Homo sapiens
ggaattcgaaatggctggcggtaaggctagaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggat

SEQ ID NO: 19117 - DNA, 300 bp, Homo sapiens
tgtcgtggtcatgtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagc

SEQ ID NO: 19118 - DNA, 140 bp, Homo sapiens
  misc_feature 17, 33, 63, 67, 94, 125, 134: n = A,T,C or G
tatcaacgaaacttgtnagatcacgaggacctnggacaaaaagtgcacacactcaggcagcantttntaccgggaggataagaaagaatccatntgtaaagaacagccttcaagggcctttctgnagtttttangagcgc

SEQ ID NO: 19119 - DNA, 300 bp, Homo sapiens
  misc_feature 78, 90, 137, 142, 161, 166, 181, 296: n = A,T,C or G
tcaggtgattatcctgaaccatccaggccaaataagcgccggctatgccactgtattggattgccacacggctcacantgcatgcaagcntgctgagctgaaggaaaagattgatcgccgttctggtaaaaagctgnaaganggccctaaattcttgaagnctggngatgctgccattgtngacatggtcctggcaagcccatgtgtgttgagagcttctcagactatccacctttgggtcgctttgctgttcgtgatatgagacagacagttgcggagggtgtcatcaaagcagnggac

SEQ ID NO: 19120 - DNA, 330 bp, Homo sapiens
acaacactttctcggcctatccggaatgccccgacgttactcggactaccccgatgcatacaccacatgaaatatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggttcaagccaaccccatggcctccatgactttttc

SEQ ID NO: 19121 - DNA, 300 bp, Homo sapiens
  misc_feature 32, 214: n = A,T,C or G
actggtttttaacagtcttgatttgtcatttngatgctttgaatactataaggaaaatgccacgaataccatataaataccacaccaatctgttgaacatatctgtgttttctgacatgggacctgcagaatagtatttcttttaaatcctgcaactttattatctagtagaattccaagtaggctgcttagacacatattcagtgaagattgnattgcgtgtgatattatcctatctttaataaagtcctactactgaaaaacagggatttgcaatgaaaatcatagctaaatagggca

SEQ ID NO: 19122 - DNA, 249 bp, Homo sapiens
tcttaattggaaaggaaaaagagaagttaacaaatactctcctcatcgctgttcacttttggaaaatattagccaggtgaaaaatgagccactgccagaaaacagaggtaacatcttgatgttaattgagggtcaggccaggcgtggtgctcacgcctgtaatcccagcacattgagagctgaggcaggtggatcacttgaggtcgggaggttcagaccagcctggccaacatggtgaagccccatctc

SEQ ID NO: 19123 - DNA, 210 bp, Homo sapiens
agaaagcactctccagaggttccatgtttctcgcacagcagagttcttggaagagcctgtggagtcagaatcccagggacgggcgtgagagtttggggaaaggctttctaagtgattttgatgaactattcggttacgaatcacagctctaaaaattgcacaactctaaaagttccaggatggctgttctcacctccagaatgaaaaaaa

SEQ ID NO: 19124 - DNA, 206 bp, Homo sapiens
  misc_feature 9, 16: n = A,T,C or G
aaaaagtanaactgangagtaaacccaagagataggttttttagaagtataaaattggctggcatggccaggcggggtggctcatgcctgtaatcctagcactttgggaggctgaggccggcggatcacgaggtcaggaggtcgaaaccatcctggctagcatggtgaaaccccttctctactaaaaatacagaaaaaaaaaaaaa

SEQ ID NO: 19125 - DNA, 478 bp, Homo sapiens
catgttgacacacttgagagtgcctgttctgtttggaaacctggaaactatgaagggaagtggccttcgagcttaacacataagacttgggaggcaaaaccttttattctctttaaatattcactttaggataagcatttttttaggtgttaggaacagggaaaactgtgtggttaggaaggaagaaagaagaaagttaactgttgtacattccctaggtaatgtttttaagcattgttattcactttcaaaacacattttatttatttggcttaatattttgatcttattttttcaatttcttttaatttaacagacaggatgagttttttataggtgtattacttagaaattatactaaaaatggccgagtgtgtggctctcacctgtaatcccagcactttgggaggccaagcaggtggatcacttggacacttggaggtgggagtcaaagaccagcctggccaacatagcaaac

SEQ ID NO: 19126 - DNA, 104 bp, Homo sapiens
  misc_feature 18, 19: n = A,T,C or G
agctggtggcaagtgaanntgcctgtaacaagccagattttttaaaatttatattgtaaatattgtgtgtgtgtgtgtgtgtatatatatatatatatgcacag

SEQ ID NO: 19127 - DNA, 211 bp, Homo sapiens
  misc_feature 90: n = A,T,C or G
aaacgacaacaatactgctagctttcaggatgatttttaaaaaatagattcaaatgtgttatcctctctctgaaacgcttcctataactngagtttataggggaagaaaaagctattgtttacaattatatcaccattaaggcaactgctacaccctgctttgtattctgggctaagattcattaaaaactagctgctctaaaaaaaaaaa

SEQ ID NO: 19128 - DNA, 186 bp, Homo sapiens
caagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttcctaaaaaaaaaa

SEQ ID NO: 19129 - DNA, 200 bp, Homo sapiens
  misc_feature 19, 39, 48, 62, 97, 105, 107, 164, 174, 189: n = A,T,C or G
cgctgatcgaaaacttgcnccagggagagaacccttgcntatgttganttccactgcctctnctcatacagaagcgatgttggaaccgttcttttgntggctgantnatggttttttaaggataaacaaaagtttttattacatctgaaagaaggaaagtaaanggacaagttnaataaaaagggcctnccctttagaat

SEQ ID NO: 19130 - DNA, 300 bp, Homo sapiens
  misc_feature 23, 25, 38, 142, 189: n = A,T,C or G
aaagggcacgatatggtatgatncnatttataagaaanatccagaataggtaaatccatagagacagaatgcagatcagctgttgccaggggctacggggagtgaagaactgggagaatctgcttaatggcgaaggggtttntactttggagagatggaaatgtgctggaactagatagaagtggtggntgtgtaacaccacggaatgtacaaaatgtcacagaagagtcaccttaaaatggttaattatatgttgtttcactgcaataaattattcttattttttaaggttgaacgcct

SEQ ID NO: 19131 - DNA, 462 bp, Homo sapiens
aaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggtcacacctgtaaaagaaaaaagaatcaaattgaatatatcttttaagaattcaaaactagtgtattcacttaccctagtcattataaaaaatatctagcattgtggatataaaactgtgggtattctacaacttcaatggaaattattacaagcagattaatccctcttttgtggacacaagtacaatctaaaaggtatattggaaaacatggaatattaaaattttacactttactagctaaacataacacaagcttatggtgtggataaaaaaataaca

SEQ ID NO: 19132 - DNA, 300 bp, Homo sapiens
  misc_feature 164: n = A,T,C or G
cgtgtcctctaagagaagtttctatctccccttggcaaaacaaaatactattcttgaaaacagaagttataataattaatgatatcattcagtgtgtaacattagaaactatgaagtttaaaagagtcagaggttagttttcctgtagaagaaatagtatgtcnctctaaacagaagagaaattactggaaattctctctcctgcagttaccctaaaaaccagctccagcaaagccatttcacgaacaattatgcatctataatgatctaaataataattggagaaaaatagtattttat

SEQ ID NO: 19133 - DNA, 360 bp, Homo sapiens
acccgataaaagtcctttgtattactccaccgtggtgatgaatgggagatctgaccatttatacctcatataaggagaagagcatctttctcgtggcccacaggaaagatcctacaggaatggatcctgatgatatttgcagctgcctccagtcttaaaaggtttgatgacaaatacaccttgaagctgaccttcatcagtgggagaacaaagcagcagcgggaagccgagttcacgaagccattgctaagttttttgaccacagtgggacactggcatggatgcatatgagcctgaaatatccagctccatgacagcttgccatagaaagaaaaataagtagccaatctaaaagaggcc

SEQ ID NO: 19134 - DNA, 300 bp, Homo sapiens
tcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatatataataatgaaatgactaagttatgtgaggaaaaaaacagaagacattgctaaaagagttaaaagcattgctctggagaattaggagggatggggcaggggactgttaggatgcattataaactgaaaagcctttttaaaattt

SEQ ID NO: 19135 - DNA, 280 bp, Homo sapiens
tgcacttttatcctcataaaaacttactttggagctgcttggattttggcatcttttagaatacaacttgctaagggttttgactccctttttgaaatattgactattctgcatagctaatagtttacagttctgtggcctcagtccctactttaggaatttctgtttattacatataaaattttggaaaagtaacccttgcaagacctaagataatgtttttgtgtataatctttaagtgaagaatgctttttaaagcatgacccagaagccataagag

SEQ ID NO: 19136 - DNA, 300 bp, Homo sapiens
  misc_feature 27, 153, 158, 189, 231: n = A,T,C or G
gctacagagcaggagttgccgcagccncaggctgagacagggtctggaacagaatctgacagtgatgaatcagtaccagagcttgaagaacaggattccacccaggcaaccacacaacaagcccagctggcggcagcagctgaaatcgatgangaccnggcagtaaagcaaaacagagcggagtgaaangaaggcacggaaggctatgccaaactgggtcttcggcagggntacaggaagttactagagtcactatccggaaatctaagaatatcctctttgcatcacaaaaccagatgc

SEQ ID NO: 19137 - DNA, 110 bp, Homo sapiens
tttttaaaacagacatcctgctttaacaatttgtaagatgactgtgcagtaataaaagtcctttgtatttctccaccgtgttttcattaaagaaaaatggagcttgtggg

SEQ ID NO: 19138 - DNA, 358 bp, Homo sapiens
ggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatt

SEQ ID NO: 19139 - DNA, 470 bp, Homo sapiens
  misc_feature 248: n = A,T,C or G
aatggaaggtgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcggtatggtgcggaatntaattcagaaagatagaacctttgctgtatcttgcatacagcaatgtacaggaaagggaagcacagtttgtaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttccc

SEQ ID NO: 19140 - DNA, 257 bp, Homo sapiens
  misc_feature 39, 182: n = A,T,C or G
gagaagagtttaaaaatctgccacctgcacaggtatttntgaaagcaaaataaggttttcttttttcccctttcttgtaataaatgataaaattccgagtctttctcactgcctttgtttagaagagagtagctcgcctcactggctacactggtgccgaatttacttgtattcctaactgntttggatatgctgcattgagacttacggcaagaaggcattttttttttaaaggaaacaaactctcaaatcatgaa

SEQ ID NO: 19141 - DNA, 199 bp, Homo sapiens
ccagcctgggagatgaagcaagaccctttctttataaaaagtttaaaaatttgctgggcatggttgggtgcacctatagtccagctacttggaggctgagatgggaggctcccttgagcccaagaatttgaggctgcagtgagctatgattatactactgcactccaacctgggtgacagagcaagacccagtctccaa

SEQ ID NO: 19142 - DNA, 300 bp, Homo sapiens
tgcataatgaattaactagaaataactttgcaaggagagccaaagctaagacccccgaaaccagacgagctacctaagaacagctaaaagggcacacccgtctatgtagcaaaatagtgggaagatttataggtagaggcgacaaacctaccgagcctggtgatagctggttgccaagatagaatcttagttcaactttaaatttgcccacagaaccctctaaatccccttgtaaatttaactgttagtccaaagaggaacagctctttggacactaggaaaaaaccttgtagagagagt

SEQ ID NO: 19143 - DNA, 177 bp, Homo sapiens
cctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacatgagc

SEQ ID NO: 19144 - DNA, 258 bp, Homo sapiens
  misc_feature 20, 168: n = A,T,C or G
ataaaagggaagggattgancccactccctattactggatacggatcagagaaaatacggtacatgtccccatggaggatatggcttgggcttggaacgattcttaacgtggattctgaataggtatcacatccgagacgtgtgcttataccctcgatttgccagcgntgcacgccataaccattttctccagaagcggggaggaaagattatgaaaggaacaggctctttaaaaaagaaaacaaaaagcagaatctt

SEQ ID NO: 19145 - DNA, 418 bp, Homo sapiens
atgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggcatacatttgtggtctgactccttggggtcctttccccggagtacctattgtagataacactatgggtggggcactcctttcttgcactattccacag

SEQ ID NO: 19146 - DNA, 304 bp, Homo sapiens
cctctgcgctatgtggacattgccatcccatgcaacaacaagggagctcactcagcgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacagg

SEQ ID NO: 19147 - DNA, 442 bp, Homo sapiens
aaaacataaagacattttaactttgggttctctttagctgggatctggccagagggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaaatgtcctctatctgctattaaaga

SEQ ID NO: 19148 - DNA, 276 bp, Homo sapiens
ccaccctgcacctggtgttgcgcctgcgaggtggcattattgagccttctctccgccagcttgccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactgt

SEQ ID NO: 19149 - DNA, 287 bp, Homo sapiens
atgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaatttttcaaatgttggaaggcgtgtgg

SEQ ID NO: 19150 - DNA, 356 bp, Homo sapiens
ggatgacaattcactctccccagaggcttgttacagagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccatgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtg

SEQ ID NO: 19151 - DNA, 264 bp, Homo sapiens
cagagggagcacttccttgtcaagccctgattttggacttccagccttcagaactttgagagaataaatttctgttgttttaagccactaaatttatggtaatttcttatggcacccctaagaatgaacacaactccaaatttattttaaatgatttaagtaactttgctatcaaaatcaggagagaataatgtgggaaagcacagccacaaactcttcttacttatggacatagatccaaaatccaaaaaaaaaaaaaaaaaa

SEQ ID NO: 19152 - DNA, 309 bp, Homo sapiens
aataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttaaaaaaaaaaa

SEQ ID NO: 19153 - DNA, 218 bp, Homo sapiens
agcagtgattaacctttagcaataaacgaaagtttaactaagctatactaaccccagggttggcaatttcgtgccagccaccgcggtcacacgattaacccaagtcaatagaagccggcgtaaagagtgttttagatcaccccctccccaataaagctaaaactcacctgagttgtaaaaaactccagttgacacaaaaaaaaaaaaaaaaaaaaaaa

SEQ ID NO: 19154 - DNA, 405 bp, Homo sapiens
tactcctcttctttcataatagatggtgagtttttgtaaaatttttaatgatgtagagtaactgcaaattaaatagcacaatgaaaattagtcattaaaaaatagcagagcaggccaggcgcagtggcgcacacctgtaaccccagcactttgggaggctgacgcaggcagatcacttgaggtcaggaattcgagaccagcctgactaacacagtgaaaccccgtctctactaaatacaaaaaaattagctgggtgtggtggcgcatgcctgtaatcccagctactctggaggttgaagcaggagaatcgcttgaaccagggaggcagaggttgcagtaagctgagaccgcatcactgcactccagcctggcaacaagagtgaaacaacatccctaaaaaaaaaa

SEQ ID NO: 19155 - DNA, 252 bp, Homo sapiens
aaaaatgtaaccagaatgattcttcaatagaaatgagatttggtggagtctggattgcctgttttgtatataatatatacttaagatatataataccacctcattttctgggcattatttcctaattgttgatgtttcaggcttttgataagtcattttatatatttcaaatttaactcagaataagtaaatatttatggcaaatgcagttttatgtactttcaggagaagaccatcaggaaaaaaaaaaaa

SEQ ID NO: 19156 - DNA, 351 bp, Homo sapiens
taaacttagaaaccactggaatgtttaagaacttaacatttattatatttaaaacttagtatagggtttttaatatttttctcaggaggtttacttgttagaagcaatgtgtttaaaatagaatatagtaaatttataaatgcagtttagtatagtaagtcctcctttgacatcatcaataggtttgtggaagttgcaccttttaagcaaaatgatgtgtaaagaaaccaattttaccataagctaattgatgtaaacaagagttaggttcctaccatatatttctggtcacaaaaacattagcaaacttgtaagtaaagacctaaaatacttccattattaaacattgaa

SEQ ID NO: 19157 - DNA, 144 bp, Homo sapiens
caaagaggaacagctctttggacactaggaaaaaaccttgtagagagagtaaaaaatttaacacccatagtaggcctaaaagcagccaccaattaagaaagcgttcaagctcaacacccactacctaaaaaaaaaaaaaaaaaa

SEQ ID NO: 19158 - DNA, 120 bp, Homo sapiens
  misc_feature 14, 23: n = A,T,C or G
gcaagcagaaagcnagtaacttngctctgttagaggtggaggattttcctatggttccccccatttcctgatttgtatttttagatggattaaatagtctcctgtttttaaaaaaaaaaa

SEQ ID NO: 19159 - DNA, 307 bp, Homo sapiens
gccgagaaataatgaatgcattgaaaatagcattgttggaatttattcccttctgttttaaaggaggtattttggaaattgaaaaacttaatttacaagtgctggtacatcttttttcttttgtggaccacaggaaggaagatttattttgatattgatactttaaaaggactttatatttgtaacattgatgttaaccagtttattagtttaaatcagtactttgcatataataagcattcaacaaaaatttattgactgaaatgaattttaaatgcatgtgtatgaacttgtttttcttaatctt

SEQ ID NO: 19160 - DNA, 300 bp, Homo sapiens
  misc_feature 157, 186, 194: n = A,T,C or G
agcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgnttgacaaagctacctatgataaactctgnaaggaagntccaactataaacttataaccccagctggggctctgagagactgaagattcgaggctcctggccagggcagcccttcaggagctccttagtaaaggacttatcaaa

SEQ ID NO: 19161 - DNA, 316 bp, Homo sapiens
gaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatgg

SEQ ID NO: 19162 - DNA, 300 bp, Homo sapiens
  misc_feature 54, 251, 275, 277: n = A,T,C or G
gagaagcccactatctcatttaatctttacaactctcttgcaaggttccctggntgtgaaaatacatgagataaatcatgaaggccactatcatcctccttctgcttgcacaagtttcctgggctggaccgtttcaacagagaggcttatttgactttatgctagaagatgaggcttctggggtaggcccagaagttcctgatgaccgcgacttcgagccctccctaggcccagtgtgccccttccgctgncaatgccatcttcgagtggccagngntctgatttgggctggcaaaggcc

SEQ ID NO: 19163 - DNA, 226 bp, Homo sapiens
agataaatgaggcatgttttttgtaggctctttcaaccgcaatgcttattaaatttatgtactttgcactaactcgaatgaataattgtttattttttgaggttacttaatataagctacagtagagtcaggtcttgccaaaattttctcactgctttacgccacctaatttgaaattaggactatatgaaatcattcattgaaaaatgcgattccttccaacctc

SEQ ID NO: 19164 - DNA, 300 bp, Homo sapiens
atgatgacagcaaagtgaagaccttgtacagaatgtgttaaatttcttgtacaaaattgtttatttgccttttctttgtttgtaacttatctgtaaaaggtttctccctactgtcaaaaaaatatgcatgtatagtaattaggacttcattcctccatgttttcttcccttatcttactgcattgcctaaaaccttattttagaaaattgatcaagtaacatgttgcatgtggcttactctggatatatctaagcccttctgcacatctaaacttagatggagttggcaaatgagggaac

SEQ ID NO: 19165 - DNA, 220 bp, Homo sapiens
ggtatgtaaaaagtacctaatagaaaatatagtctgtaatatgtcctcagttgatatacaataaagttaaaagcatacactatagaaccattagatctggttgtgaattactgctctgctacttaatgactgaataatcttggcaagttacttctctgtgaatcagttttattacacataaaatggaaataatattacccatcttatatagttgtaatgg

SEQ ID NO: 19166 - DNA, 233 bp, Homo sapiens
  misc_feature 95, 113, 131, 163, 167, 185, 200: n = A,T,C or G
attcatattttccatcttattcccaattaaaagtatgcagattatttgcccaaagttgtcctcttcttcagattcagcatttgttctttgccagnctcattttcatcttcttncatggaccacagaagctntgtttcttgggcaagcagaaaaattaaattgnaccnattttgtatatgtgaganggttaaataaattgngaaaaaaatgaaataaagcatgtttggtttccc

SEQ ID NO: 19167 - DNA, 201 bp, Homo sapiens
ggaaaccacccttcaactggaagatatcattaaacagaggataagagatcaggcttgggatgatgtagtacgtaaagaaaaacctaaagaggatgcatatgaatataaaaagcgtttaaccttagaccatgagaagagtaaattgagccttgctgaaatttatgaacaggagtacatcaaactcaaccggcttaaaaaaaa

SEQ ID NO: 19168 - DNA, 389 bp, Homo sapiens
gatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacatag

SEQ ID NO: 19169 - DNA, 300 bp, Homo sapiens
taccagcttccttcagcagcgcaggcggtggtccctgaggcccgtggaaggagtcaaacttgcgggaattttgcagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggagccaaagcaaaaggaacttttagagaaaggctgattcaatc

SEQ ID NO: 19170 - DNA, 234 bp, Homo sapiens
taaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgttttattttgg

SEQ ID NO: 19171 - DNA, 375 bp, Homo sapiens
ttcaacagcatctctgctgttgacaatggctctctggccaacacgcctcatctgagggagcttcacttggacaacaacaagcttaccagagtacctggtgggctggcagagcataagtacatccaggttgctaccttcataacaacaatatctctgtagttggatcaagtgacttctgcccacctggacacaacaccaaaaaggcttcttattcgggtgtgggtcttttcagcaacccggtccagtactgggagatacagccatccaccttcagatgtgtctacgtgcgctctgccattcaactcggaaactataagtaattctcaagaaagccctcatttttataacctggcaaaatcttgtaatgtcattgct

SEQ ID NO: 19172 - DNA, 300 bp, Homo sapiens
ccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttaagatataagctgcta

SEQ ID NO: 19173 - DNA, 300 bp, Homo sapiens
  misc_feature 223: n = A,T,C or G
ataaagaacaactatgcaaatctgtgttttcttttctttcctcctagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattggtgggtataattnacctctcattagaaaggctaacaaattttaagtgccacaggtttaaggattctgcagaaaaaaaagaaaaaagcctt

SEQ ID NO: 19174 - DNA, 210 bp, Homo sapiens
acattaggcttaaaaacagatgcaattcccggacgtctaaaccaaaccactttcaccgctacacgaccgggggtatactacggtcaatgctctgaaatctgtggagcaaaccacagtttcatacccatcgtcctagaattaattcccctaaaaatctttgaaatagggccgtatttaccctatagcaccccctctaccccctctagagcc

SEQ ID NO: 19175 - DNA, 370 bp, Homo sapiens
ggatccaaatgttcagaaatgggatgtaacagtattagaactcagctatcacaaacgtcatttggatagaccagtgttcttacggctttgggaaacattggacaggtacatggtaaagcataaatcgcacttgagattctgaattatttggctcctccatttctggaaattgagactcaagctttatgaatttatcaagaacttaaaaatgaagaaggtcacagattgatcttttataagaccttatttgatgctttgtgcttcaaggagatgatacctgtcatccatataagcaaactttttggcttacaactatttttttaatattagccttctagtctgtaatggaaattgtatattttgatagaag

SEQ ID NO: 19176 - DNA, 382 bp, Homo sapiens
tgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaatgaaaaaaaaaaaaaaaaaaaaaaaaaaaaaaaa

SEQ ID NO: 19177 - DNA, 401 bp, Homo sapiens
atgctttacttttacaaagcacaccttatcttttagttgaagaaatggtggcactatttctttttttgcactaagcaactgcacatttcaaaaggattattgagatgttatgaaaatctctaccttgcacaaaaaaaaacccagcagcttttaaaattcatcatttccacaactgaattgatttccgtttctacagacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatg

SEQ ID NO: 19178 - DNA, 245 bp, Homo sapiens
gcatgtgggttccatataggtgcagaaatttcctcagccactggagggatttcgaccatatttgtcatttggatgagttgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctggtttacaggaaa

SEQ ID NO: 19179 - DNA, 331 bp, Homo sapiens
aatttttggggggtaggtaaccattaattttgcctcagtaaaataaatggcctttatgtataagctaagacttgtacaaaagtagattaatgtccttcacctgtgactctacaacaccaattcattcactttggtttttcagccagacatctggccattttagtgatttattgacttaactgattaatttggtaggggaggttaatactattgtgccttcagatatagccttaagtttctgtcaccaagaggtgatggcaatctaacctgttggcctcaggatgtgctttgccttccctggattcctcagactcctatttttatatcagat

SEQ ID NO: 19180 - DNA, 342 bp, Homo sapiens
aaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataattgaatgagcacccattccaaagctttattaccagtggcgttgttgcatgtttgaaatgaggctgtttaaagtggcaatctcagatgcagtttggagagcagatctttctccttgaatatctttcgataaacaacaag

SEQ ID NO: 19181 - DNA, 274 bp, Homo sapiens
aaacttataaaggcactttttatttttcctgtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggcaaaaaaaaaaa

SEQ ID NO: 19182 - DNA, 345 bp, Homo sapiens
atttgtgaaccatctccctagcatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctg

SEQ ID NO: 19183 - DNA, 133 bp, Homo sapiens
ttaactaagctatactaaccccagggttggtcaatttcgtgccagccaccgcggtcacacgattaacccaagtcaatagaagccggcgtaaagagtgttttagatcaccccctccccaaaataaaaaaaaaaa

SEQ ID NO: 19184 - DNA, 164 bp, Homo sapiens
aagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggc

SEQ ID NO: 19185 - DNA, 350 bp, Homo sapiens
  misc_feature 35, 128, 160, 215, 249, 336, 341: n = A,T,C or G
caacagcaaaacatccacaactctgtaaagctggngggacctaatgtcaccttaattctgacttgactggaagcattttaaagaaatcttggtgcttttctacaaattcccgctatttgccttgctgntacttttctaagtaagattcaaacttgctggngacttaataatgcaagtgcgataatattctggaggcatgggaacaacagccagangggagggggcctctagggctgaactaccatctgngggggctctgggtcaagcgctgtggatcaaggcacattgaccatggaggaggggttaagaagggccaggcgaagggaaactggagancgacnttatgctgt

SEQ ID NO: 19186 - DNA, 300 bp, Homo sapiens
  misc_feature 179, 203, 257, 274: n = A,T,C or G
gaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggntgagatgaagcttcttcatggagnaaaaaatgtatttaaaagaaaattgagagaaaggactcaggagccccgaattantaccaatagaagggcantgcttttaggataaaatgaagggggc

SEQ ID NO: 19187 - DNA, 300 bp, Homo sapiens
  misc_feature 54, 107, 114, 116, 161, 213, 233, 257, 290, 293: n = A,T,C or G
ataagaacttatttgtggataagaatatgaagtatattccaacagaagatgttncaggtctgtcactggaagaacaattgaggaggttgcaagaaggacgaacttgnaaagtgngnatggcaaagaagtttctgttggatttattccttggggcatctggnagtatgccaggaatgtgccccttctctaagaaaatgccctatttgcaggggnataatcaagggactggtcgnacattctctcttaaagaaaaaagnctatattttaacctgataaaagggctttaaaanatngtggaca

SEQ ID NO: 19188 - DNA, 300 bp, Homo sapiens
  misc_feature 74, 96, 101, 124, 159, 184, 226, 263, 295: n = A,T,C or G
gaaagatagagattaatacaactacttaaaaaatatagtcaataggttactaagatattgcttagcgttaagtntttaacgtaattttaatagctnaagantttaagagaaaatatgaagactnagaagagtagcatgaggaaggaaaagataaaaggnttctaaaacatgacggaggtgagangaagcttcttcatggagtaaaaaatgtatttaaaagaaaatngagagaaaggactacagagctccgaattaataccaanagaagggcaatgcttttagattaaaatgaggngactt

SEQ ID NO: 19189 - DNA, 300 bp, Homo sapiens
  misc_feature 183, 232, 293, 298: n = A,T,C or G
aggaggctgtcttaaaacattttaaactcagagaactctaagagcttgttgaatcccactctcttcttttcatgtgaaagtagttggatgctgagaagataagggacttgcccaatgtcccattgctgtttaatggcaaatttgggatgaggcttctaaattttggcactgagagctctttgnaagtgtaaaaaatgacttcagaattatcaaaaatgaaattatgttcagngaagctttattgattttggttgttagaggatatgtatttgggtgaatttttccttaaattnggggncc

SEQ ID NO: 19190 - DNA, 300 bp, Homo sapiens
  misc_feature 68, 187, 266, 280: n = A,T,C or G
cttagctgtgctcgcgctactctctctttctggctggaggctatccagcgtactccaaagattcaggnttactcacgtcatccagcagagaatggaaagtcaaatttcctgaattgctatgtgctgggtttcatccatccgacattgaaggtgacttactgaagaatggagagagaattgaaaaagnggagcattcagacttgctttcagcaaggactggctttctatctcttggactacactgaattcaccccactgaaaaagangagtatgcctgcgngggaccatgtgactttgcac

SEQ ID NO: 19191 - DNA, 299 bp, Homo sapiens
  misc_feature 19, 33, 40, 84, 113, 147, 253, 276, 290: n = A,T,C or G
tgcccacggaccctctaantccccttggaaatntaactgntaggccaaagaggacagctctttggcactaggaaaaaaccttgnagagagagtaaaaaattaacacccatagnagggcctaaaagcagccaccaattaagaaagcgntcaagctcaacacccactacctaaaaaatcccaaacatataactgactcctcacacccaattggccaatctatcaccctatagaaggaactaatggtaggataagnaacatggaaacattctcctccgnataagcctgggcangattaagaa

SEQ ID NO: 19192 - DNA, 300 bp, Homo sapiens
  misc_feature 9, 53, 78, 151, 164, 167, 247: n = A,T,C or G
cctgtgagngaccacagttatgaccaaatgccatggaaaagtgtgagattgcngcagaggttacactcctcaaggagngtggcctgagacccagctattcatagggaggctgaaccaaggaggattgcttgagctcaggagttgaggctgngggccccaagggngtngctagggagttgtgaggtggtatggctggctttttaatatcccagccattggctattggtcaggtctttctcagaattcngaaccagcccgcactttggggcccctgggcaagggggaatttctgctgctgcg

SEQ ID NO: 19193 - DNA, 300 bp, Homo sapiens
  misc_feature 33: n = A,T,C or G
accaaagtcccacagcgagccctggagctgganaagaacagagccatagaaactgctcctctcagcttccgaaccctggtaggactgcttggaatcgaagctgctctggaaagcctgataaaatcgctttgtgcagaggagaacaactagttccaaaacagtgaacgtggaggatgaagatgctgcgtggaggaacatgcaattttattcaatataaacatttgctattttctgcttagaaaccacaccctgaagacgtgctgctatgcagtatggcacattatatggaaactctcatga

SEQ ID NO: 19194 - DNA, 300 bp, Homo sapiens
aattaaaaaaatatataccatgtacttacaaagtaaaaaaattaaaaagtaaaatttaaaaaaggatattcacttgcagataattcttcattatcactaaggtagaactgttttccttggtgacttttactactttgtttaagcatatcactgaaggccaggaattttgaaattcatcaaaatcttgttgagtgcctattaaaataatcttaaaatagtccaagtgatacaatatttgtagggaagggacaccttaaaaagaatacaaatgcaatttataagacaagaaaagggaaagga

SEQ ID NO: 19195 - DNA, 200 bp, Homo sapiens
  misc_feature 76, 111, 112, 150, 190: n = A,T,C or G
aactgcacatacacattgcttgtattaaaaggcagattgtagcacatccatggagcctcatggactcagagctgangcggacacctggagcacacctgcgtaatgcgcggnngggccagtcacaaggaattgtgttgctaagccaaaagngggaagctgactgggatttaccaaaaaaaattctgtaatncaaaccaaaa

SEQ ID NO: 19196 - DNA, 182 bp, Homo sapiens
tcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaaaaaa

SEQ ID NO: 19197 - DNA, 300 bp, Homo sapiens
atcatgcactgcataacattttagtcgatgacagactgcacataagatggtagtctcataatattataacaccattatctttactgtaccttttgcatgtgtagatacacaaatacttaccactgtatatacaattgtctatagtaggtcgggtgcagtggctcatgcctgtaattccagcactttgggaggtgaggtgggcagatcacttgaggtcaggagtttgcgaccagcctgccaacatggtgaaaccccatctctgctaaaaatacaaaaactagctgggtgtgattgcagggt

SEQ ID NO: 19198 - DNA, 350 bp, Homo sapiens
  misc_feature 36, 174, 292, 332: n = A,T,C or G
taatggcacagctgcccacccacatgctcatgctgnttcagaagttttggaaaagtctggaagcacctcatgtggagctcaactcaaccacagttcttatgggaatggtatttcttcagcaaaccatgaagacttggtggaaggtcagattcataaacttcgctaaaacttcgnaaaaagctaaaggcagaaaagaagaaattagctgctcttatgtcttccccgcaaagcagaacagttcggaagtgaaaatctagaacaggtgccccaggatgggtctccaaatgattgngaatcaatagaggacttggttaaatgagctaccatatccnattgaaattggcaatgaa

SEQ ID NO: 19199 - DNA, 298 bp, Homo sapiens
  misc_feature 167: n = A,T,C or G
agggtgtattccttttatattgctgagaaaactagttaaatgatcagattcttgctgttaagaaacaatttcgtttaatgggatctgtacaactgattttaaaaaaatgctacaaaaagccccaaagcatataatctctactccttacagtctctagaattaaatgnactcatttagacaacatattaaatgcatattttaagccactttagagaaacctcataggcacagagtttccaagattaattttaagaatatcttcacgaacttgcccttctactccacattgcacaaaaaa

SEQ ID NO: 19200 - DNA, 145 bp, Homo sapiens
agagttagcacgaagattggaattgggccaattaggggaaaggggtaggctgcaaggtaaagatgaggtctgaaccacagtggtggcaatgcaagggaaatagaaaaagatggatgcaaaaaaaaaaaaaaaaaaaaaaaaaaaa

SEQ ID NO: 19201 - DNA, 300 bp, Homo sapiens
gaagaataatttattgtagagctttttgaaacaatctgacaatttatattgcaattaattgtacttatgccatctgaccaaacaatgtaactcctaggctttttgcctatatgactaaaatcatatgcacaatagtggttattacattctttagcccagtagccattaaattccttgtgcccttaaaacctaaaagttcacagggagaagacctcttactgacttgtagaatctcaatactacttatcttgaaatttcagtaagtgttaggtaaaagagttcatttgggataatcacact

SEQ ID NO: 19202 - DNA, 300 bp, Homo sapiens
ttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaattactattgtatacaagcttaattgttaatattccctaaacacaattttatgaagggagaagacattggttgttgacaataacagtac

SEQ ID NO: 19203 - DNA, 200 bp, Homo sapiens
  misc_feature 25, 128: n = A,T,C or G
aaccattcaaaatacaagtactggntgaacctgaccacttcaaggttgcagtgaatgatgctcacttgttgcagtacaatcatcgggttaaaaaactcaatgaaatcagcaaactgggaatttctggngacatagacctcaccagtgcttcatataccatgatataatctgaaaggggcaggattaaaaaaaaaaaagaa

SEQ ID NO: 19204 - DNA, 180 bp, Homo sapiens
  misc_feature 42, 157: n = A,T,C or G
aagtcattattcctgggcttggtaagtgaatttatgagattnactgctctagaaagtatagatggccaaaggaccgttttgtattgcttcctgattaccagtctgattataccatgtgtgctaatatactttttttgttatagattgtcttaatggnaggtcaagtaataaaaagagatg

SEQ ID NO: 19205 - DNA, 350 bp, Homo sapiens
  misc_feature 215, 256, 260, 287: n = A,T,C or G
acctgcaggaaacaagtgtcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattgggtgaaaacatgaatccagatggcatggttgctcnattggactaccgtgaggatggtgtgaccccatatatgattntctntaaggatggttagaaatggaaaaatgntaacaaatgtggcaattattttgggatctatcacctgtcatcataactggcttctgcttgcat

SEQ ID NO: 19206 - DNA, 300 bp, Homo sapiens
  misc_feature 2, 218, 255: n = A,T,C or G
anaataaggctggagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgntgtcctaatgctcaaaatcaagggacctctgaagggnacttggtaaatgtaagacatctggcatcatttgcagcactgtaac

SEQ ID NO: 19207 - DNA, 300 bp, Homo sapiens
  misc_feature 8, 167, 197, 282, 286: n = A,T,C or G
taaacttngcaaaatgcctagatattatcctactgaagatgtgcctcgaaagctgttgagccacggcaaaaaacccttcagtcagcaccgtgagaaaacttgcgagccagcattacccccgggaccattctgatcatcctcactggacgccacaggggcaagagggnggttttcctgaagcagctggctagtggctnattacttgtgactggacctctggtcctcaatcgagtcctctacgaagaacacaccagaaatttgcattgccacttcaaccaaaancganatcagcaatgtaaa

SEQ ID NO: 19208 - DNA, 429 bp, Homo sapiens
tttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatggga

SEQ ID NO: 19209 - DNA, 300 bp, Homo sapiens
ccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagcaactaatgaagaaatgaataataaattttgacactgaaaaacattttattaataaagaa

SEQ ID NO: 19210 - DNA, 300 bp, Homo sapiens
attgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagtcaaggatctagaagacgattaagggaag

SEQ ID NO: 19211 - DNA, 300 bp, Homo sapiens
  misc_feature 247, 255: n = A,T,C or G
atagactgggggctgaaaaacaacagaaatgtatttccttcagttctggaggctgaaagtccaccatcagggtgccaatacgggcaggttctggtgagggctctctaaggggttgcagactgagtcttcccattgggtaagggagctccctggggcctcttccataagggcactaatcccattcatgagagctctagccttctgacctaatcaccttccaaaggctctacctcctagtattgcactntgggaggncaaggatttcaacatacaaattttgggggatcacaaatattcaga

SEQ ID NO: 19212 - DNA, 142 bp, Homo sapiens
gtattttctgacttttatggaggcagatatctctaagtggcccctcctggtgctggggtatgatcaaaagggacttctgtaagttttcaccggactgctttaattttctatcagaacagtgtatttagtacttgattaagtt

SEQ ID NO: 19213 - DNA, 265 bp, Homo sapiens
tcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgtccaagacattgcaataaaagcatttaagttgaatgcgg

SEQ ID NO: 19214 - DNA, 300 bp, Homo sapiens
  misc_feature 295: n = A,T,C or G
gcctttcattatggaattgttaaagactttagcagaacaccagcagttaataccactagtagaaaaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaataggccagcctgcttgctttaatgcatggattcataaacttcttccctacctgcatcatgtgcatgtagggnatatt

SEQ ID NO: 19215 - DNA, 263 bp, Homo sapiens
atgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggtgcaaagaattgatatttagatggtttttaatactcagcagattgcttcctttatattg

SEQ ID NO: 19216 - DNA, 528 bp, Homo sapiens
  misc_feature 33: n = A,T,C or G
ccctactgctgctacacaagaccctgagactgntctgcaggacgaaaccatgaagagcctgatccttcttgccatcctggccgcttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctcttttttttctggaggctgcacctgattttgtatccccctgtagcagcattactgaaatacataggcttatatacaatgctctttcctgatattctctggctggctgcaccccttttccggccccagatggataagtaatgaaag

SEQ ID NO: 19217 - DNA, 382 bp, Homo sapiens
  misc_feature 332, 335: n = A,T,C or G
gaaagaagctgaaaatgtaaaaccacaccagggaggaaaaatgacattcagaaccagcaaacactgaatttctcttgttgttttaactctgccacaagaatgcaatttcgttaacggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggnggncttccactttcattgaaaatgccatatctataccatatttatttgag

SEQ ID NO: 19218 - DNA, 312 bp, Homo sapiens
  misc_feature 36, 55, 59, 71, 101, 124, 136, 140, 213, 221, 242: n = A,T,C or G
gatccttggaagagtattcccagttgaagctgaaanttacagcacagtgcagctntggntcatattcaggnatctcaggagaacttcagaagagcttgagnaggccaaatgttgaagttaagtnttccaataatgngacntcttaaaagttttattaaaggggaggggcaaatattggcaattagttggcagtggcctgttacggttgggatnggtggggngggtttaggtaattgtttagnttatgattgcagataaactcatgccagagacttaaagcttagaatggaaaaagtaaagaaatatcaactt

SEQ ID NO: 19219 - DNA, 430 bp, Homo sapiens
  misc_feature 70: n = A,T,C or G
cacaaaggaaaaagatttgtcttggtcagaacatctttttgctcctaaagagataccatactctgaagantttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgtcattctgacaggctggtgggaactcaagtcccctactgagctgatgaaaagtaaggagcgcagtgatgtggagcatgaacagcaagttactgaatccccttccttggctcagttcctactgcagacgagtaatttgattccacat

SEQ ID NO: 19220 - DNA, 444 bp, Homo sapiens
  misc_feature 44, 71: n = A,T,C or G
taagatttcctttggcaatatcatattctaaaagttttaaattncaatacaagttacatacatttaaaagncattttacagattttatggtactaatgaaatttacagtgatagaacaaaagaggattagtagaaaatacattattagaatataaaaaatgttattactgaggaaagggaggagaggacaagtgtaataaatcaaaattgacctcaaaagaaaatgtgtaacagagttgaggttgttaaaacagaaaaggttctgaataatgaagattaacctaatgcagaattgctaggtaaagaggtcaggggaatgctaagccagttcttaagacttctctgtcctctgctttgctgttatccttaaggcatatactttgtctttctgcagaaaattctacctggctacaattactttgaacattaatgcaaaaaaaaaaa

SEQ ID NO: 19221 - DNA, 398 bp, Homo sapiens
  misc_feature 225, 311, 336, 342: n = A,T,C or G
caagtgaaatgaaattgccaggtcaaaggactgaatgctttaatatctattaaatttgtttcagaggccatctgttaaaataaaatattttattattttatagtttttcaacaaatatatttgagacttaggaatgtgatatctctcagaattagtgaaagccattcctttacctaccggctccaagtaatcctattggctccaaggatcataggaaaaatattnaatagaaaacttcttttccattttaactatcatgctgccatgacataggctgagcatctttgcaaagtaaggaaatgcattttttncccctgaaatcacatacctatatgnctcttngatcttagggaatgaaacaaatggaaaataattgggcctcatgtctaaatatggaa

SEQ ID NO: 19222 - DNA, 342 bp, Homo sapiens
  misc_feature 40, 258, 260, 267, 292: n = A,T,C or G
tcttttatctcatatggcacaagtagagggggaagccatnaggaaattcatcaccttgctatgcttttattggatttttaattcctgagtgcctaaatgtggtgaccggcacctcacataactttttgagattcttgatgtcatttttatccttcctgtcaaccagcaatgtatttttatgttactaaaaccagtaacgtcataattgttgagggcaagcttcattgttgatagtgcaaagtgtcgctgttgtgatgngngttattntattcaagtttgaatattgacaagngtaacttaagctgggactgacacctgtggactgctgggggcaaatgatag

SEQ ID NO: 19223 - DNA, 437 bp, Homo sapiens
  misc_feature 37, 38, 275, 416: n = A,T,C or G
ctgacagcattcgggccgagatgtctcgctccgtggnnttagctgtgctcgcgctactctctctttctggctggaggctatccagcgtactccaaagattcaggtttactcacgtcatccagcagagaatggaaagtcaaatttcccgaattgctatgtgtctgggtttcatccatccgacattgaagttgacttactgaagaatggagagagaattgaaaaagtggagcattcagacttgtctttcagcaaggactggtctttctatctcttgnactacactgaattcacccccactgaaaaagatgagtatgcctgccgggtgaaccatgtgactttgcacagcccaagatagttaagtgggatcgagacatgtaagcagcatcatggaggtttgaagatgccgcatttggatnggatgaatccaaattctgctg

SEQ ID NO: 19224 - DNA, 502 bp, Homo sapiens
  misc_feature 43: n = A,T,C or G
aagaagcatcctctgccaagaccaaaaggaaagaagaaaattngccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgccaaaagacgttttctttggaccaaagatctctttcgtgattccttgcaacaatcaatgagaatcttcatgtattctggagaacaccattcctgatttcccacaaactgcactacatcagtataactgcatttctaggttctatataggcaataggagcatagatctataaattcttacttgctaagacaagtaaatctgggtaaacaag

SEQ ID NO: 19225 - DNA, 249 bp, Homo sapiens
  misc_feature 178, 179, 181, 218, 220: n = A,T,C or G
cttgtaaagaatggatggtccgtggaaggaacagaaacaagcacttgggcgtgggttgtgactgcttttgggggagcctggggtttgggctcccacctgtttacagacctttttttctccttcagactttaaaattttaaaaatttaaaaaggaattaaaaaaaaaaaagacttccgnngnaaagaaacctattttcagaatgcagatgcgttccttnanagctctgggacgggacagggttgttccct

SEQ ID NO: 19226 - DNA, 452 bp, Homo sapiens
ttccgggctggggacaagttcacttaaaaaggctttgttatttaacaggtcaccagttaagacttctgctttgtagatacatgcagaagccatcaaacaagggggagcttttaactgcaacaataagctaaagtatgtaaaatactacattctattcagtcttggagtgttttgtagaaagttatcttcagccaaatctttgctgaagactggttgtggagtgttggtaaatgctttgtgtttttatgtaaaatattttctaaacaaaaaatgttaaaagtacatgtcctctgtagtaaactgatatctatatatatgaatcattcaagcctaaagtctagtaataaactgtacttgtgaatagagaaaccctaaatattcatgcagaaaaaattatgcggctgtaagaaaaatgagtaatttgggtttggacttgaaataacagggtctgt

SEQ ID NO: 19227 - DNA, 150 bp, Homo sapiens
  misc_feature 55, 96: n = A,T,C or G
agtgggatgattaaataaagaaaaaaaaatacggacacacacacacacatacacncatatatacacacacatgcatatatatcacattatatatgnatatatattacatttatatatatacaaacacacacaataagatactattcagca

SEQ ID NO: 19228 - DNA, 474 bp, Homo sapiens
  misc_feature 15, 283, 376, 403, 433: n = A,T,C or G
ttcaaattccctttntttgaagccatatgttggtttgcacgccaaaaacttgctggaaaccctgaaaggtaattaataatttgcatgtttgtatatgatatgatgcatattgtttgtaaattcactcatagccacctgacagaaagagtcccttttctagtagtgtatggatgtcactcctattttgttttttaaataagtggttttcccccatccagcaacctttttagcaagttagagtctttagtccataacctgacaatccatgttcttaaaaatttgntatgaaagacctggatcaagaacaacgtaggtaatattagaaatgttcattccatctagtcctctagaagcctgcatacatcatcaagcacgnaacaggcctgactctcaaaaatgcagnttatgcaagagactggtacctattatatgntcccaaaatttgctttaaaaaaagcaactaggctggcacag

SEQ ID NO: 19229 - DNA, 376 bp, Homo sapiens
gtcagagatgtcaagagaaaaagcagcccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatg

SEQ ID NO: 19230 - DNA, 387 bp, Homo sapiens
ttaatgagtgacagtcaaaattgattcgtggaaaatctaggggcctatgtacacaattatttttttttaattgacatagaatttgtataccatgaaattcacccccttaacgtatacaacttcatggtttttagtttatccacaaagttgtgtgaccatcaccactaggtaattccagaacattttcctcacccccgagaagtaccccacagacattagtagttaccacccccctatctctgtcaaccacttgtcaatctctgtggatttgcctattaaggatgatttagtttttaaatagataacttggattgtagggggatattaataaaaacagggaattaagatgggatttagtactgcataatgggccaggaaaaaaaaaaa

SEQ ID NO: 19231 - DNA, 310 bp, Homo sapiens
ggaaaagataaaaggttcctaaaacatgacggaggttgagatgaagcttcttcatggagtaaaaaatgtatttaaaagaaaattgagagaaaggactacagagccccgaattaataccaatagaaggcaatgcttttagattaaaatgaaggtgacttaaacagcttaaaggttagtttaaaaggtgtagggtgattaaaataatttgaggcgatcttttaaaaagagattaaaccgaggtgattaaaggccttgaaatccatgacgcagggagaatgcgcatttaagcctagttaccgcatttctaaac

SEQ ID NO: 19232 - DNA, 380 bp, Homo sapiens
  misc_feature 217, 220: n = A,T,C or G
aatcattttactggggcaagaaaaacatctcattcctttgtcgtgaatatccttgctcaggctctttatgaattattttctgccacagatggtaagtgtaggacactttttagtgaatattactcaattgcagatttttagcgtaggaaaggaataaacaagttagtgatttgccagaaataaaaatgttacctgagtttgctaactcccaagttgnagntttttaaaattccattttgagcaatagttgtaggtttagttttagtttggaaggaaggggaattccttagacacattaatagcatgcctcagtaacatattcattatttggaatcctctgggcagactagatcatgcttgtcctcacacacacaagactg

SEQ ID NO: 19233 - DNA, 508 bp, Homo sapiens
  misc_feature 16, 350: n = A,T,C or G
gacaagatgttttctntttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatggcggaggttgagatgaagcttcttcatggagtaaaaaatgtatttaaaagaaaattgagagaaaggctacagagccccgaattaataccaatagaagggcaatgcttttagattaaaatgaaggtgacttaaacagcttaaagtttagtttaaaagtggnaggtgattaaaataatttgaggcgatctttaaaaagagattaaaccgaggggattaaaagaccttgaaatccatgacgcagggagaattgcgcatttaaagcctagttaacgcattactaacgcagacgaaaatgggaaggattaattgggaggggga

SEQ ID NO: 19234 - DNA, 440 bp, Homo sapiens
aatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagcagatctttctccttgaatatctttcgataaacaacaaggtggtgtgatcttaatatatttgaaaaaaacttcattctcgtgagcatttaaatgtgacaatgtacacactggacttagagttctggtttgat

SEQ ID NO: 19235 - DNA, 180 bp, Homo sapiens
catacacatccattcttcaccagatctatagggtagcacctcctgtgcagtgtctactggcaacacactcagattgtttctgatcaaaattttgaatacatctgtttgaaattgtccatttttacaaaaaaaaattttaattgctatataattcatctatcttaaatctgctatgagaaa

SEQ ID NO: 19236 - DNA, 229 bp, Homo sapiens
ttcaccactggctctttcattcattcagcaaatagttattgtatataaaacaagaaccaggcactgtgctgggcactaagctagaatacagagaaaaggagcattcccagctgggtgtggtggcttacgcctgtagtcccagtgctttgggaggtcaaagcaggaggatcacttgaggctaggagtttgagaccagcctgggcaacatggtgagaccccatctctacca

SEQ ID NO: 19237 - DNA, 180 bp, Homo sapiens
attaaaaatacaaaaattagctggcatgagggcaggccgcctgtaatcccagctactcaggaggctgaggcaggagaatccctggaatccaggaggcggaggttgcagtgagccgagatcgcacccactgcactccagcttgggcaacatagcgagattccatctcaaaaaaaaaaaaaa

SEQ ID NO: 19238 - DNA, 327 bp, Homo sapiens
gactatcaaaaacacagatatcgccaaggagctctgccttcctcccgtgaaactgcactgctccatgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctg

SEQ ID NO: 19239 - DNA, 260 bp, Homo sapiens
tgcgtacatccacagggtcactaacgggggcaagggaaaaaagggttgctcattttgggtatcactggagtctgatggaaagagataggcgcatctctggagttgatcgttactatgtgtcaaagggtttggagaacattgattaaggaagcattttcctgattgatgaaaaaaaataactcagttatggccatctacccctgctagaaggttacagtgtattatgtaagcatgcaatgtgttatgtaagtgcttaatat

SEQ ID NO: 19240 - DNA, 410 bp, Homo sapiens
cttgctatattcaccaaaaggacttacttcttggtttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatattacaggccaaatgactaaacattgccttgctatattcaccaaaaggacttaattcttgtcttttcccagttttatatagaggaaacactatgatagggatttcctaaagtatttggggccagttaaatgctaattatatacat

SEQ ID NO: 19241 - DNA, 314 bp, Homo sapiens
acacagagcaagacgaagatgaagaaatggatgtgggaacagatgaagaagaagaaacagcaaaggaatctacagctgaaaaagatgaattgtaaattatactctcaccatttggatcctgtgtggagagggaatgtgaaatttacatcatttctttttgggagagacttgctttgtatgccccctaatccccttctcccctgcactgtaaaatgtgggattatgggtcacaggaaaaagtgggtttttttaggtgaattttttttaacattcctcatgaatgtaaatttgtactatttaactgctatcttgat

SEQ ID NO: 19242 - DNA, 302 bp, Homo sapiens
gtgataacatttaacataattgaggtgtataaaataaatttttcaccttatgcatttaatttttggtggatgaccagtaattgctttcttattgaagttaaatttttgttatttctattcttgagaaaattttatgggctagaggagttaactgttaaataacagttttgaaaagcttgttattaattttagcaaagcccaagggaaatagttcagaactgaaacatgtagtccaagtgatgaatgaaaaaccaaaagtttttattttcaaatttaaaaatcaaagtatataagacctcttg

SEQ ID NO: 19243 - DNA, 302 bp, Homo sapiens
attgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttt

SEQ ID NO: 19244 - DNA, 246 bp, Homo sapiens
ccacagaatgaacctttgaggcctgtaaagtggattgtaatttcctataagctgtaatagtggaggtattgtgggttcatttgagtaagccctccaaagataccatccaaataacctgggagaatgtcataaattattcagataattatcactgcatgaatctgattcagaggcatgcatttacatatgttgccctaattaccatttgatgatcataaatacaagtgaatgacattggacttttag

SEQ ID NO: 19245 - DNA, 345 bp, Homo sapiens
tatttaacaaagaaaatcttcaacacttaatatgtaaaatgaacagtgcaaattgtttttaagtcttggtcttgaaaaatactgtagatggcttaaccatatgcttggctgggcatggtggctcacgcctgtaatcccagcgcttatgaaaggctgaggcgggaggatcgcttgagcccaggagttgggaccagcccgggcaacatagggaaaccttgtctctacaaaaatcaaagaaactagccgggcaaggtggtacatgcctgttttctcagttacttgggaggctgaggcaggaggatcatttgcacgcaggaggttgaggctgcaatgagccatgattgc

SEQ ID NO: 19246 - DNA, 172 bp, Homo sapiens
aaaaaagggttcaataaattgcttatacctatgaagagatgcaaaagaaccttcaaaataaagcaaaggacttgaagaaagagaaggaagacatgaagaagaggatgtcatttaggtgaaggtgatggatacagaatctgagtctgaggggagcctggttgacagagagaca

SEQ ID NO: 19247 - DNA, 336 bp, Homo sapiens
cctggaattgagaagggcaatgatacagggaaaagatccttgtctttggaaatgaccaaccaaaaggagaagctaaatatcaagtaagaacatctgatgaacaaagtcgtggcaaaccctaaggacaccagcttcctggaggctcgaattattcccttgaccaaagcccacaattatgaagaacacagcagaaacactgaaataacaaaacccacaaatactattggtgatgggcactgccagaggaaaaagatgctcaaaaaccttcgttagaccaatatgatgtctctgagaagacacactggggactgagcacatctttttgatggagcagcc

SEQ ID NO: 19248 - DNA, 316 bp, Homo sapiens
aatattgcaaaccatactacactaaacattgtcgtgcatacttccttgtgtattacattggtttttaaatcaatgaactagttgtaaacatggagagaaacaacaaggagggagatggatataagagaagaagagattaaaggggatggaatcagttgtttctggagcacagaatattcaccaaatttgaccagatgcgcggtgctcatttaggaaagagcaactgcactgggacgaagaggttttttaggaaatcagaggtcttcagagaagttttggttaaaatctgcagtatacactaccaaaatggtttttg

SEQ ID NO: 19249 - DNA, 315 bp, Homo sapiens
atctgtttgaaaattactataaaacggtgttttctgatcggtttttgtttcctgcttaccatatgattgtaaattgttttatgtattaatcagttaatgctaattatttttgctgatgtcatatgttaaagagctataaattccaacaaccaactggtgtgtaaaaataatttaaaatttcctttactgaaaggtatttcccatttttgtggggaaaagaagccaaatttattactttgtgttggggtttttaaaatattaagaaatgtctaagttattgtttgcaaaacaataaatatgattttaaattcttaa

SEQ ID NO: 19250 - DNA, 449 bp, Homo sapiens
acaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgacaacgaaggccgcgcctgcctttcccatctgtctatctatctggctggcagggaaggaaagaacttgcatgttggtgaaggaagaagtg

SEQ ID NO: 19251 - DNA, 324 bp, Homo sapiens
agattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgta

SEQ ID NO: 19252 - DNA, 421 bp, Homo sapiens
cgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatccagatttgtgtaagaattgtcatcatgtaatagccagacatgagtatacattcagtatcatggatgaatttcaggagtataccatgctgtgtctgttatgcggcaaagccgaagatctatcagtattctccctgacgacccccgacaaatgactctcttattctaaggatccttctacagatctgttataactatattgtgttggtttacaatacagcaagcctgatggtttgtcttattccaaaaaaaaaaaa

SEQ ID NO: 19253 - DNA, 400 bp, Homo sapiens
gaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgcgcgaacagcttct

SEQ ID NO: 19254 - DNA, 446 bp, Homo sapiens
  misc_feature 373: n = A,T,C or G
ctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgtctgggcagaccttatccaaagctggtacaactgtccttagactgatgagcaaaggaggagncaactaatgaagaaatgaataataaattttgacactgaaaaacatttaattaataaagaatattgacatgagt

SEQ ID NO: 19255 - DNA, 224 bp, Homo sapiens
tgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatga

SEQ ID NO: 19256 - DNA, 260 bp, Homo sapiens
caggctatgaaatcatcctgtgagttatttcctccataataaccctgcatttcccattaatctacatatcttcccacagcagctttgctcagtgatacccacatgggaaaaatcccaggggatgttgcttactctttttgcccacactgctttggatacttatctactgtccgaaggccttctttccccactcaattcttcctgccctgttattaattaagatatcttcagcttgtagtcagacacaatcagaatcacag

SEQ ID NO: 19257 - DNA, 438 bp, Homo sapiens
  misc_feature 409: n = A,T,C or G
agagagagcacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaagggggacagccaaacagaagctttattcgagaacaggtgaatcagttgaatttgtgtgtaaacggggatatcgnctttcatcacgttctcacacattgcgaac

SEQ ID NO: 19258 - DNA, 197 bp, Homo sapiens
  misc_feature 30, 49, 62: n = A,T,C or G
acctaccgagcctggtgataagctggttgnccaagatagaatcttagtncaactttaaattngcccacagaaccctctaaatccccttgtaaatttaactgttagtccaaagaggaacagctctttggacactaggaaaaaaccttgtagagagagtaaaaaatttaacacccatagtaggcctaaaagcagccacc

SEQ ID NO: 19259 - DNA, 179 bp, Homo sapiens
  misc_feature 40, 41, 42, 54, 59, 66, 83, 106, 120: n = A,T,C or G
taaaaagcagagtgcctctcctcctccaaaggaacgcagnnnctcaacacgcancagancaaagcnggacagacaatgacttngacgagctgagagaagagggctncagacgatcaaatnactccaagctacgggaggcattcaaaccaaaggcaaagaagttgaaaactttgaaaaaa

SEQ ID NO: 19260 - DNA, 295 bp, Homo sapiens
  misc_feature 24, 79: n = A,T,C or G
aacaagatagaaaatgaaaatatngtcaagagtttcagatagaaaatgaaaaacaagctaagacaagtattggagaagnatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttaccgtagaccagaaccaatttagaagaatacttgaagtatagaagatagaaaaatataaagc

SEQ ID NO: 19261 - DNA, 468 bp, Homo sapiens
  misc_feature 42, 48, 437: n = A,T,C or G
ataaaaaagcgtccaggggcctttcttcagccctgaggagtnctcttnacgtggagcccagcctcgggggttccatggccccctgctaacccttcactcgtgacaggagcaagccggcttccgagatgactcagagacagccacaaatcatgttcatggattccctgcattaaagtacagatgtatctctcccctggactttaagatactttagaataaaagttgcaaagtgacagtcagccaactgactccaagcctccggtatgctcttgtcggcagggagatattttacattaatttgaatttaaaatttaaaattagaaaagatcacattaggctgggtgcagtggctcacacctgtaatcccagcactttgggaggctgaggtggcaggatcacttgagggtaggagttcaagaccaggctggcaacatggngaaaccctgctctactaaaaatacaaaaatt

SEQ ID NO: 19262 - DNA, 300 bp, Homo sapiens
  misc_feature 146, 211, 291: n = A,T,C or G
atatccagcaaaataagagaaggttccagatgccaaatgataagccaccatcaacccagaggggaagccttctggttggtttggctgtatgagattcaggaaggccagaatacccaaaattattcacacgacgttaacttattggnactggctaagcaatacatgtatttcctaaaggaggagatggcttttggtgatttatggcacactngttcatctgactgtaaatatattgcatgctttattctgatgggcactatttcatccagcaagcttttcatctgagaatgntaaatggtg

SEQ ID NO: 19263 - DNA, 300 bp, Homo sapiens
  misc_feature 29, 241: n = A,T,C or G
tagaagatagaaaaatataaagccaaaanttggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggtaaaaatcacatcaaaaagctctaaaaggctgggnaatttaaaaaaaactaaggcagaaggcttttggaagagtagaagaatttggaaggcctt

SEQ ID NO: 19264 - DNA, 350 bp, Homo sapiens
  misc_feature 16, 216, 231, 236, 245, 247, 283: n = A,T,C or G
caactagcagggctgnactaaataatagcaaaatgaagtttttcagacagaagggaaacgatatcagaaggaatagtggcacatcaagaatgaagaagaggaacagaaatagcagatttatctgggaatataatacactcttgagttctccagtatatattttatggttcaaagcatatttaagattactggaacttaaaggggggatggtaaagnaacctatatggtggnagggnttcttccgngnaatatattttgcattggaaaaatgttgattctaagnaagctctgaaaagataattattggaattcctggacaatcacttaaaaagctataccaagtaatatag

SEQ ID NO: 19265 - DNA, 300 bp, Homo sapiens
  misc_feature 32, 160, 249, 280: n = A,T,C or G
cacttgccatctctgtctaggggtcacaaatngaaatggctcctgtatcacatacggaggtcttgtgtatctgtggcaacagggagtttccttattcactctttatttgctgctgtttaagttgcaacctcccctcccaataaaaattcacttacacctnctgcctttgtagttctggtattcactttagcatgttgctgccagaatacaagcattgcttttggcaaattaaagtgcatgtcatttctnaatacactagaaaggggaaataaattaaagnacacaagtccaagctaaaac

SEQ ID NO: 19266 - DNA, 292 bp, Homo sapiens
  misc_feature 71, 109, 188, 233, 262, 285: n = A,T,C or G
tagtctttttatccctcacttcctcccagccttcctcaccgacttcccagagtccactgtatcattcttgngcctcttgtgaccttgagcaactattcatttctagttnaccatttaacttgtcctttcgtcccctcttccttcttaatcaagctttttatgagtttcatgcatatagtacatatagngatgaataaagacagacattgtccctgcctttatggagttatggnctggtgggaggacagacatttaacaagtnataaaagctgggaaaaatgcagngaagaaa

SEQ ID NO: 19267 - DNA, 183 bp, Homo sapiens
  misc_feature 17, 21: n = A,T,C or G
tctctgccatgaagccnattnggtagcagaagctgaaggcagagatacaaaggaaaagagagagagaacatccaccttttcttcatttggcatctgagtatttgagtgatcaggctcagcagtatggttctgaatacctcttcaggaagactgtgactccacttagtcccccaaaaaaaaaaa

SEQ ID NO: 19268 - DNA, 300 bp, Homo sapiens
aagtgtttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggttctaaaacatgacggaggttgagatgaagcttcttcatggagtaaaaaatgtatttaaaagaaaattgagagaaaggactacagagccccgaattaataccaatagaagggcaatgcttttaaga

SEQ ID NO: 19269 - DNA, 209 bp, Homo sapiens
caaaaaaagcataacttgcaaccaaaagaagaaagtgacaattctacagggataaaaaagggcacatacctcctcccgtaaaaatattccgaaaaggtgtttaattcctaggtctaaagagctattgaacaagaatcataagaggatttcgcaagctcaagtctcaagttgtcatccctgctttactttataaaaggaaaaacgtagaa

SEQ ID NO: 19270 - DNA, 371 bp, Homo sapiens
  misc_feature 55, 70: n = A,T,C or G
caaaatgtagagacacaggcgcatccaaagacacacagaggagatccgcccatcnggggcagaagccacntgcaaccacagattgctaataacacttaaaaggtaacttccacaaagctagaatttcagtgtggattggcctaagggtcagaaactcctgaggattctagtcttagggggacctttaaacttctgtgggcttgagccccaggaaccccagaaggttctcccagtgaagatgtgtgaaactcccggatggctctgctggagcaagggaagagtaatcattgtgaaatacacctagagccttctccagaacaaagaccttcctaggaccttatcctagctgggggaaagtcatttctcccact

SEQ ID NO: 19271 - DNA, 298 bp, Homo sapiens
  misc_feature 119, 135, 151, 162: n = A,T,C or G
aaaagaagccataagaagacttcctgagaacctttataatgacaggatgtttcgcattaagagggcactggacctgaacttgaagcatcagatcttgcctaaagagcagtggaccaaanatgaagaggaaaattnctaccttgaaccgtanctgaaagaggntattcgggaaagaaaagaaagagaagaatgggcaaagaagtaatcatgtagttgaagtctgtggatgcagctgttatgaagatggttaaacttgaaacaaacaattttaagaattatttggctgaagatgttccac

SEQ ID NO: 19272 - DNA, 360 bp, Homo sapiens
  misc_feature 33, 125, 146, 201, 239, 261, 308, 353: n = A,T,C or G
ctctccaaccactgtgccactgacttgctgcgngaccctgggcaagtgacgtaactataaggtgcctcagttttccttctgttaaaatggggataataatactgacctacctcaaagggcagttntgaggcatgactaatgctttntagaaagcattttgggatccttcagcacaggaattctcaagacctgagtattttntataataggaatgtccaccatgaacttgatacgtccgngtgtcccagatgctgcattagnctatatgggtctccaagaaactgaatgaatccattggagaagcgggnggataactagccagacaaaatttgagaatacataaacaacgcatngccacgg

SEQ ID NO: 19273 - DNA, 155 bp, Homo sapiens
  misc_feature 30: n = A,T,C or G
ccagattgaccatattgatgaaaaggcctntgagaatgtaactgatctgcagtggctcattctagatcacaaccttctagaaaactccaagataaaagggagagttttctctaaattgaaacaactgaagaagctgcatataaaccacaacaacc

SEQ ID NO: 19274 - DNA, 427 bp, Homo sapiens
  misc_feature 67: n = A,T,C or G
agaaacgacacaggataggagacgtcgctttgaacgtgctataggaccctctcaaacacacaccatnagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagcaactaatgaagaaatgaataataaattttgacactgaaaagcattttattaataaagaatattgacatgagt

SEQ ID NO: 19275 - DNA, 348 bp, Homo sapiens
aaaaagcaacttttccaacatacaatttacttttaataaagtatgaatatttcattttgagaacattccctggaattgccacataattcattaaaaacatttttttaagcaacacttggaacagtgtttactttaaatccttaatggccttaattaattctcagattcctgccccatcacttacagaaccaattcactttagagtgactaaaaggaaacgatagcctagctttctaaagccacgctgtgccctcaattacagagggtaggaatgggtatacctctaactgtgcaaagcagagtgaaattcaattcatagaataacaactgctgggaatatccgtgcca

SEQ ID NO: 19276 - DNA, 197 bp, Homo sapiens
  misc_feature 21, 23: n = A,T,C or G
cttcaaaacctaaagtattgngntgtgtatggtggctcatactgcaatccaagcactttcggaggattgtctgagtcccagaggttgaggctgatcatgccactgcactccagcctgggtgaaacagcaagaccctgtctcagaaaaaaacaaaacccaaaacctgaagaacttattatctgtctagccctttacag

SEQ ID NO: 19277 - DNA, 371 bp, Homo sapiens
  misc_feature 238, 292: n = A,T,C or G
aaaattttatatcaaaatctggttatcatcagtctgcttcagaacatggtcttgttgtcattgctccagataccagccctcgtaagtgtttgtggtctagatatcctttgtaaaaatctaaatctttaagactggtataaagtggtatgatatatacattatacaattcattttatatttttgctgttatctctattaacctttcaagtggcatcatgactccaaaataccatgctgnacattttcctcattgaattttactcatgacatggcctttatgaaagaggatagntttgctattcccattgtacagattaagatacttcaaagcagagattgagcactcaattcatatatcatgtggcactact

SEQ ID NO: 19278 - DNA, 160 bp, Homo sapiens
acagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagt

SEQ ID NO: 19279 - DNA, 104 bp, Homo sapiens
  misc_feature 77, 79, 82: n = A,T,C or G
aggctgaggcgggagaatagctgggacctggagggtgggggttgcagtgagccgagatcacaccactgcactccggncnggncagcggagcgagactctgtctc

SEQ ID NO: 19280 - DNA, 115 bp, Homo sapiens
  misc_feature 55, 68, 97: n = A,T,C or G
gcctaccaagactttgagaatcactacaagaaaaactccttgtggagagggttcnaagacgtggggancgattccagatgagaattcacaagcgacncattgacttgcacagcct

SEQ ID NO: 19281 - DNA, 295 bp, Homo sapiens
ctgaccagttaggagactgcttgttaaattagttcagaggagaaacagtgaaggcagtggcactgggcatgaagaagtatatgtgtgctaattttagatttcttagggaagcagaaatgacaagagttagtggtccattggacagaaatattgaaggagactggggagtctaggttgactcccagtgtttaggtttgggcagtaaaatgacatgtagaacaattaactgataaacagcatacagaaagaggaaagaacttcatttcacatgtttgtttttgaggaaaagatgctg

SEQ ID NO: 19282 - DNA, 275 bp, Homo sapiens
  misc_feature 49, 81, 82, 129, 170, 174: n = A,T,C or G
aacttactacatatctaaaacaagtatcaagtttaataaaatgaatganctgaaatgattggctgaatcaatagaaatgtnngctaaagaaactatcttttttgaggcaaatcattaatagcaatgaangagcacttagactgaaacacaataaaacccaacagaaaaanacantcaagaggtaacaaaaagctattattttgtgaatattctcaagtgaaatcactaaaatgtgaagactatcacaagatttactgtaataaattagataaacc

SEQ ID NO: 19283 - DNA, 381 bp, Homo sapiens
gaaatggaagagaactttgccgttgaagctgctaactaccaagacactattggccgctgcaggatgagattcagaatatgaaggaggaaatggctcgtcaccttcgtgaataccaagacctgctcaatgttaagatggccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcag

SEQ ID NO: 19284 - DNA, 230 bp, Homo sapiens
attttagcattaaattagttacactgtgatgactggcctattacctgactcagctccctctaccttgaaattgacatttttaaaaaatgcaactaagtggttaatagtgtgtgacgctcaaagttaatgtaaactggaaaggttgtgtgtcgttgctttttgtgttttggttaggcttggttttgttttttaatttttataccttctaataaatttgcagtttcattctt

SEQ ID NO: 19285 - DNA, 327 bp, Homo sapiens
  misc_feature 210: n = A,T,C or G
tttctggcctggaggctatccagcgactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgctttcagcaaggactggctttctatctcttgnactacactgaattcacccccactgaaaaagatgagtatgcctgccgtgtgaccatgtgactttgcacagcccaagatagttaagtgggatcgagacatgtaagcagcatcatggagg

SEQ ID NO: 19286 - DNA, 165 bp, Homo sapiens
  misc_feature 72, 73, 75, 112, 127: n = A,T,C or G
tagtaagatgagaaagacttgattttttaaaaaacaattaaaaatttacattgtttaatctaatgctgaganntngaaagtactacctttgcccttatagttacgcatgtgnatttatatgtatttncttggtcattcaaacgccaataaaatactttactatcc

SEQ ID NO: 19287 - DNA, 180 bp, Homo sapiens
  misc_feature 25, 56, 69, 77, 80, 82, 99, 101, 156: n = A,T,C or G
cgaatgctgaaagatttaatgactngcctacagatactggtagaaccaagtgaccngaagctctgtctncaatattntgngnctctgtgccatcctatncnccttatccatctttactaaccctagccctacaaccaaccaacacaactaaacccncacataaactaaaacatttaactc

SEQ ID NO: 19288 - DNA, 227 bp, Homo sapiens
  misc_feature 103, 173, 208: n = A,T,C or G
aaaacctgtgtgccattttaagaggtacttaatgtttggtaacttttatgccttcactttacaaattcaagccttagataaaagaaccgagcaattttctgcnaaaaagtccttgatttagcactatttacatacaggccatactttacaaagtatttgctgaatggggaccntttgagttgaacttattttattatttttattttgnttaatgtctgggctttctg

SEQ ID NO: 19289 - DNA, 450 bp, Homo sapiens
gataaaataataatccatacccactgcgccttaaaagtgtgacatttgaagtccacttttcttgttttcatgtgatgggtatgcaccagtaataaaataaataaataaataaaatgtgtcactgggtgaggtactgcaagttgtaactatgttaccaccatctgtagtttactgagcacctcatcaggtctcagactcagctactcaactctgccactgtgacacaaaggcagccatagacaatatgtaaacaaatgggcatgactgtgttcccataaaaccttttgttgtgaacattgaaatttaaattttatatagttttcacatgtaacaaaataatattcttttgatattctccaactcattagaaaatataaaaacccttcttagggtcacaggccatacagaaacgtatcaggaagaatttgaccctttggctatagttttcca

SEQ ID NO: 19290 - DNA, 126 bp, Homo sapiens
ctatctcttgtctacactgaattcacccccactgaaaaagatgagtatgcctgccgtgtgaccatgtgactttgcacagcccaagatagttaagtgggatcggagacatgtaagcagcatcatgga

SEQ ID NO: 19291 - DNA, 477 bp, Homo sapiens
  misc_feature 61: n = A,T,C or G
tcaaactagaactcaggattaagaaactcactcaaaaccactcaactacatggaaactgancaacctgctcctgaatgactactgggtacataacaaaatgaaggcagaaataaagatgttctttgaaaccaacgagaacaaagacacaacataccagaatctctgggacacatttaaagcaatgtgtggagggaaatttatagcactaaatacccacaagagaaagcaggaaagatctaaaattgacaccctaacatcacaattaaaagagctagagaagcaagagcaaacacattcaaaagctagcagaaggcaagaaataactaagatcagagcagaactgaaggaaatagagacacaaaaaacccttcaaaaaaatcaatgaatccaggagctggttttttgaaaagatcaacaaaattgatagaccactagcaagactaataaagaagaaaagacagaagaatcaaacagat

SEQ ID NO: 19292 - DNA, 295 bp, Homo sapiens
aataagacatcaaatgttttaagaaccaaaattttactgctgcttttctaacaccctgttgctaacctgagcccccatactcttactgtcaataacagattttcatgataaaatacaagaaacaggcctgatgcctgttaataacagattttcatcatcaaatacaacaaaacaggcagggcacgggtggctcacacctgtaatcctagcactttgggaggctgaggagggtggatcacttgaggtcaggagtttgagacaagcctggccaacatggtgaagcctcatctctact

SEQ ID NO: 19293 - DNA, 408 bp, Homo sapiens
  misc_feature 30, 31, 337: n = A,T,C or G
ctttccagagaagcaaatgctgagagactnngtcaccatcaggcttgccttacaagagctcctgaaggaagcactaaatatggcaagggaaaacggtaacagccactgcaaaaacatatgaaattgtaaacactgttgacactaagaagaaacagcatgaacaaacaggcaaaataaccagctagcatcataatgacaggatcaaatccacacataacaatattaaccttaaatataaatgggctaaatgtccctgttaagagacacagactggcaaattggataacgagtcaagacccatgagtgtgctgtattcaggagacccatctcatctgcnaagatacacataggctcaaaataaaaggatagaggaatatttaccaagcaaatggaaagcaaaaaaaagca

SEQ ID NO: 19294 - DNA, 335 bp, Homo sapiens
  misc_feature 145, 158: n = A,T,C or G
gcctggataccgcagctaggaataatggaataggaccgcggttctattttgttggttttcggaactgaggccatgattaagagggacggccgggggattcgtattgcgccgatagaggtgaaattcttggaccggcgcaagacgnaccagagcgaaancatttgccaagaatgttttcattaatcaagaacgaaagtcggaggttcgaagacgatcagataccgcgtagttccgaccataaacgatgccgaccggcgatgcggcggcgttattcccatgacccgcggcagcttccgggaaaccaaagtctttgggttccggggggagtatggtgc

SEQ ID NO: 19295 - DNA, 418 bp, Homo sapiens
  misc_feature 28, 294: n = A,T,C or G
agactgaaccaaatcaatacctgttganttttagaaacagagaaaacaattaagagcacaagaaaggaaatctctgggacacctgaggagacatttcagaggagaaagagaatcaatttccaagtaatttggaatggaagcaagtctggccgcattctttatctgggagctcctctaaaatcctcccaccaccaccagggtttgatggttaggagacttagcaacagaaagagtaaaaagagaatataagcagcgaagcctgtgcttcatctccccagggcatgccgaaatagncactcctagttcttcttcaggtgtctcctgatgcctatgggtttgatattgctattttgtcatcattgtttaatttcggatcctggtttgcaaacttgcatctttctaaagaccagtaatgatt

SEQ ID NO: 19296 - DNA, 195 bp, Homo sapiens
caggcagttgggtattgatatgttatttggtgctctcattcatggcaaaggatttgataaataaaggttctttaaacactaaagcaaaatcaaatgagcaaaactaaggatgaaatgtaatattcatcagaacaaggatcactgagaaaaaatattcagaaacaactttaataaaacctgaattgaaataactgc

SEQ ID NO: 19297 - DNA, 450 bp, Homo sapiens
  misc_feature 9, 374: n = A,T,C or G
tcggttcgnttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaactngcatgttggtgaaggaagaagtggggtggaagaagtggggtgggacgacagtgaaatctaagagtaaaaccaagct

SEQ ID NO: 19298 - DNA, 100 bp, Homo sapiens
  misc_feature 39, 97: n = A,T,C or G
gtgggagaatcgcttgaacccgggagacagaggctgcangtgagccgagatcgcgccattgcactccagcctgggcaatgagagcaaaactgtctantaa

SEQ ID NO: 19299 - DNA, 383 bp, Homo sapiens
  misc_feature 5, 377: n = A,T,C or G
tcggnatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggcaggtcaattgnacttta

SEQ ID NO: 19300 - DNA, 219 bp, Homo sapiens
  misc_feature 12, 128: n = A,T,C or G
gttgaggccatnttgaacattatagatacctatgatgcttcacacgagtgtgaactaagaattagtacattttggagtgggtgatataagtgcaaatgatgttaaccttgctgaaacatttgatgggntatatatggctttaatgtgaatgcagcaatggtatccaacagcagctgcaaaaaaaggagtaaaaattaaacttcacaaaataatttaccg

SEQ ID NO: 19301 - DNA, 452 bp, Homo sapiens
  misc_feature 41: n = A,T,C or G
gtttgatgtggagcgagataactactgccgatatgattatntggctgtgtttaatggcggggaagtcaacgatgctagaagaattggaaagtattgtggtgatagtccacctgcgccaattgtgtctgagagaaatgaacttcttattcagtttttatcagacttaagtttaactgcagatgggtttattggtcactacatattcaggccaaaaaaactgcctacaactacagaacagcctgtcaccaccacattccctgtaaccacgggtttaaaacccaccgtgccttgtgtcaacaaaagtgtagacggacggggactctggaggcaattattgttcaagtgactttgtattagccggcactgttatcacaaccatcactcgcgatgggagtttgcacgccacagtctcgatcatcaacatctacaaagagggaaatttggcgatcaca

SEQ ID NO: 19302 - DNA, 127 bp, Homo sapiens
  misc_feature 90: n = A,T,C or G
ggcatcggttaatttatatggtatgttctaagcacagctctcttctcctattttcatcctgcaagcaactcaaaatatttaaaataaagntacattggaggtattttcaaatctttgcttgataagt

SEQ ID NO: 19303 - DNA, 155 bp, Homo sapiens
tgttttctctttgaaagatagagattaatacaactacttaaaaaatatagtcaataggttactaagaatattgcttagcgttaaagtttttaacgtaattttaatagcttaagattttaagagaaaatatgaagacttagaagagtagcgtgaag

SEQ ID NO: 19304 - DNA, 373 bp, Homo sapiens
  misc_feature 304, 334: n = A,T,C or G
tcagaagactatgttaatgagctctgactgtacttacgctgcactgtcggtgttaagagaaattactctcacaagagcagaggcctgaagattctttcttctgaaagccaagcaccacaaggaaaaaaaaattattaatagctcaggttaaaaacacccatttaaacaaaaacaagagcatttgtaataggaagtgtttatacaaatagcacatttgtgatatgttgaaaagcatctctcttggcaaccaatctatgtttgaggaagattgggtaatgctgatgtgttccattcatgaaactgnatttgatacataatcctattattaattcgnatgcttagcaacctaggaaatcaaaataatgtttggaag

SEQ ID NO: 19305 - DNA, 202 bp, Homo sapiens
  misc_feature 143: n = A,T,C or G
gagatcagcctggccaacatggtgaaaccctgtctctactgagaatacaaagatagccaggcgtagtggcaggtgcctgtaatcccagctactcgggaggctgaggcgggataattgcttgaacccgggagcggaggttgcangtgagccgagattgtgccgctgcaagtccaccctgggtgacagagcaagactccacgtc

SEQ ID NO: 19306 - DNA, 351 bp, Homo sapiens
ataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaa

SEQ ID NO: 19307 - DNA, 457 bp, Homo sapiens
  misc_feature 69, 239, 347, 376: n = A,T,C or G
acaggtatggcaaagtagacaaagcatttgttcatttggagcttagagtccaggaggaatacattaganaatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagntaacattcaaaacgcagctccccaatcacactagcaacatttcaagtgcttgagagccatgcatgattagtggttaccctattgaataggtcagaagtagaatctttncatcatcacagaaagttctattggacagngctcttctagatcatcataagactacagagcacttttcaaagctcatgcatgttcatgatgtaggggccgaattttgagct

SEQ ID NO: 19308 - DNA, 265 bp, Homo sapiens
  misc_feature 21, 47, 89, 179, 200, 224, 228: n = A,T,C or G
taaacactagaagtctttagnacaaaactgctctagggacacctggngattcctacacaagtgatgtttatatttctcataaagagtcntccctatcccaaggtcttcatgatgccagtagccatatatgataaattatgttcagtgataacttagttatcagaaatcagctcagtggncttccccgcatgattcacatntgatgagtttttaaaaatcaaagngatnttgaaaatctctaatggctcagaaaataaaaacatcc

SEQ ID NO: 19309 - DNA, 202 bp, Homo sapiens
  misc_feature 161: n = A,T,C or G
gacaagggaatggatgaagaaaatgcgcatatatgggacagtggccatatattgccataaaaggaatggagttttgatacaacatggtgagacttgcagatgttatgctaagtgaaataaatagacacaaaaggacaaatatacaaatatatgttccactnacatgaaatactcaggtaagtccctacagaaagaatagcag

SEQ ID NO: 19310 - DNA, 250 bp, Homo sapiens
  misc_feature 95, 113, 116: n = A,T,C or G
cagcactttgggaggctgaggcgggcagatcacctgaggtcaggagttggagaccagcctgaccaacatggacaaaccccgtctctactaaaaanacaaaattggcagggtgnggnggcacatgcctataatcccagctacttgggaggctaaggcaggagaatcgcttgaacccgggagcggaggttgcagtgagccgagatcgcaccattgcactcctgcctggcaacaagagtgaaactccatctcc

SEQ ID NO: 19311 - DNA, 169 bp, Homo sapiens
aggatgcatgtgttaagagggaagtttgtagctgtagatgcttacattaaaaaggaagagagatcaaaatcaaaatcgacagcctggctgtgatttggttctttgaaagtatcaacaaaattgacaaaccgctagctagatgaagggagaaagaagactggaataaccc

SEQ ID NO: 19312 - DNA, 352 bp, Homo sapiens
ccaacggaagtttacttacaaacatgtggagacttacatttggtcctcaggctgcagagtgccatatgtcctctagacatattcacgtgtaacaaaataacaaaaataaaggaaagtagacaagatcaaacaatactccagagatgcaatcatcaaaatttcaccaggggaaactctggaaatacaagtccacatttttcaacaaataaattgaaaagaaaaagagggccaggcatggtggctcacggctgtaatcccgaactgctgagatcgcaggcgtgaggcaccacgctaagcctaatttagtgactaagagatatcttaaatatatataaaccttgtgtggataaac

SEQ ID NO: 19313 - DNA, 376 bp, Homo sapiens
  misc_feature 42: n = A,T,C or G
gatgcaaatgttttgaaatgatatgaccaaaattttaagtangaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcc

SEQ ID NO: 19314 - DNA, 131 bp, Homo sapiens
  misc_feature 101: n = A,T,C or G
tgaacacgctggttatctaaatgagaagcagagaaataaagccaagaaaatttacctggatgaaaagaggctcttggctggggaccatcccattgaccttntcttaagggactttaagaaaaactaccaca

SEQ ID NO: 19315 - DNA, 381 bp, Homo sapiens
  misc_feature 7, 321: n = A,T,C or G
ccagagnagcctctcagggactggccggagatctccctgctgaccgagaacgaccgccactaccacattccagtcttttaagtccgctgggggccgaacagcagtgctcaccagtgacggtggtcacagttgcaataaagtctctctctgaaaccaaagctagcatttcagcatggaaggaattaggaccttttcttcaggattacaggtacactggatgcagccatgcatggatggtttttctttatttttcagtgatttcctctgaagcagctcactgatacatttgggagttggggcttgctttgccataaggggcgngcccttcacatgatggcgggcctttaagagcacaaagaagttaatatggacaacaacagg

SEQ ID NO: 19316 - DNA, 102 bp, Homo sapiens
  misc_feature 51, 56: n = A,T,C or G
gcagagagcgatatcgcagctttcaacaagatctgaagcctgagtgtgtgnaccgngcgcgcgtgcgtgaggccctgccacgattaaagactgagaccggcg

SEQ ID NO: 19317 - DNA, 236 bp, Homo sapiens
catagttaccaccaaggataccaggatgggtaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactagataaatagcaaactttcacctg

SEQ ID NO: 19318 - DNA, 371 bp, Homo sapiens
  misc_feature 18, 220: n = A,T,C or G
acacgatgtttcccttgntcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgcagcaacacaagtcggaatagaatggaacctgtcccctgttggcagagntaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttc

SEQ ID NO: 19319 - DNA, 294 bp, Homo sapiens
  misc_feature 17, 47, 94, 110, 144, 146, 206, 211: n = A,T,C or G
tatttatcgactgtganatgacaaggaaacttacaaactgcaacggnggagaaactattaaaggtattcagaaacgtgaagccagcaattgttncgcaattcggcatttngaaaacaaatttgccgtggaaactttaatttgtncncgaacagtcaagaaaaacattattgaggaaaattaatatcacagcataaccccacccttnacatnttgtgcagtgattattttttaaagtcttctttcatgtaagtagcaaacagggctttactatcttttcatctcattaattcaat

SEQ ID NO: 19320 - DNA, 209 bp, Homo sapiens
  misc_feature 141, 207: n = A,T,C or G
aacaaaggactaaagagctgaaaccaacctagttttgtttttgtgatataaactttaagtgcgagggaccatgccagcaactaccaaaaatctcttaaatcttcaggtacagctggcattttggcagatgcatagagacanctgagaccctcagaaaggaaggataatccaagaatataggaaatctgggtctcttcctttcatttnat

SEQ ID NO: 19321 - DNA, 273 bp, Homo sapiens
  misc_feature 61, 225: n = A,T,C or G
gccagctcagatattttgagatactaaggattatctttggacatgtactgcagcttcttgnctctgttttggattactggaatacccatgggccctctcaagagtgctggacttctaggacattaagatgattgtcaagtacattaaacttttcaatcccattatgcaatcttgtttgtaaatgtaaacttctaaaaatatggtaataacattcaacctgttatnacaacttaaaaggaacttcagtgaatttggttttattttttaacaaga

SEQ ID NO: 19322 - DNA, 430 bp, Homo sapiens
  misc_feature 215: n = A,T,C or G
gtttcttggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgnactacactgaattcacccccactgaaaaagatgagtatgcctgccgtgtgaaccatgtgactttgcacagcccaagatagttaagtgggatcgagacatgtaagcagcatcatggaggttgaagatgccgcatttggattggatgaattccaaattctgcttgcttgcttttaatattgatatgcttatacacttacactttatgcacaaaatgg

SEQ ID NO: 19323 - DNA, 441 bp, Homo sapiens
ttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgcttcttattttacttcttttagctgtttaactttgtaagatgcaaagaggttggatcaagttaaatgactgtgctgcccctttcacatcaaagaactactgacaacgaaggccgcgcctgctttcccatctgtctatctatctggctggcagggaaggaaagaacttgcatgttggtgaaggaagaagtggggtggaagaagtggggtgggacgacagtgaaatctagagtaaaatcaagctggccaa

SEQ ID NO: 19324 - DNA, 140 bp, Homo sapiens
tctttgaaagatagagattaatacaactacttaaaaaatatagtcaataggttactaagatattgcttagcgttaagtttttaacgtaattttaatagcttaagattttaagagaaaatatgaagacttagaagagtagt

SEQ ID NO: 19325 - DNA, 463 bp, Homo sapiens
  misc_feature 388: n = A,T,C or G
aggggtggaaagatcatttctgtctagattagtctgttattaagcaattctcatcaaagtacaagttgaacatttctaatctgacacctgaaatgctcccaactctgcaagtttttgagtaccaacatgacaccatgaatggaaaatttcacacctgacctcatgtgatgggtcacagtcaaaagttggtttcaccaggtacagtagcttgagcctgtattaccagctactcaggaggctgaggtgggaggattgcttgagtgcaggagctgagactgcagtgcactttgatcatacctgagaatagccacagcacttcaacctgggcaatatagtgagaccctgctttacaaaacaaataaaaccaaaccaaaacaaaaaacttggntccatgcacaaaagtatttaaaatgtataaaactaccttcagctatgtgtataagggatatatgaaacataaaag

SEQ ID NO: 19326 - DNA, 385 bp, Homo sapiens
aaatcaaaaacacagaataaggaacatatttaactttttttcattataaaatggttagaggaccctaccccctctagattccctgatttccccagccctgcagcatacagtaagatgggtccctgtgccaggcctcaatactgccagggaataaaaccagagggagaggaccctcagtgtcatatcaggaagcccagtgccagaggacagacaggttcaaaactggcttttcctctgggcctgggttggtgctataggccaagggtcattttatacttgggtataaatcaatcccagtttgggaaaagattatttttaagcttaaaaggctgacatgtgccattatatgtagtatgtaatatatgtaacatcttccaattctttt

SEQ ID NO: 19327 - DNA, 601 bp, Homo sapiens
  misc_feature 43, 46, 571: n = A,T,C or G
acacacaatactacaggcaaatattcctgatgaacattgatgnttnaatcctcaacaaaatactagcaaaccaaattaaacaacacattaaaaagatcattcatcacaagcaagtgggatttttcccagggacataaggatgattccacatatgcaaatcaattaatgtgatacgttgtatcaaaagaatgaaggacaaaaactatatgatcatttcagttgatgctgaaaaaacatttgataaaattcaacatcccttcaagtcaaaactcctcaaacaactgggtatagaaggcatacctcaacataataaaagccgtatatgacagactccagctagtatcatactgaatgggaaaaaactgaaagccttcaattcagatcaacacaataaggatgaccactttcaccactgttattcaacatagtactggaagtccgagctagagcaatcagactagagaaagaagtaaaggacatccaaaattggaatggaagaagccaaattatccttatttgcagatgatatgatcttatatttggaaaaacctaggctccactaaaaaatagnaggaatgataaacaaaatcagtacaattgc

SEQ ID NO: 19328 - DNA, 156 bp, Homo sapiens
  misc_feature 88: n = A,T,C or G
gttttattacctgtgaaactgaatttggcgtttgctgcatagaaacttggaaattactcccttttttcatgacactggctgaaagganatatggttcataactgaaagtctttgccttatataaaatgtttatttttatttcaaaagcatctaatc

SEQ ID NO: 19329 - DNA, 417 bp, Homo sapiens
  misc_feature 15, 294, 380: n = A,T,C or G
actgctaggaagctncgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgagaaaaatgatgaagttctggttgctggatttggncgcaaaggtcatgctgttggtgatattcctggagtccgtttaaggttgcaaagtagccaatgtttctcttttgccctatacaaagncaagaaggaaagaccaagatcataaatattaatggtg

SEQ ID NO: 19330 - DNA, 274 bp, Homo sapiens
  misc_feature 24: n = A,T,C or G
aaaatgctgttgaaggcccacggncatgactgcacccctcactaattggtcattggtttggggaggacaccactgtcccagtggaaccttgagtacaccttggagccctcctcttcctctccggacctgtgccaaactgtgagtggcacagagcaaggactgtatgtgttctcttctttattgcatactcagttccttgaccacagtgccaagcacacagcgagcactccctgtgtatctgctgagtaaataaacgaatgaacaaacccatcac

SEQ ID NO: 19331 - DNA, 287 bp, Homo sapiens
  misc_feature 42, 130, 185: n = A,T,C or G
ggtttagcacatctgttatccgtaaaacacctgtaactagcntttttaatttattatttgaattgtaggatagcgaatcactaatttttagttgctgaggttggcattttagtgattattaagcacttcngtcagtctttgaaaaaagaacgtattttttgtgctttgaagatctctgaagaatntcttttataatagaatgggcatgtattgtaacagttttatgtcaaatgatctgtgctgtagaaaaacattaacccttgttcaaaaaagaaatggataaactt

SEQ ID NO: 19332 - DNA, 165 bp, Homo sapiens
  misc_feature 68: n = A,T,C or G
agtaagatggcatttcatttcaactcagaagccaacatttaaaacagaggttggataaaatttttttnctctttgctttgaagaaacaaaatagtaatgagtaaactctaataactataccatatatcaatatttgattaagaaaaaaggccgagtatcaaccac

SEQ ID NO: 19333 - DNA, 120 bp, Homo sapiens
ctcacttctgggtttatatacaaggaattgaaaacaggccccatggagatatgtgcacacccatttgcattgcagcattatttccagtagctaagagggggaaacaacctaaatgttaat

SEQ ID NO: 19334 - DNA, 364 bp, Homo sapiens
  misc_feature 330: n = A,T,C or G
ctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtaggctttacgtgtggctacaacaaattttactaagctttttcattgtctttccatgaaacgaagttgagaaaatgattttcccttgcaggttgccacagtttngttatgcatttccttaaaataaatggagactcca

SEQ ID NO: 19335 - DNA, 414 bp, Homo sapiens
  misc_feature 34, 62, 124: n = A,T,C or G
gcaccaaagcagcagctgtattgccgcagttctngcttcaccttcacgatgtttcccttggncaaaagcgcactaaatcgtctccaagttcgaagcattcagcaaacaatggcaaggcagagcnaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttc

SEQ ID NO: 19336 - DNA, 168 bp, Homo sapiens
tactaaaaatacaaaaaattagccaggcgtggaggagggcgcctataatcccagctactcaggaggctgaggcgggagaattgcttgcacctgggaggcagaggtttcagtgagccaagatcacaccacggcacttcaacctgggtaacatgagtgaaactttgtctc

SEQ ID NO: 19337 - DNA, 450 bp, Homo sapiens
  misc_feature 385, 397: n = A,T,C or G
ttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggacatactgaaaaccctataaggcctggataatttttgnttgattattcantgaagaaacatttattttccaattgtgtgaagtttttgactggtaataaaaga

SEQ ID NO: 19338 - DNA, 130 bp, Homo sapiens
  misc_feature 5: n = A,T,C or G
agaanagtgatgtgttcgacgttttatcaaaggccccctttctatgttcatgttagttttgctccttctgtgtttttttctgaaccatatccatgttgctgacttttccaaataaaggttttcactcctc

SEQ ID NO: 19339 - DNA, 283 bp, Homo sapiens
  misc_feature 207: n = A,T,C or G
caaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttangggcttgtttgttgacatgacaaattaacattcttatagttacatctgggaaatgagcatttgaaatagataatcc

SEQ ID NO: 19340 - DNA, 352 bp, Homo sapiens
tactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgcacagcccaagatagttaagtggggatcgagacatgtaagcagcatcatggaggtttgaagatgc

SEQ ID NO: 19341 - DNA, 285 bp, Homo sapiens
  misc_feature 31: n = A,T,C or G
ttgactggtcccttacctcttatggctaagnctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacaagtgtcatttgaaaacg

SEQ ID NO: 19342 - DNA, 303 bp, Homo sapiens
  misc_feature 53: n = A,T,C or G
ctatccagcggactccaaagattcaggtttactcacgtcatccagcagagaanggaaagtcaaatttcctgaattgctatgtgtctgggtttcatccatccgacattgaagttgacttactgaagaatggagagagaattgaaaaagtggagcattcagacttgctttcagcaaggactggctttctatctcttgtactacactgaattcacccccactgaaaaagatgagtatgcctgccgtgtgaccatgtgactttgcacagcccaagataggtaagtgggatcgagacatgtaagcagc

SEQ ID NO: 19343 - DNA, 338 bp, Homo sapiens
atttttaagtcaaatttttcacttaattatgtcttatggaggtattgccaaataaacaaatatggatatatgatagatatcctttctgatgtctgtatagtgttttatatagatataaaaaagttaacaaatcctcttctaatgcatattcagattacttccacatgtgcactcctataaaccaaggtacaatgaacatcattgtacaaacctctttgccctcctgtgtgttcagctcctgaggatatatatgtatattcaagtacatatatatgtacttgaatatgcaaataaaaatctggaagagagtaaggctgaatattatcagtaatcataac

SEQ ID NO: 19344 - DNA, 417 bp, Homo sapiens
  misc_feature 402: n = A,T,C or G
ggaacttataggcattcatacatttttataattttgagactgagagtcatcttaaaaattattaatccaattcccttattttacatatctgaaaattaagttgcaacagagttgaggtttatagaagcagaatgagggcctaagtcttacttttaacccagcattctaattctttctatgccatattccctaatccattataaaaatatgcttatatgtttacagtaatgtatatggcaaaagaacaggtttaaatgttttatttatactgctatcttgagagctttattgtctaagcttttaaaaccttctaaagactgccttattaggaatggggagggatgaagaaactttagttcggtgatctgagtggtagtcgatagaggcctagactagaatggnaattgtagaaatggc

SEQ ID NO: 19345 - DNA, 434 bp, Homo sapiens
  misc_feature 399: n = A,T,C or G
catggctaactgcaagaattaaatcttctatctgagagtaataatttatgatgactcagtggtgccagagtaaagtttctaaaataacattcctctcacttgtaccccactaaaagtattagtctacacattacattgaagttaaacacaaaattatcagtgttttaagaaacatgagtccggactgtgtaagtaaaagtacaaacattatttccaccataaagtatgtattgaaatcaagttgtctctgtgacagaatacatacttattcccatttttaagcatttgcttctgttttccctacctagaatgcagatgttttcagttatctccccatttgcaaagttgcctcaagataacatttttcattaaagcatctgagactaagaacacaattantattctaacaatgatattagctcatcacttatttg

SEQ ID NO: 19346 - DNA, 348 bp, Homo sapiens
  misc_feature 42, 43, 45, 48, 132, 133, 134, 290, 337: n = A,T,C or G
acaggttctccaagcatcaccctgggagtttcctgagggttnncncanaaatgagggctgcacattgcctgttctgcttcgaagtattcaataccgctcagtattttaaatgaagtgattctaagatttggnnngggatcaataggaaagcatatgcagccaaccaagatgcaaatgttttgaaatgatatgaccaaaattttaagtaggaaagtcacccaaacacttctgctttcacttaagtgtctggcccgcaatactgtagggaacaagcatgatcttgttactgngatattttaaatatccacagtactcactttttccaaatgatcctagnaattgcctaga

SEQ ID NO: 19347 - DNA, 420 bp, Homo sapiens
  misc_feature 336: n = A,T,C or G
tctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgcacagcccaagatagttaagtgggatcgagacatgtaagcagcatcatggaggntgaagatccgcatttggattggatgaattccaaatctgcttgcttgctttttaatattgatatgttatacacttacacttatgc

SEQ ID NO: 19348 - DNA, 300 bp, Homo sapiens
tacgggacccgctatggggcctccctccggaaaatggtgaagaaaattgaaatcagccagcacgccaggtacacttgctctttctgtggcaaaaccaagatgaagagacgagctgtggggatctggcactgtggttcctgcatgaagacagtggctggcgggtgccttggacgtacaataccacttccgctgtcacggtaaagtccgcatcagaagactgaaggagttgaaagaccagtagacgctcctctactctttgagacatcactggctataataaatggggttaatttatgtaac

SEQ ID NO: 19349 - DNA, 303 bp, Homo sapiens
  misc_feature 42: n = A,T,C or G
aattgtgttgtacatttgttcttagcatatattaaagttttnaaccaaatgtgttaaagcttacgctttgcatgtaaatttcccagaagttgttgagctcaaatgtatcctacatccagctgtagaaatttgtcagaaattgtttaaattttgtatataattgtactgtttaattctagccattgcgctgaacagtatttgagttaccatataatatggctttacacaaggaaatgtgtggcttttgttttgtattttttcagtatagaagttcctgtgtcttatttaaataaagttattagt

SEQ ID NO: 19350 - DNA, 318 bp, Homo sapiens
  misc_feature 91, 276: n = A,T,C or G
ggccgagaagctgcttcagtccatctcccagaggcatttggactgtatctttgctcaactgctaatttctcttggctgtagggtgtgtggntaaggtacaaccacccctaaagctcagttttgaagtgagtgtatttatagcttctctgctggtgctgcttctagagggatgatagatcatttgaacccaatgacaatttttaaccagaaaatttaattgtacctgaatcaacctttcagcctaggacgaagttaggcccaagtcagagtattaangatcatgagaattgtgtgctgaaccagtaaacgagtttacct

SEQ ID NO: 19351 - DNA, 374 bp, Homo sapiens
  misc_feature 46, 110, 352, 369: n = A,T,C or G
ctcctctctttggttagggaagaagaaagcccttcaccattgtggnatgatgccctggctttaaggtttagctccacatcatgtttctcttgagaattctatttggtagntacaattacagaaactgattagtttgtcagtttgcagatagatttagcacagtgctcatcactcggatagattgagatgttctttcacatcagatgatctgtaacactgtaagatactgatctttacaactgtttaatcagttttatttttgtacagtattagtgacctaagttattttgctgcccgtttttgtaaatcaaatgaaattataaaagaggattctgacagtagggtattttgnacatatgaatatatgtngtccc

SEQ ID NO: 19352 - DNA, 232 bp, Homo sapiens
  misc_feature 35, 54, 130, 192: n = A,T,C or G
acgtcaccaaggtggcttctccttggctgagaganggaaggcgtggtgggattngctcctggggtccctaggccctagtgagggcagaagagaaaccatcctctcccttcttacaccgtgaggccaagancccctcagaaggcaggagtgctgccctctcccatggtgcccgtgcctctgtgctgtgtatgngaaccacccatgtgagggaataaacctggcactaggtctc

SEQ ID NO: 19353 - DNA, 134 bp, Homo sapiens
tagcaataaacgaaagtttaactaagctatactaaccccagggttggtcaatttcgtgccagccaccgcggtcacacgattaacccaagtcaatagaagccggcgtaaagagtgttttagatcaccccctcccc

SEQ ID NO: 19354 - DNA, 121 bp, Homo sapiens
  misc_feature 64: n = A,T,C or G
ccagatattcataaatgtgacaaatgaacagcaggattatgaattatcaaaggaaaaagtattngctgaggtgaaaaaatctgatgtttgaggaagtttttatttttatttatttgttttg

SEQ ID NO: 19355 - DNA, 438 bp, Homo sapiens
  misc_feature 353, 407: n = A,T,C or G
atatctaaatctaacttttcataaaactttacggtctttccttcactaccttaaatatgcaagaaatactgacttggtatagggtaccttagttttctctattcattagacaggtaaaattatatttcagctgattgatctgggtgacaaaattatttcttagctataatcagcacatcacttagttcaaacaaaattccccagcaaatgttagatagtaggtatatcagtcacctggggagttttcttcataatatgcatattcatcttgtaatgcatacatagttatcatcctccttctcaacccatctccctaaccccacatgcttgccagttcttggaagggataaagngattctaataatgttttacttctctctgtcaattaaatgtgatataattctagnataaaaatatttggacaggtgcttaacatgg

SEQ ID NO: 19356 - DNA, 186 bp, Homo sapiens
  misc_feature 57, 139, 160: n = A,T,C or G
catctaggatctattcctaacaggctactccaatcccactttagttttccacaattntaaatcttaatagtgagaattcaaatgaaagtcatttcatttgactattctgatgacatgatgtggcagaataaattgggcntaaaatgccctagaaaatggnaaatgataaaaaataatattttaaaa

SEQ ID NO: 19357 - DNA, 178 bp, Homo sapiens
  misc_feature 17, 56, 98, 103, 104, 173: n = A,T,C or G
gtgcatgaaatgctggntagaacaccatcctaaagaaaaactttacaagggtgttntggagtaagaaaaaaggttataaagttggaatcttaaattgnaaaannaaccattgagtgtcaaagttctaaaagcagaactcattttgtgcaatgaacataaggaaagactactgnatagg

SEQ ID NO: 19358 - DNA, 142 bp, Homo sapiens
ataaacctggaggagactatatggagccccccaccctaccacacattcgaagacccgatacataaaatctagacaaaaaaggaaggaatcgaaccccccaaagctggtttcaagccaaccccatggcctccatgactttttc

SEQ ID NO: 19359 - DNA, 523 bp, Homo sapiens
  misc_feature 34, 43, 499: n = A,T,C or G
gaagatgtaccatgaggtattcttaaagtggggnatttggatnagagatcttataaagaacttaaaagaactagatctctgtgaaatgatgggctagaaaaaaaatctgcccttgggcaattaatcttgtgtttgagctgaagctctgaatatgcaggaaaattaaccctcagaatttttaactattagcttgtacttaaagaatgtcaaagtcccagtttattttattaaatataagggaaatacctaagctaggaaattaacataaaaagcaatcctggattggtgatgaccatggagcagctggcatttttaaaaattgctttttattggaaggtgagcccttaagctaggctttgtaggatatccagagataacactgtgtttattattagctcacaatctaaaattacaaaactaaattgatcatttacaccactaagaatttcagcaatacagctctcacatacataaattataaaataattttatttaaggngatgaaatttataagcaggtcaaa

SEQ ID NO: 19360 - DNA, 349 bp, Homo sapiens
  misc_feature 205: n = A,T,C or G
atagacttatgtggaaagcatccatagacttccgtggaaagcatccatagacttccgtagaaagcatctgtagacttccgcagaaagcatccgtagacttccgtagaaagcactgatgatgttgtataaacagaccataaggagattgaagccctccatgtattctgtttgcccttggaatatatgtgcatgtgcatgtgcttgngtgtttattttcatttgggtttatgccctatttttaatttgtaagcagaacaagaggcaaagggctctcatatgcccgtagaattatatagtcagggcttttcaggaattttttttttaatccttcaacatttatctttgcatc

SEQ ID NO: 19361 - DNA, 412 bp, Homo sapiens
  misc_feature 13: n = A,T,C or G
aagtattcaattnaacaagaagacctaacaatcccaaatagatttgcacccaatacaggaatgtctggattcatgaggcaagttcttagagacctacaaatagacatacactcccacccaataatagtgagtgacatcaacactccactgacagtattagatcatacaggcagaaaattaatgaagatatttaggacctaaacttagcattggaccaaatggatctggtagacctttacagaagtgtccatccccaaataagagaatatacattcttttcatagccacacggcacatactctataatcaaccacataattggatataaaacaatcctcaacaaatgtaaaataaccaaaatcataccaaacacactctcaggccacagtgcaataaaaataaaagtcaacac

SEQ ID NO: 19362 - DNA, 243 bp, Homo sapiens
ccctctaaatcaccacgatcaaaagggacaagcatcaagcacgcaacaatgtagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttaagatcaccccctcccc

SEQ ID NO: 19363 - DNA, 551 bp, Homo sapiens
  misc_feature 473: n = A,T,C or G
aaagggagaatacacaatggagtatagcaggtatcagccatgtttaccatccacacaagaagacgtcattaataagtatttggaagctacaggtcaacttcctgttaaaaaaggaaaagccaagaactaactttgtttactgtgagttgactgactctaattgaatctgcgtggttttgatactttgatggattccagtggaataaattcaggctgctgaaacaagaaattctgagcccaggaagcggctcttctttcttcaaaagaagcccttcttgttcatattcaggagcttctgttatattcaaaggtaattctatgtctatctcaactctattgattggttttatagtttattgaaaatcctcaaataaaatataattattactgaaatatgtttaatatttaaggggaaaagagactaatttcagttatacttttaagcttagaatgtatgtcatttccaaatttgnatcataagagtttcaacataggagaaaagctgaaaaaatgcaaagaataaccacatactttccatctaccttcctttg

SEQ ID NO: 19364 - DNA, 164 bp, Homo sapiens
  misc_feature 91: n = A,T,C or G
gccagagtaaagtttctaaaataacattcctctcacttgtaccccactaaaagtattagtctacacattacattgaagttaaacacaaaantatcagtgttttagaaacatgagtccggactgtgtaagtaaaagtacaaacattatttccaccataaagtatg

SEQ ID NO: 19365 - DNA, 343 bp, Homo sapiens
  misc_feature 297: n = A,T,C or G
ggatggtcgccagcagtaccatgcctcagaaaatgttattttccttatttggaaaatggatataatcaaaattatggaagaaagtttgtacagggtaaatctatagacgttgcctgcatcctggctacgctcttccaaaagcgcagaccacagttacatgtatggagaatggctggtctcctactcccagatgcatccgtgtcagctttaccctctgaacttctgatcgaaggtcatccctctccagcttgagtggatcaaagatgacaagggccaatggaaccaagtttgagtctngccaggcaatacttgggcctgagtatgggactaggatctggtttgg

SEQ ID NO: 19366 - DNA, 181 bp, Homo sapiens
  misc_feature 89, 113, 134: n = A,T,C or G
gttttaatctgagccttgcagactttcatttggagtttgaacccgttttggttgcatttcatttttggagaacttaattaacgtgagantggcaattgaaatgcaggggcagntttctgttaatgtcatgctgntgtttaggtaataagaaatattaagtaattggctttagattttgtaa

SEQ ID NO: 19367 - DNA, 287 bp, Homo sapiens
acctgatgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagact

SEQ ID NO: 19368 - DNA, 385 bp, Homo sapiens
  misc_feature 7, 334, 357, 372: n = A,T,C or G
cccacancatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtaggaaagaaataaaccctttgtaaatgaggcttgcttttgngaaagatcatccgcaggctatgntaaaaggattttagntcactaaaagtgt

SEQ ID NO: 19369 - DNA, 274 bp, Homo sapiens
  misc_feature 31, 32, 134, 252, 254: n = A,T,C or G
gcattcacctgggctattttggaggctagtnngtcatcttcctgcaggagtaattttatccatgtagttcctagactgttgtctaaatggaatcaagatgggtttgtcagccaccgttgcctaatggtgatttnaggataaattatcttatctcgtattagcctaagaaatctctgacttgggatttggggtgatttaatacaaaatcattcaaagatttctttctgtcttttctttatggcttttggctgngnacttatgactttctctgctg

SEQ ID NO: 19370 - DNA, 140 bp, Homo sapiens
  misc_feature 50: n = A,T,C or G
aacctttagcaataaacgaaaggttaactaagctatactaaccccagggntggtcaatttcgtgccagccaccgcggtcacacgattaacccaagtcaatagaagccggcgtaaagagtgttttagatcaccccctcccc

SEQ ID NO: 19371 - DNA, 435 bp, Homo sapiens
  misc_feature 12, 45: n = A,T,C or G
taagccctaaantgtctactttattttgaaggaggctgtctgcgntagtttgggaagtcagatatatagaacataatgccagaacatttaacgaacctgagagtgtaattgcaagatcagctaaaaagataactgaccaacttttaaaatttatcaagtaagtaatttcatagatgttgtgtaaaagtgattgcatattgtgctattaacaatcatctagttttgccgggcgtggtggctcatgcctgttaatcccagcactttgggaagcgaaggccgtcagatcacttgcggtcaggcatttgagaccagcgtagccaacatggtgaaaccccggctctactaaaaaaaatacaaaaattagccggccgtggtgccggttgctgaggtgggagaattgcttgacccaggaggtggtggtacagtgagcccaat

SEQ ID NO: 19372 - DNA, 270 bp, Homo sapiens
aaaaaatgaaaaaataaaaataaaaaaagaatacaatcattaggaattaccatgtgtaacagttaaaagggaccatttgtgaaattagatattttttgagttatcaagtgttaacattgtgttttatgtactagttaacatccccagcatctcctgagtaccatgttaaatagtgcaggggactttggtacttgcgtatgacattaattttcctttattcacattgaagcaatgctaagtcacatgtgtaagctctccaatcaggttcac

SEQ ID NO: 19373 - DNA, 337 bp, Homo sapiens
aactatcttgagaaaaaagaacgaagttggaagtctcacactccctgatttcaaaacatattacaaagctacagtaatcagaatagcataaagtggtacttggcataaagacacacacaaaaacccatggaacagaatggagagcccaaaaataaactctcatatatatggtcaagtgatctttgaaaagggtgccaagaccagtcagtggagaaaggatagtctctttaaccattatgctgggaaaaccggatattcacatgcaaaagaatgaggttagacccttaccttatgccatgtacaaaaataattcaaaatggattcatgacctaaacac

SEQ ID NO: 19374 - DNA, 496 bp, Homo sapiens
  misc_feature 23, 32: n = A,T,C or G
aaaacacatgagcagtaacaagntttaatctngctcctcaggactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgcaaacccttctttagcccttcacacatcgactgaagaatatgatgctgaaggatatggaagacacagatgatgatgatgatgatgatgatgatgatgatgatgaggacaactctctttttccaacaagagagccaagaagccatttttttccatttgatctgttccaatg

SEQ ID NO: 19375 - DNA, 469 bp, Homo sapiens
  misc_feature 421, 442: n = A,T,C or G
gaggcattgaggcaagccagcgcaggggcttctgctgagggggcaggctggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaatacccaatagaagggcaatgcttttagattaaaatgaaggtgacttaaacagcttaaaggttaagtttaaaaggtgnaggtgattaaaataatttgangcgatctttttaaaaagagattaaacc

SEQ ID NO: 19376 - DNA, 127 bp, Homo sapiens
gtaatcccagcactttgagaggctgaagtgggagcatcacttgagcctgggagtttgagatagcagtgagtcatgaacgtggcactgtactccagcctagacaatagagcaagaagaccctgtctct

SEQ ID NO: 19377 - DNA, 401 bp, Homo sapiens
  misc_feature 329: n = A,T,C or G
ggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggnggttttcctgaagcagctggctagtggcttattacttgtgactgggacctctggcctcaatcgagttcctct

SEQ ID NO: 19378 - DNA, 310 bp, Homo sapiens
  misc_feature 71, 95, 102, 211: n = A,T,C or G
aaaaacatatggatccccatgaagccctactacaccaaagtttaccaggagatttggataggaatggggcngatgggcttcatcgtttataaaanccgggcngctgataaaagaagtaaggctttgaaagcttcagcgcctgctcctggtcatcactaaccagatttacttggagtacatgtgaaagaaaacgtcagtctgcctgtaaatntcagcaagccgtgttagatggggagcggtggaacgtcactatacacttgtataagtaccgtttacttcatggcatgaataaatggatctgtgagatgcg

SEQ ID NO: 19379 - DNA, 329 bp, Homo sapiens
  misc_feature 10, 40: n = A,T,C or G
gccagtatgntgtaagaaagcccttaaataaagaaggtanttaaacctaggaccaaagcacccaagattcagcgtcttgttactccacgtgtcctgcagcacaaacggcggcgtattgctctgaagaagcagcggtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctg

SEQ ID NO: 19380 - DNA, 414 bp, Homo sapiens
  misc_feature 120, 121, 122: n = A,T,C or G
ttagcagacccagcttagagttcttctttctttcttaagccctttgctctggaggaagttctccagcttcagctcaactcacagcttctccaagcatcaccctgggagtttcctgagggnnntctcataaatgagggctgcacattgcctgttctgcttcgaagtattcaataccgctcagtattttaaatgaagtgattctaagatttggttgggatcaataggaaagcatatgcagccaaccaagatgcaaatgttttgaaatgatatgaccaaaattttaagtagggaaagcacccaaacacttctgctttcacttaagtgctggccgcaatactgtaggaacaagcatgatcttggtactgtgatattttaaatatccacagactcactttttccaaatgatcctagtaa

SEQ ID NO: 19381 - DNA, 265 bp, Homo sapiens
gtaataaatgtatatcaaaattgtaattataggaagaattacatgtcagaagtgtgggttgcaaataaagggagatgcaaagggacagttaaagcttcatatgcattaatggaaaaaatgtcaagaaagagtgacaaattgagcgttcaactcaagaagttagaaaaagtacaaaataaagctcaagaaaatggaagtaataatagcacaacttagtgaaataaaacaaactaaaacatatcagcaaaactgaaagtgtttcttt

SEQ ID NO: 19382 - DNA, 362 bp, Homo sapiens
agcaacccggccagtactgggagatacagccatccaccttcagatgtgtctacgtgcgctctgcactcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcaagaatcatcttttgagctttctgttgatggtaactgagctactagagatattcttatttcactaaatgtaaaatttggag

SEQ ID NO: 19383 - DNA, 245 bp, Homo sapiens
  misc_feature 90, 115, 179: n = A,T,C or G
aataaagggtggggaaagaacaaaatccccccctcacaccctattgcaccaccagccttctccctccctgctcaattatacccatgttanagggaaggaaatagggaagaaactngtctaaggcacatggatgttcgcaacaattgggatgcagaacttgatctgactcccagccaggnttgattttgatttgcagtggcagagaggactaattttttactaggttctgagccctgactgaactc

SEQ ID NO: 19384 - DNA, 522 bp, Homo sapiens
  misc_feature 491, 500: n = A,T,C or G
ccaaattggcgtttgtcatcagaatcagaggtatcaatggtagtgagcccaaaggttcgaaaggtgttgcagcttcttcgccttcgtcaaatcttcaatggaaccttttgtgaagctcaacaaggcttcgattaacatgctgaggattgtaggagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtgcccttcaaattgcttctccacgaggtggaatgaagaaaaagaccacccattttgtagaagggggagatgctgcaacagggaggaccagatcaacaggcttattagaagaatgaactaaggnggctaccgngataatttttctaagctggtgg

SEQ ID NO: 19385 - DNA, 278 bp, Homo sapiens
  misc_feature 29, 220: n = A,T,C or G
atcatgcattcttagcaaaattgcctagnatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgacaaatttttcattccttttgctctttgtggntggatctaacactaactgtattgttttgttacatcaaataaacatcttctgtggccag

SEQ ID NO: 19386 - DNA, 467 bp, Homo sapiens
acactaaaatatttgtattaaaagaagaaaagataacattttacctttagataactgcacttgtacctcactagagttaatcccacccaatcagattgagaaataaattggggaatgtggaaagagtccaaaagaggtcagaatttggagaggtactggccttctggacaacatttagaccctctacaattattttcattaagctgattcctacatcctgaatattcatgttttctcatctacagatatttgtcttcccccaaactaaaagaaaaaaaactaccctttactctcttttctactcagttactcttttgtgctatgttaagaaacttgaaatatattggggatgtggggattttgtccctgactgcccactgtacaggacaagagagacagtgtttcagttggaattcaggactcctggttttgaggaagaggatgacactgcagtacttggtttggaa

SEQ ID NO: 19387 - DNA, 374 bp, Homo sapiens
  misc_feature 305, 321: n = A,T,C or G
ttacatttcatatgatagaaaaagaaaactgcattaagaaatatggacctcttgcctgtcctagaagctttatatacatatagatagacaagagaaatgggaggaaaaaaatgaagactccatgatttttcgattgagtctaatctaataggtcccgaggactttctccagaagagcaaagatgcattggaaagcaattatgtgtctgaacaccttcacgagtggattgatctaatatttggctacaaacaaaaagggagtgatgcagttggggcccataatggtatgtaatattcattgaaatnttatttagcattgggngaatatttagcattattcattttcattggaaaatgaaagcaaacaataccaac

SEQ ID NO: 19388 - DNA, 331 bp, Homo sapiens
tcaattccttttcaactttaccctgactgaagagctgagcattggattgttagaaagcagacaaaccagacaaaacaaaaagctcttgttttccctttccccgtcctcctttccagggccttaaccccaccaactctggccatggttgcccaaggttacttgtcactgaggcagttggcatttctgggattgtgacaccctcgaacgccagaaagaatagctgtagagtgtaataaaggcagaggactcaagaaaggcatgaagattagagagtaaaggaagacagaccagaggaaggagatgaatgcgttccctaggtggtcttgtgtgt

SEQ ID NO: 19389 - DNA, 104 bp, Homo sapiens
cattccctgtaaaaggcaggagacatgtgattatgatcaggaaactgcacaaaattattgttttcagcccccgtgttattgtccttttgaactgtttttttttt

SEQ ID NO: 19390 - DNA, 439 bp, Homo sapiens
  misc_feature 14: n = A,T,C or G
tgggacgatttctncccgggttccgatcgctttgccggccggacttcagggacatttccaaatgggacaaccgcgtagtgagcaacctgctctattaccagaccaactacctggtggtggctgccatgatgatttccattgtggggtttctgagtcccttcaacatgatcctgggaggaatcgtggtggtgctgggtgttcacaagggtttgtgtgggcagcccacaataaagacgtccttcgccggatgaagaagcgctaccccacgacgttcgttatggtggcatgttggcgagctatttccttatctccatgtttggaggagcatggctttgtgtttggcattacttttcctttgctggtgatgtttatccatgcatcgttgagacttcggaacctcaagaacaaactggagaataaaatggaaggaatagggttg

SEQ ID NO: 19391 - DNA, 320 bp, Homo sapiens
  misc_feature 68, 295: n = A,T,C or G
acacctgtggtcccagctactcaggaggctgaggtgggaggatcatttgagcccaggaggtcaaggcngcagtgagctgtgatgacaccactgcactccaacctaggtaacagagagacacctctgtctctgaaaaaacaaaacttgaagtttgaaacccccagcttgctgagggagccctttttatttttggtactgagagtctcaaggcccatagctacatggtacagggctgttgctgcttgctgcacagcagaaattacaccatccacaggaaatggactatttttgcagnccaacatcagccaaccacacacagc

SEQ ID NO: 19392 - DNA, 377 bp, Homo sapiens
gaaactctatgacaagattgacccagagaagctttcagtaaattctcattttatgaaagacctgggcttagacagtttggaccaagtggagattatcatggccatggaagacgaatttgggtttgaaattcctgatataggtgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaatc

SEQ ID NO: 19393 - DNA, 175 bp, Homo sapiens
  misc_feature 36, 37, 42, 52, 65, 86: n = A,T,C or G
agcaagtggccctatttttattagggttttgaaggnntgtgngtgtgtgcgngcgtgtgtgtgtntttcttttttaaatgtatagnagagtggtgtctgtataagtgttacctgtagtggggttttgtccagcaagcctgaaatttatactttgaaataaaactactgggtttct

SEQ ID NO: 19394 - DNA, 340 bp, Homo sapiens
gcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacaagctctttggcactaggaaaaaaccttgtagagagagtaaaaaatttaacacccatagtaggcctaaaagcagccacc

SEQ ID NO: 19395 - DNA, 460 bp, Homo sapiens
  misc_feature 10, 21, 199, 223, 396, 421: n = A,T,C or G
aaattagttnaagcataagangaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataattnatgatgactcagtggggccagagnaaagtttctaaaataacattcctctcacttgtaccccactaaaagtattagactacacattacattgaagttaaacacaaaattatcagtgttttagaaacatgagtccggactgtgtaagtaaaagtacaaacattatttccaccataaagtatgtattgaaatcaagttgnctctgtgtcagaatacatacttatncccattttaagcatttgcttctgtttccctacctagaat

SEQ ID NO: 19396 - DNA, 261 bp, Homo sapiens
  misc_feature 231: n = A,T,C or G
aatatcattcactggcatgaaaccaggaggcggagcttacagtgagccgagatagtgccactgcactccagcctgggtgacagagtgagactccatctcaaaaaataaaaataaaaaaaaatcattcactatgatcaagtggaattcattccaggaatgcaaggatggttgaacatccacaaatcaataactttgatataccacattaactgaaagaaagacaaaacccgnatagttatttctagagatgcagaaaattca

SEQ ID NO: 19397 - DNA, 230 bp, Homo sapiens
aaggccttcttggctgatccatctgcctttgtggctgctgccctgtggctgctgcaccacagctgctcctgctgctgctgagccccagctaaggttgaagccaaggaagagcggaggagtcggacgaggatatgggatttggctctttgactaatcaccaaaaagcaaccaacttagccagttttatttgcaaaacaaggaaataaaggcttacttctttaaaaagtcat

SEQ ID NO: 19398 - DNA, 480 bp, Homo sapiens
ttgtccgacatcttgacgaggctgcggtgtctgctactattctccgagcttcgcaatgccgcctaaggacgacaagaagaagaaggacgctggaaagtcggccaagaaagacaaagacccagtgaacaaatccgggggcaaggcaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatc

SEQ ID NO: 19399 - DNA, 128 bp, Homo sapiens
  misc_feature 81, 111: n = A,T,C or G
gccagcagtacgtggagccacaattgcacaatatattttcttaaaaaataccagcagttactcatggaatatattctgcgnttataaaactagtttttaagaagaaatttnttttggctatgaaattg

SEQ ID NO: 19400 - DNA, 516 bp, Homo sapiens
  misc_feature 154, 158, 176, 183, 184, 448, 471: n = A,T,C or G
gcaagactgttattgagtaccggcacagaagacctcacgcctccccatcattgacattgcacccatggacataggagggcccgagcaggaattcggtgtggacatagggccgggtctgcttcttgtaaaaacctgaacccagaaacaacacaanccgntgcaaacccaaaggaccnaagactnnccaatctcagacactctaggactctgcactgaatggctgacctgacctgatgtccattcatcccaccctctcacagttcggacttttctcccctctctttctaagagacctgaactgggcagactgcaaaataaaatctcggtgttctatttatttattgcttcctgtaagaccttcgggtcaaggcagaggcaggaaactaactggtgtgagtcaaatgccccctgagtgactgcccccagcccaggccagaagacctccctncaggtgccgggcgcaggaactgngtgtgtcctacacaatggtgctattctgtgtcaaacacctctgta

SEQ ID NO: 19401 - DNA, 378 bp, Homo sapiens
  misc_feature 22, 54: n = A,T,C or G
gaagtattcaataccgctcagnattttaaatgaagtgattctaagatttggttngggatcaataggaaagcatatgcagccaaccaagatgcaaatgttttgaaatgatatgaccaaaattttaagtaggaaagtcacccaaacacttctgctttcacttaagtgtccggccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttgggataattat

SEQ ID NO: 19402 - DNA, 102 bp, Homo sapiens
  misc_feature 57, 72: n = A,T,C or G
aaataagtagaaacaaaaaagcagtggctaagatggtatagggactgtcataccagngaagaataaaagggngaagaataaaagggatatgatgacaaggct

SEQ ID NO: 19403 - DNA, 347 bp, Homo sapiens
  misc_feature 13: n = A,T,C or G
acatgcctgtttncccaacacccttgcatgcagtgaatattacagaagtgaaaaaggaaaatgtattattccaatagcaataaaatatagaataactaggaataaacctgataaatatgtgctatctgtgtgaagaaaactttagcatgctccagagggacccaaaggaagacttgaccaaatcaaaattttgccagtttcttgcatgggaacttgtagcatggtgaaaatattcattctcagtcaagctatgatttgaacatgacccaataaaaatacccacagacttttttagtggagcaaggggaatttactgagctgatttttaaagatcatttagaaaaacg

SEQ ID NO: 19404 - DNA, 125 bp, Homo sapiens
  misc_feature 12: n = A,T,C or G
catcaaagcagnggcaagaaggctgctggagctgcaaggcaccaagtctgcccagaaagctcagaaggctaaatgaatattatccctaatacctgccaccccactcctaatcagggggtggaaga

SEQ ID NO: 19405 - DNA, 300 bp, Homo sapiens
  misc_feature 41: n = A,T,C or G
attattgggtgtcccaccctcatgacctcatctaaacaganttacctcccaaaagtcccacttcctaataccatcacagtggggacagggctttaacatatgaattttggagggatacatacattcagtccataacacagaggaagtaactcatccaaggcctcatagctaaaaggtggtagagttggaattgaaccaaggattcacacttgaaagtctgtttttaaccagaatgagtgagtgagtgagtaaggcacttatgtttcccaaatttcttgaaacagagtaaaaatgttgacg

SEQ ID NO: 19406 - DNA, 216 bp, Homo sapiens
  misc_feature 86, 104: n = A,T,C or G
gacttcaggtaccagcttaaagagcactagggatggggaacgaatgccaaatcagactccacctagagcaccaggaaacagcttgnaccctggagggaaatggngttgctgaaaggggaggcttgagccagtgcgagactgaacttgtgcagccttagccaagacaaagcagggtttttcagcagacggtgatgggacaggaattgaagaagagaa

SEQ ID NO: 19407 - DNA, 206 bp, Homo sapiens
aggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctacc

SEQ ID NO: 19408 - DNA, 249 bp, Homo sapiens
  misc_feature 65: n = A,T,C or G
aaatatatatgtcaatatttagtaaagcttttcttttttaatttccaggaaaaaataaaaagagnatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacatt

SEQ ID NO: 19409 - DNA, 271 bp, Homo sapiens
ttgaataaaatttactcccagtgccgtggctcatgcctgctgcaatcccagccctttgggaggccgaggcaggaggatggcttgaggccaagagtttgagaccggcctgtgcaacatggcgagacccagtgtccacagaattaaaaattaaccacgcagctgtaatcccagccacttgggaggctgaggcaagaagatgacttgagccctggcatttggctatgatcttgccactgcactctagcctggcaacagagtcagactctgtcgc

SEQ ID NO: 19410 - DNA, 314 bp, Homo sapiens
  misc_feature 20, 258, 288: n = A,T,C or G
ggtatgaaaacattcctagngatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggtaaatgaccttgtatataaatattgccatatcatggacctataatggngatatatttgttctatgaaaaatgtattgngctttgatactaaaaatctgaaaatg

SEQ ID NO: 19411 - DNA, 325 bp, Homo sapiens
  misc_feature 5, 40, 103, 105: n = A,T,C or G
gcttncctttttttaaattaaaaagtataaatctttatanaaattaactataactttatgaaagtatgtttaaacttgagcagattttgtaaaaatttaatgngnagaacatgtgttgttttcagcaacagcttaatttctttagtcacttaaccttttttagacttttgtttttaaaaatatttctttttttcactctgaatcatacctaggaatcaagtctctctagcctttgtaatatattgaaaagacttgaaggccattttgccttcaaacttttttccaggagtttgccttaaacctctaacatcttataagtttcctc

SEQ ID NO: 19412 - DNA, 156 bp, Homo sapiens
  misc_feature 41, 70: n = A,T,C or G
cctagacactataagcgtattgttttcaggatacgttgcantgaaaacatttctgagttttggtactgtngtaggtaagcgttacaaaccaatgaaataaaagtacctgagatcgcaccattgccctccagcctaggcaacgagcgaaactccgtc

SEQ ID NO: 19413 - DNA, 530 bp, Homo sapiens
  misc_feature 519: n = A,T,C or G
atttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgccaaaagacgttttctttggccaaagatctctttcgtgattccttgcaacaatcaatgagaatcttcatgtattctggagaacaccattcctgatttcccacaaactgcactacatcagtataactgcatttctagtttctatatagtgcaatagagcatagatctataaattcttacttgctaagacaagtaaatctgtgttaaacaagtagtaataaaagntaattcaatcg

SEQ ID NO: 19414 - DNA, 148 bp, Homo sapiens
  misc_feature 43, 125: n = A,T,C or G
tgccacatttgagatgatccttacggaaaaggaacagattgtncctaaaccagaagaggaggttgcccagaagaaaaagatatcccagaagaaactgaagaaacaaaaacttatggcacgggagnaaattcagcattaaaataaatgt

SEQ ID NO: 19415 - DNA, 154 bp, Homo sapiens
  misc_feature 24, 76, 77, 80, 88, 137: n = A,T,C or G
tgctgagggggcaggcggtaggtngaggaaaccgcagataagtttttttctctttgaaagataagaagtttgaagnnggnaaacttgnagacagaagtaccgggagggcgaagaaaagaatagagaagatagggtanattaggaagataaaaaa

SEQ ID NO: 19416 - DNA, 302 bp, Homo sapiens
  misc_feature 17: n = A,T,C or G
ttgcattagtttatgtntccatgccagagtttgtgtgggcgggcgcatgtgcaccacagagtgcactcgaggggactttcagtcacaggatttcataattgtcattgtcacactttcaaatttttgtacatcaagtgaatttttttatattaaaaggttgagccaaagcccccagtgtttgtattttgaagccaagcttcacttctaaagtgcctacagagacttgtaaatgaaaatgcagctctgcaccgagtttgaaaccgcatacctccttctattaggaatggcatatactgaggtgg

SEQ ID NO: 19417 - DNA, 167 bp, Homo sapiens
  misc_feature 20, 51, 82, 140: n = A,T,C or G
ggatcccctaacaacagtgngagagcaatgcgagcagttggagaaatgtgnaaaggcccgggagcggctagagctctgtgangagcgtgtatcctctcgatcacatacagaagaggattgcacggaggagctctttgacntcttgcatgcgagggaccattgcgtgg

SEQ ID NO: 19418 - DNA, 185 bp, Homo sapiens
  misc_feature 148: n = A,T,C or G
ctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttgnaccagcagcggatgaataaagcttcctgtgttgtgtg

SEQ ID NO: 19419 - DNA, 233 bp, Homo sapiens
  misc_feature 38, 64: n = A,T,C or G
gacaggactttcactaactgtgtggatcttgggcaagnctgtgtgccctgagactcagtttatntaactttcttttaaaaaacatagtccagatgcagataacaaagcctgcctctaatttcccttacagaattgtgagaagctggtggagatgtttgttacaaaagtgttttgaaaatagagcaaatattattctttttaaggcatgatgttttcatagcatgtcaggcaac

SEQ ID NO: 19420 - DNA, 351 bp, Homo sapiens
  misc_feature 37, 41: n = A,T,C or G
caatgcaaacagaattgctttagatttccaaagaggnaatnatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagatc

SEQ ID NO: 19421 - DNA, 331 bp, Homo sapiens
  misc_feature 14, 27, 216: n = A,T,C or G
ataatattgatatnggaagctgcagantccagaataagtggagtaataactaaacagacatttaattttatttcaatatctatggaaaaaacacttattaaatctccctgtattttatgttgtctttattacagaatcacttgtctgtttgttgtgtgccacttactgacaaaactttaaacagtacttgatgccagctctctactctgtggctgngggacctgtttcttttaggtacttgtgcttattaatctacttactaaattttcacattgacatttttggggatgatactaccatatacgaaatggaaaatgtaatatgctcaggc

SEQ ID NO: 19422 - DNA, 404 bp, Homo sapiens
  misc_feature 273: n = A,T,C or G
ccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaactggttctcaaagtgtggntcccagaacagcagcttcagcatcacctgagtttttaaaattgcatatccatccttggactccaccccagacctactgaatcagaaactctggagagacgtttctttggaccaaagatctctttcgtgatt

SEQ ID NO: 19423 - DNA, 424 bp, Homo sapiens
ggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgcaataagaacaaaggcatcatctgggggagaggatacactgatgggagtatttggagaatcccaagaagacatccctggaacaaaaatgatctttgtcgcattaagaagaaggaagaaaggcagacttaatagcttatctcaaaaaagctactaatgagtaataattggcacttgcttatttattacaaaacagaaatgctcatgacttttttatgtg

SEQ ID NO: 19424 - DNA, 428 bp, Homo sapiens
agtaacttctgtctgacaaacagtctctctccaggacatggaagtagccaggcaccgtaatcacttcagcgatgctctcctgtcgtgcaaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctggccaaggcaaaagcactcggcaaaaatgcacagataatgccaggtgcggtgctcatgcctgtagtcccagcactttgggaggctgaggtggcagatcactttgagctcaagggtttgagaccagcctggcaacatggcgagaccctgctct

SEQ ID NO: 19425 - DNA, 297 bp, Homo sapiens
  misc_feature 255: n = A,T,C or G
acataatttaatacagattgatgttaatacttgtgtatttacataaccgtttccttcttgtcactgaaatatatggaccttaatttgtatcctgactgactcaacccagcagagcataaattgacttgagagccttacctttgatgtctgaaatgaaacccccttctccaaaggcaaaattcggagactttgatctttgctactggagcctttaacaacacctataacgataaaaaattcctaattgtttgtggnagtattttaattctagatgtggtatctctctgggaagtatag

SEQ ID NO: 19426 - DNA, 194 bp, Homo sapiens
gtgatgttaagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgcacagtatttt

SEQ ID NO: 19427 - DNA, 254 bp, Homo sapiens
tctggacttggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgcttt

SEQ ID NO: 19428 - DNA, 132 bp, Homo sapiens
  misc_feature 7, 116: n = A,T,C or G
atgattncctgatcttaacaaaattcgtagcagtggaaccttgaaatgcatgtggctagatttatgctaaaatgattctcagttagcattttagtaacacttcaaaggtttttttngtttgttttctagact

SEQ ID NO: 19429 - DNA, 183 bp, Homo sapiens
  misc_feature 35, 36, 45: n = A,T,C or G
acatttgaatcctaactgtcgctagctacaggacnntgggcaagngacttaaactttcttagtttttctcatctgtaaaaatgaaatagtacctacctcatatacttattgggtagattaaatgagagtttgttttaaagctactgtcacagcccagtaccatagaagaatttcagatgtaac

SEQ ID NO: 19430 - DNA, 190 bp, Homo sapiens
  misc_feature 39, 79, 109, 172: n = A,T,C or G
gaagatgacatcacctattggcttaacagagatcgaaanggcatgaatactatggcgattactaccaacgcactatgangaagactctgcaattggccccggagccccnacggctttagcatggagcaggcgcaactacgatgactactaaccatgacttgccacacgctgnacaagagcaaatagcgat

SEQ ID NO: 19431 - DNA, 316 bp, Homo sapiens
aatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaagcataaaattaaataaaatttttcccc

SEQ ID NO: 19432 - DNA, 272 bp, Homo sapiens
  misc_feature 61, 119, 120, 201, 211: n = A,T,C or G
agactccagcagccaagatggagaagcagagcgagagcaagactgcttttcaggaagcctnggacgctgcaggtgataaacttgtagtagttgacttctcagccacgtggtgtgggccnngcaaaatgatcaagcctttctttcattccctctctgaaaagtattccaacgtgatattccttgaagtagatgtggatgacngtcaggatgntgcttcagagtgtgaagtcaaatgcatccaacattccagttttttaagaagggacaaaagg

SEQ ID NO: 19433 - DNA, 440 bp, Homo sapiens
acagcaatgagtgaacgggcacttgctcagaaaagactcagtgagaatgcatttgatcttgaagccatgagcatgttaaatagagctcaggaaaggattgatgcctgggctcagctgaactctattcctggccagttcacaggaagtacaggagtacaggttttgacacaagaacagttggccaatactggtgcccaagcctggattaaaaaggatcagttcttaagagcagccccggtaactggaggaatgggagccgttttgatgagaaaaatgggctggagagaaggagaaggattaggaaaaaacaaagaaggcaataaggaacccatcctagttgattttaagacagaccgaaaaggtcttgttgcagtaggagaaagagcacaaaagaggctggggaacttctctgctgcaatgaaagatctgtcaggcaaaca

SEQ ID NO: 19434 - DNA, 323 bp, Homo sapiens
  misc_feature 154, 212, 259, 261: n = A,T,C or G
gtttctggcctggaggctatccagcgactccaaagattcaggtttactcacgtcatccagcagagaatggaaagtcaaatttcctgaattgctatgtgtctgggtttcatccatccgacattgaagttgacttactgaagaatggagagagaantgaaaaagtggagcattcagacttgtctttcagcaaggactggctttctatctcttgnactacactgaattcacccccactgaaaaagatgagtatgcctgccgngngaccatgtgactttgcacagcccaagatagtaagtgggatcgagacatgtaagcagcatcat

SEQ ID NO: 19435 - DNA, 443 bp, Homo sapiens
  misc_feature 28, 162: n = A,T,C or G
tggacgagcctcaaaacaaaaggttgtncattctttgaaggtgatttagcacctaattgtaattcagcagtacggtgaagattagagttgttctatctacagcagtacaacagtgctttttttaaaaataagaaataaattaactgaacaactgtgcttcgnaattcttggacttaggtaagtgacatataaccaaataagagttgtgtataaaaccaagatgatagcccatgaaaacccaaagggatcttttagggtgagatagtatatgtcaaagttgtcaggcaaactgtataaacttggtcgttgcctttattatctattctaatcatttacagataaggaagctgaggccttcagcactaaggtctcacacaggcttttacagctggtgaggacaaggtcgggctggcaatactgggagttcctaaacacaaaaggca

SEQ ID NO: 19436 - DNA, 416 bp, Homo sapiens
  misc_feature 5, 389, 412: n = A,T,C or G
atgangattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggcacaacttgcttctgctcatcctgccttagtgtgcaatctcatttgactatacgataaagtttgcacagtcttacttctgtagaacactgccatagggaaatgctggttttttgnactggctttaccttgatatatgnatat

SEQ ID NO: 19437 - DNA, 257 bp, Homo sapiens
agcttccagcagcgaatttgccattttcagtggaaaacaagtggtcgttactagctaagatgtgttgtgtactttggatctgcatttgctacacccttccttgtagtaagacaccaactgcttaaaacgtaaggatgtttcaagttcctccatttaacagatatgaagagcattttaagaggtgcagcctctggaagtggatcaaactagaactcatatgccatactagatatgtttgtcaataaacttatgacgcg

SEQ ID NO: 19438 - DNA, 354 bp, Homo sapiens
atcgctttcagttatgagctctccaagctggagagcacagtcggctccccggagaagccgctgtctgacctgggcaagctcagctaccgcagctactggtcctgggtgctgctggagatcctgcgggacttccggggcacacttgtccatcaaggacctcagccagatgaccagtatcacccaaaatgacatcatcagtaccctgcaatccctcaatatggtcaagtactggaagggccagcacgtgatctgtgccacacccaagctggtggaggagcacctcaaaagtgcccagtataagaaaccacccatcacagtggactccgtctgctcaagtgggcaccccccaagcac

SEQ ID NO: 19439 - DNA, 330 bp, Homo sapiens
  misc_feature 79, 277: n = A,T,C or G
ttttttacaataaaatgatacaataataaatgatggaaattgtattttttaaattgagtaatttgtttataacactggngacttctggttgcttcatttggctagcttcccttgttggcagggcatttgtttcttcattcagacaatgctactctgagaccacacaggacttttatccagaagtacccacagtataaactaaaaatacttgagacaacagtaaagaatatataaattcacatcaagagtaactgtactgtaagaatgtgatggcagnggtagggaaaatgaaaataattagagcatcactgtgagcaaagcatgtctcgg

SEQ ID NO: 19440 - DNA, 463 bp, Homo sapiens
  misc_feature 290, 339, 356, 423: n = A,T,C or G
gagttgaatactcagctcccacgagaaagaaagtagttttaaggtccagcttcttagtctacttgaagcaaattttttttcttttatatttctgaatataaatatactcttatatgggctaaaaagaccccatgaataaatagcaggttcagtagttgaggagtggagtttagtaggtttgttttcagtataaattagataacatgtggaggcacagcattttggaaattgagtgccccaagtgagctttgtttataaactttcaaaatgtcggaagtggacaggtttgntaaatcttgctgccagcaccctttcttccttggtccttttcctctctgngttattgcctgcggganccagtccttcatactagatagagtcagataaagcaaacggtttggcaaaaacatactggttggcccnctccccctctcttatgaaggggtagcatggttctgggttt

SEQ ID NO: 19441 - DNA, 349 bp, Homo sapiens
caatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgtctcaagaaggataatgtaaagaatgaagacaaagatcaaaaatccaaggagaat

SEQ ID NO: 19442 - DNA, 273 bp, Homo sapiens
gggccaaaaccctcctggatcccttcagagtctttttggcctgatgatgactcttgagtgataccctgtgatgcagacatgccccagatggattctactttctttaaaactagggactttcaagattaaaaaaagattgcactactaatttgacgcctaacttcagaagcttcactgtctacatgtgaacttttccagaaaaactgtgccatggacatttttcctctggggaattaacatctaaattctggtaactattaaaagacagatctg

SEQ ID NO: 19443 - DNA, 316 bp, Homo sapiens
gctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagca

SEQ ID NO: 19444 - DNA, 386 bp, Homo sapiens
atcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcggccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatg

SEQ ID NO: 19445 - DNA, 232 bp, Homo sapiens
  misc_feature 20, 21, 55, 74, 92: n = A,T,C or G
ttacatatctaagtcagaanngctagaaaaatgacatatacacatgcaaaaaaangaaggtggaacttaacctnacactatatacaaaaagnaactcaaaatgtatcaaaggcctgaatgtggggtctaaatccataaaactcttagaagaaaagctttatgacattagatttgaatatgacaccaaaagcacaggcaacaaaagaaaaacatacataaattagactacatc

SEQ ID NO: 19446 - DNA, 253 bp, Homo sapiens
  misc_feature 30, 55, 59, 86, 98, 107, 135, 174, 177, 213: n = A,T,C or G
tgtgatattcaccatcaggctgaaagaagntgatgttttacctttaaaacaaganttancaggggtatatataaatatatgtatantgtatatatgtnagaaagatnaagagaataagttataaaaagaaaaaanctatataaaataattatataaccatccagtgttacatgntancattaaattggtaacaaatggcataaaaatagctgngcctttaatttgcgataaaggctatttgctttttcccata

SEQ ID NO: 19447 - DNA, 216 bp, Homo sapiens
ccagggttttagaagttcggccaactcggtgtatgtgccttcctgcgccttgcatggctctgggcaccattggaagactgcagatataaatgacaagtgatttattttgttttcagcctccagagctttagctttagagtcagataggcagagctgggtttatatatcatcctgagtaactaacctcagcatctgaacctcagtttattaattgcc

SEQ ID NO: 19448 - DNA, 544 bp, Homo sapiens
  misc_feature 524: n = A,T,C or G
agcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttgggataattatgggggggggattattttttatactgtatgtgccaaagctttactactgngaaaagacaactgttttaat

SEQ ID NO: 19449 - DNA, 238 bp, Homo sapiens
atgtgggtttatttctggactttcaattctattccattggtctgtgtgtctattcttatgccagtaccaactgctttgattgctatagatttataataaattttaaaatccagaagggtgaatcctccacctttttttttcttctacattgtttgctgtaagaacatttagattgctagccataagaactgtaatttgcaacacagttattacctaggcttcactaacttattcccct

SEQ ID NO: 19450 - DNA, 136 bp, Homo sapiens
  misc_feature 19, 42, 54: n = A,T,C or G
aaagcaggttcttgttggngcacaagcacaaaattagttatntatggggatggnagttttttcatcttcagttgtctctgatgcagcttatacgaaataattgttgttctgttaactgaataccactctgtaattg

SEQ ID NO: 19451 - DNA, 227 bp, Homo sapiens
ggaccaaagatgacctgtggtaagcaacctgggcatcttaggaagcagtccctggagaaggcatgttcccagaaaggtctctggagggacaaactcactcagtaaaacataatgtatcatcatgaagaaaactgattctctatgacatgaaatgaaaattttaatgcattgttataattactaatgtacgctgctgcaggacattaataaagttgcttttttaggct

SEQ ID NO: 19452 - DNA, 291 bp, Homo sapiens
  misc_feature 5: n = A,T,C or G
aactnacaaaagttcttttgagaataagttacacacaatggccacagcagtttgtctttaatagtatagtgcctatactcatgtaatcggttactcactactgcctttaaaaaaaagaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagt

SEQ ID NO: 19453 - DNA, 504 bp, Homo sapiens
  misc_feature 376: n = A,T,C or G
gactgcctgagtccctcaaacatggtaagttttctcctaagtcaaagagacggaggctgagcatggaggtgcctcctgtacccaaccaacttcagtttcttttatcagctttatataggcttttgaataggattttattcaggaaataaaaatagtcttgctactataaataagaatacccattgtagagtttttaaaaaaagtattataggagtaggtgtctgtcataatatttgctccaagttatttaaattggccactttaatatagatttttaaaaatcttcatttttttctacttagaaaacaacagtgattattgggaaaatttaaatattacagaaatgttttaagaactgtaagactaggcctggcgnggtagctcacacctgtaatcccagcactttgggagattgagacaggtggatcacaaggtcaggagatcgagaccatcttggccaacatggtgaaaccccatctctactaaaaatacgaaaattagcga

SEQ ID NO: 19454 - DNA, 414 bp, Homo sapiens
gagagaatagaatacaatggcatagactcctaatgtttgataaaatactattttcagagtggtagagaggttttatttgcctaaatagccgttattaaatggaataacaaccacattagaccaaattaattgcaaacacagcggcaacctggggagaagttgaaactccagttttgtggattacagttttgagttttatgattgacatttttaagtcccctatttaaggggtcaagattataacaatgtgtgtcttactaagtttctaggtcattgtgagcacttgataaatatttgctgaatgttgtttttttgaatgaacataagatagaaacaaaaacttctcatccagttaactagagtgaatgtagggagaattgttttgcttgtaacatggagagtttattttcaagt

SEQ ID NO: 19455 - DNA, 361 bp, Homo sapiens
gtattctttttttggtttgttatggaaaagctggagtaaagatttgaattgcattccatagattttattttttgtgtactttgaaaatgatgctgagctgacacaggatcaggaggtggcccagatttatatggattacaaatggagataggatgagttaggaagagaaacctgataggtcattcttgagccatccagggatcttttcaaaatctccatataaagggcctaattggagaaagaaagggagggaaatgatcttcaaatatattagaaaaaatagttttgattgaatataaagaacttagggcactaaaacttggtagtagaaagagtgtcaagaagattctggtatcatctc

SEQ ID NO: 19456 - DNA, 488 bp, Homo sapiens
  misc_feature 32, 39, 58, 351: n = A,T,C or G
ttaccttgcatcagaggagcctcaccgtaccnaggaagnttgaaggtgaaagaggaangtgaaacaggtggctgggacccagaaaccctcttaccctgcacctctgtcatacttctcccggggcatagggagagttattctgcttctctttgccttgttttgtaacatggggtagttgttggtgcagccatgttgtgctgagtgaacatatattaagatctttggaacctttaggagactgaaaataggtaagtatgaattagtatttctggaatgggtattcaggagaacttcgtaccatttttataaatgtgaaaggaacctaattagaacagcttgcactttgtcagnacactactagatttcaaaatcagattctacttacagggagaaaaaaaaagcccaatatgttgaacagtattgaaattgttgcataaataaaggccatcattgtagaccagcttactgaagtgaagaaagaaaaaaag

SEQ ID NO: 19457 - DNA, 453 bp, Homo sapiens
taggagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttgggtaaatacggcatcatctgcatggaggatttgattcatgagatctatactgttggaaaacgcttcaaagaggcaaataacttcctgggcccttcaaa

SEQ ID NO: 19458 - DNA, 453 bp, Homo sapiens
atggtgaagcagatcgagagcaagactgcttttcaggaagccttggacgctgcaggcgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattgctatttaaaacttgtaatttttttaatttacaaaaatataaaatatgaagacataaacccagttgccatctgcgtgcaataaaacattaatgctaacacttttt

SEQ ID NO: 19459 - DNA, 134 bp, Homo sapiens
aacctttctcatagctgtatgctacctgcatgcaacttgctttacctgcctttgttattctactgactcttgctttttcaattgctgttaaaaataagataaacagaaagcaatataccattgaacctaaaagc

SEQ ID NO: 19460 - DNA, 372 bp, Homo sapiens
atttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaaggtaaaaacatacctttagaagaaaaaagataaatttaaacctgaaaagtaggaagcagaagaaaaaagacaagctaggaaacaaaaagctaagggcaaaatgtacaaacttagaaagaaaattggaagatagaaacaagatagaaaatgaaaatattgtaagagtttcagatagaaaatgaaaaacaagctaagacaagtattg

SEQ ID NO: 19461 - DNA, 306 bp, Homo sapiens
  misc_feature 72, 79, 255: n = A,T,C or G
gtcagcagctgtctcaacaaccttgaaaggttcttaagtagagagcctctggtttttggttggtgaagcagngattttnattttggggcagggagcatttgaaaaccctgtagctcttgaccattgagacccaagcaggaggacatttttccaggttgtgaaacaaggtggtgacattatccagaagactctaaggaaagaggctttgctcaggctttgatttttgaaagaaatcaaggagcaggctggcacagngctcacacctgtaatcccagcactttgggaggccgaagcaggaggatcact

SEQ ID NO: 19462 - DNA, 235 bp, Homo sapiens
  misc_feature 153, 154: n = A,T,C or G
cgaggctgggaggatcacctgaggtcgggagttcaagaccagcctgaccaacatggagaaactccatctctactaaaaatacaaaattagccaggtgtggtggcacacgtctgtaatcccagctacttgggaggctgaggcaggagaatggcnngaacctgggagttggaggttgtggtgagctgagatcatgccattgcactccagcctgggcaacaagagtgaaactccgttt

SEQ ID NO: 19463 - DNA, 401 bp, Homo sapiens
  misc_feature 246, 310, 328, 330: n = A,T,C or G
atgatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaaataaaaagagatgagtcttctgtaattcattgagcagntagctcatttgagataaagcaaatgccaaacactagctctggattaatccccatcattactggnaaagcctcatttgaatgngngaattcaatacaggctatgtaaaattttactaatgtcattattttgaaaaataaatttaaaaatacatccc

SEQ ID NO: 19464 - DNA, 496 bp, Homo sapiens
  misc_feature 24: n = A,T,C or G
aactacaaaactgatgaaattganggactactaaataaatggagatatatttcatgaccatgcacaggatgactcagtattgtcaagatgtcaggtcttctcaacttgatctatagattcagtacaatcccaataaaaatcccagcaagttattatgtggataacaacaaactgattctaaagttcatttggaaaggcaaaagatccagaatagccagcacaatgtttaaagagaagagttggaggactctcacagctgacttcaagagttatgataaagttataataaacaagacagtgtggtattggtgaaagaacagacaaatagaccagttgaatggaatatggagcccagaaatagactcatgcagcctggcacagtggctcacacctgtagtctggaactttgggagctacttgaggccaggagtttgagaccagcctggcaacaaaacaacaccttgctctacaaaaaaaatattttaaattagccgat

SEQ ID NO: 19465 - DNA, 356 bp, Homo sapiens
  misc_feature 26, 266, 276, 287, 318: n = A,T,C or G
ggtcaaatgaaggtgaattcaaggcngaaggaaatagcaaattcacctacacagttctggaggatggttgcacgaaacacactggggaatggagcaaaacagtctttgaatatcgaacacgcaaggctgtgagactacctattgtagatattgcaccctatgacattggtggcctgatcaagaatttggtgtggcgttggcctgtttgctttttataaaccaaactctatctgaaatcccaacaaaaaaaatttaactccatatgngtcctcttgntctaatcttgncaaccagtgcaagtgaccgcaaaattccagntatttatttccaaaatgtttggaaacagtataattgac

SEQ ID NO: 19466 - DNA, 391 bp, Homo sapiens
  misc_feature 48: n = A,T,C or G
aagagcaggggaatcaaagcaaatgcattcaaaaaactgaataacctnaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgagtaaaggaacttaagtattggtttaatat

SEQ ID NO: 19467 - DNA, 172 bp, Homo sapiens
  misc_feature 57, 92, 101, 131: n = A,T,C or G
agttagctaataaaaagcttttgtctacacaccctgcatatcataatgggggaaagntaagttgagatagttttcatccataactgaacatncaaaatctngatcagttaagaaatttcacatagcccacntacatttacaaactgaagagtaatcaatctactcaaagcat

SEQ ID NO: 19468 - DNA, 264 bp, Homo sapiens
  misc_feature 205: n = A,T,C or G
gcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggncactgctcctctcccctccccacaaaaggaaaaaaaagctggatttgattttttttttc

SEQ ID NO: 19469 - DNA, 369 bp, Homo sapiens
  misc_feature 62, 77, 161: n = A,T,C or G
accactggagactttagctttttgtctgagtgagttggagcacccgttggagggatctgaanggggtgtgatgtggnttaacatgctttctcttaggatcactctggctgctgtgttgcaaatccatagtgggcacaggtggaagcaggaggccagttagnaggtgccttcagcaatccaggcaaaggggttaagtggcttggtccagagcgagcagtggaggtagtaggaagtgtgtgggttctggacagattctgcaggtacaaccagtggatttgatgacaggaaatggaatgcaagaaggaaagagggagttgtcaagaatgacttgagatttaggcctggttacatcagtgtaggcgatattcg

SEQ ID NO: 19470 - DNA, 242 bp, Homo sapiens
ggaagagatctagacatccagatacaggaagcttaaagatacccaaatagattgaacccgaaaaagtcgtccccaaggtatattatcacttgaggaacatttcagcttataactgttgaaagccagacaaaaaaagaattctaaaatcaataagagaaaagtgtcaaatcacatataagggaactcccatcagactaatagattcctcagcagaaaccttacaggccaggagagaatgtgat

SEQ ID NO: 19471 - DNA, 273 bp, Homo sapiens
  misc_feature 30, 81, 169, 174, 202, 261: n = A,T,C or G
ggagagaaaaataagcagaatccaccttgntcctgaacccaggacaactcattttctacaagtatgttgggagaaaacacnggaatctggttttgttattacacttactgatggtcattcagcatggactgggacagtttctgaatcagagatttcccaagaagctgangacanggcaatggaaaaagggaaatatgttggngaactgagaaaagcattgttgtcaggagcaggaccagctgatgtatacacgtttaattnttctaaagagtc

SEQ ID NO: 19472 - DNA, 234 bp, Homo sapiens
gtttggtttcttgttcttgcgatagtttactgagaatgatgatttccaatttcatccatgtccctactaaggacacgaactcatcattttttatggctgcatagtattccatggtgtatatgtgccacattttcttaatccagtctatcattgttggacatttgggttggtccaagtctttgctattgtgaataatgccacaataaacatacgtgtgcatgtgtctttatagca

SEQ ID NO: 19473 - DNA, 300 bp, Homo sapiens
  misc_feature 59, 72, 178: n = A,T,C or G
atggggacaaatgaaggtgaacccaagggtgaaggaaatagcaaattcacctacacagntctggaggatggntgcaccgaaacacactggggaatggagcaaaacagtctttgaatatcgaacacgcaaggctgtgagactacctattgtagatattgcaccctatgacattggtggncctgatcaagaatttggtgtggcgttgccctgtttgctttttataaaccaaactctatctgaaatcccaacaaaaaaaatttaactccatatgggttcctcttggtctaatcttgcaaccag

SEQ ID NO: 19474 - DNA, 432 bp, Homo sapiens
gagtgcaagaagaaagaggcgctgctcactgttttcctgcttcagtttttctcttatagtaccatcactataatcaacgaacttctcttctccacccagagatggcttttccaacacattttaattaaaggaactgagtacattaccctgatgtctaaatggaccaaagatctgagatccattgtgattatatctgtatcaggtcagtagaagaaggaactgagcagttgaactctgagtccatcaattgtaatatttggaaattatctacaatggaatcttccctctgttctctgataacctacttgcttactcaatgcctttaagccaagtcaccctgttgcctatgggaggaggtggaaggatttggcaagctcaaccacatgctatttagttagcatcagttgtcaccaacagtctttctgcaaaggg

SEQ ID NO: 19475 - DNA, 226 bp, Homo sapiens
atcctagcactttgggaggccgaggctggaggattgcctgagctcaggagtttgagaccagcctgggcaacacagtgaaaccccatctacttgggaggttgaggcaggagaatcgcttggacctgagaggcggaagttgcagtgaaccaagatcgcgccattgcactccagcctgggcaacagagtgagactccatctcaaaaaaaaaaaaaaaaaaaaaaaaaaa

SEQ ID NO: 19476 - DNA, 172 bp, Homo sapiens
taatgggtaaaaaatatattatgagttttttatcctcacgtatggtgctaggctatactggatttgggctaacaaaagcttgttaacttttttttgtctcattgacagaagtattttatatctcatattttacattacataggtgtgtgtgtgtgtatgaaataaaagtttg

SEQ ID NO: 19477 - DNA, 369 bp, Homo sapiens
  misc_feature 30: n = A,T,C or G
agactttactttgatttacagatctggagnatctcaaaacagttgttttgtggaaaacactctggcaaactctgagtcttagtcattaaaaatagtttttgggtaaacaacagtgtaatagaaatggaaattactgattcacattgagccatgaagaatttattttcagcaatttttatagaagttgctttatgacaaagaaagctttggtaactggcatttggcatttcacaccactaaattttctacatgtggatttatttctctggtctctcactttctcactcagttatactgaattcatttatgatgagcgctctcaaccattcttattcatcaaagccctgaagttggcagagccctctctgg

SEQ ID NO: 19478 - DNA, 327 bp, Homo sapiens
  misc_feature 286: n = A,T,C or G
gtttaaattcagtaacgtacttgaaaggcaaatttcagtgcttttgtatgttggagaagggcttactgatgcgtgctaagaccgatttctgattgagggatgaaccttgggctcatttttttcttgtgaagtctctttctagaaaattctttggttttgttctttttaaaaaatacatacttttttgaatgtatcatgcttcattaacaacggaaaatccacatggtgtttactaaacttgtttacgacattaaaaatttcctttttatttttaggaagcccaggntgagtttttcacaagagatttttttcttagctgaggatagt

SEQ ID NO: 19479 - DNA, 402 bp, Homo sapiens
aacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgctacaaacaaagtgttacatcttctgcataaaattacctacttaatcaagataagcacgcatttttgttgccttggttttacctgtagactgtggactattttaccttaagacctgaaaaagttt

SEQ ID NO: 19480 - DNA, 420 bp, Homo sapiens
  misc_feature 5, 11: n = A,T,C or G
caaantttggnatgtccatatcagccatgaaaaggaataaaattctgattcatgccacgggtacatactacaatatggttgaacctcagaaacattatgccaagtgaaagggctctgtattgtatgataccatgatatgaaacttttagaacaggcaaaaccttagatcagatcagtactttgcctgggtgtagggtggcagcatggagattggttttaaacaggcacagcggaacagtttgggtgatggaaatgttcctggtgatagttgtgtataaattgtatgaaaacgtgtgcaattgtgtacttaaaatggataattttcatgacatgcaaattatacctcaagaaagccactaaacgtgggtgggccactcaaaatttcaaaattctctttaagatgaccattcaggcaggcat

SEQ ID NO: 19481 - DNA, 482 bp, Homo sapiens
  misc_feature 40: n = A,T,C or G
ggagcaggtcaatttgctcaagatgtcaagttggattgancaggccaggcattgtggtggagtctccatcatcagcgatggggaatgcacagtaaagactgttaggtgtcagcacagaaatgagtcttctcacttgggctgtcctcacatgccttttgctaggaagtggttttggcctcttttggtgcattctttctcacatgtcaatttagaggaaggaactaatgatttgaaggcaaggtctgccttcaacagtgaagtcaaaatgagactgcaggtccactgattgcaccgttcagtgcttttgactctgaagattgttttatcaagtccagctcactgggctggttcatttacttaacaaatatacacagagcccctattatcacccaaattcattctgcgcactgaggatgtcctggtgaacagggttgacaatgggcctgctcttatatttgaatgagggaaactgacaaggatgt

SEQ ID NO: 19482 - DNA, 380 bp, Homo sapiens
  misc_feature 359: n = A,T,C or G
gctgatgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgantttaaatctgtgacaaaccat

SEQ ID NO: 19483 - DNA, 225 bp, Homo sapiens
  misc_feature 25, 28: n = A,T,C or G
gagagcttggttttatgatatccgnggncataccacttttcttatgtgaataaggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgat

SEQ ID NO: 19484 - DNA, 238 bp, Homo sapiens
  misc_feature 6: n = A,T,C or G
gagcgnctgcaattcactgccaatgctctcgctttgccatggagcgggatggctccagtggaggagtgatccgcctggcagccattgcagagtcaggggtagagcggcaagtacttttgggagaccagatacccaaattcgccgttgccactttatcacccgcctgaatcctgggattctagtatgcaataagagatgccctgtactgatgcaaaatttaataaagtttgtcacagag

SEQ ID NO: 19485 - DNA, 339 bp, Homo sapiens
  misc_feature 302, 329: n = A,T,C or G
atattactacccaaatatccattgttgaaatttgtaaaaataaaaatatttaatggcaccctttctagtttattaaaggtaaaaaactgttaacagttcattgtatatttgaaggaatgtatttttaagaaaaactttaataaattcctttagtaatgcctttctctggcatcataaaggagtattccagtgaatttggaagatcgagaggaaaaagtaactaaacggcgttagtcaacagttttgtggcaatgggaaattaaactgggaataacacaaaagaaaaaaaaacctagcttggntctaagtacgagcctaggcaaggaggntacattaaac

SEQ ID NO: 19486 - DNA, 188 bp, Homo sapiens
gaagtgattaaagtagattgcttaaagaattaaagctttaaagatgaaagatgttattgcttttgctggacatgaggaacagttgtaaagtttccaggtctacaataactttctggaaccctctcagtgaactgtttcttgtaaaagttttccctaagataaaagctcaatcccattgtttccacact

SEQ ID NO: 19487 - DNA, 532 bp, Homo sapiens
aaatgtaaagaaggccctgaagctgatggggtcaaatgaaggttgaattcaaggctgaaggaaatagcaaattcacctacacagttctggaggatggttgcaccgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgcaaagaaaaatgatacttctctttttttgctgtccaccaaatacaattcaaatgctttttgttttatttttttaccaattccaatttcaaaatgtctcaatgggctataataaataaactcaacactcttttatgataacc

SEQ ID NO: 19488 - DNA, 212 bp, Homo sapiens
  misc_feature 33, 81, 150, 196: n = A,T,C or G
caggagttttgagaccagcctgggcaacctggngaggcctcatctctacaaaaaatacaaaaattagctgggtgtggtggngtgcacctgtggtcccagctacttgggaggctgaaatgggaggatcgcctggcccaggaagtcaaggcngcagtgagctgtgattgcaccactacactctagcttgcatcagagngagaccctgtttcaga

SEQ ID NO: 19489 - DNA, 105 bp, Homo sapiens
  misc_feature 48, 53: n = A,T,C or G
aaggttattttctacaaactgaatcgatgaggacatggataatatctncatgnatctgagaagtaatctgtatgtggggggaggggataataaatatttctaacc

SEQ ID NO: 19490 - DNA, 439 bp, Homo sapiens
  misc_feature 5, 17, 276, 303, 389, 406: n = A,T,C or G
taganactacccaaaangaaccacagagagaataatggctaatttaaaaaagagacaatcagcgaactgtaggacaatttcaagtgcctcagtattcatgttattcaagttgctgaagaggaggaaagtgggagagttttagactgaaatatttgaaaaaatggtgggaaagaaaattgataaaaacttaacaatatatgtagtaattattactattgtcttcactttacagatagggcaggtaacttgcccaaagtcaaacataaataaactggnggagccgagatttaaaaccttacaggntccatagggtgaatccttgcttttcaccttctctaccctgtaatacatcatctatttccagacttccagctgcttcttcttatggnacaggattgtttctgantactccaactttatgtgtccttacttggcttat

SEQ ID NO: 19491 - DNA, 351 bp, Homo sapiens
tgaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaattgggataatt

SEQ ID NO: 19492 - DNA, 334 bp, Homo sapiens
  misc_feature 117, 178, 204, 260, 265: n = A,T,C or G
gctcttcactgttgcctgcacttttttttccttttttgtaatattgatgacatcaatgtaacatttgagatgtttctgaattactgttgtaatggctaaaatcacataaacgtttgngtcggaatggtgtcctctctttctcttcctttttctctttattaacgatttaaatgtaacnttctgaacacattgcattgaattctncctttaacaaaaagcaaaggcgtaggtaaaagctcaaatgaatttattctttcggnatggnaaaattgaaccaatcacagttaagatgagagatcaacctgagttttaaaatacctttaataaatattag

SEQ ID NO: 19493 - DNA, 283 bp, Homo sapiens
  misc_feature 208: n = A,T,C or G
atttgaactcaggacctttggaagagcagttagcactcttaaccgctgagccatctctccagcccataaagtagccttttaatgagctattcagaaatagctgtggcttatgaaggtaataaaacatccttgttgtacctgttttcttgaattcattgcacccttttgattcttagcaatgattcaaagctgggtgcagtgatgcagncttgtaatcttagcagttgagaagctagatctgggatttgaggcagactgggattatgagaccctgtctcaaaac

SEQ ID NO: 19494 - DNA, 302 bp, Homo sapiens
  misc_feature 30, 126, 147, 235, 276: n = A,T,C or G
aaaacatgacggtgaaaatggatgactttngactcgacttcaaaccattacagctacagagtggaaacaatttgagggtagaggttaggtctgctcttctccataatccctctcagaggatgcagnggtttatacagtgttaatggntcataaccagggtatttgttgaattaatgaataaataaacaaagaaataaatgatgagtgagttgacgaaacaggaacattgattggnagcagtagcgtgaattaaggagtttgttgacccttcctctntgttctgtgagtcataacaaatgaaa

SEQ ID NO: 19495 - DNA, 295 bp, Homo sapiens
  misc_feature 229: n = A,T,C or G
ctctgggtcaggaaagtgaactgtgccaagaagtatttttcaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggctcgagggtggcgncacagcaggatttccgccttctgcattgcactgcacagcccatggaacatgagcacttgaggcctt

SEQ ID NO: 19496 - DNA, 256 bp, Homo sapiens
gagatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcc

SEQ ID NO: 19497 - DNA, 299 bp, Homo sapiens
  misc_feature 213: n = A,T,C or G
aaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattgcctagaagnttgcactgacttgtgttcctgaactatgacacatgaatatgtgggctaagaaataggtcctcttgataaataaacaattaacaaat

SEQ ID NO: 19498 - DNA, 164 bp, Homo sapiens
  misc_feature 11: n = A,T,C or G
cacagagttangcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattacc

SEQ ID NO: 19499 - DNA, 129 bp, Homo sapiens
  misc_feature 19, 60, 124: n = A,T,C or G
agagattaatacaactacntaaaaaatatagcaataggttactaagatattgcttagcgntaagtttttaacgtaattttaatagcttaagattttaagagaaaatatgaagacttagaagagnagcgt

SEQ ID NO: 19500 - DNA, 518 bp, Homo sapiens
  misc_feature 477: n = A,T,C or G
agggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttagggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggantaatcagtatggggaaacaatcttttgtaaatgcaaagctg

SEQ ID NO: 19501 - DNA, 300 bp, Homo sapiens
  misc_feature 170, 273: n = A,T,C or G
aagcccagggaagcttgcccaaagagcgagccataaaactcaagtctggccgggcgcagaggctcacgcctgtaatcccagcactttgggaggcaaggcaggtggatcacaaggtcaggagttcaagaccagcctggccaagatggtgaaaccctgtctctactaaaaanacaaaaaaattagcgaggcattatggcaagtgcctgtaatcccagctacttgggaggctgaggcaaggagaattgcttgaacctaggaggcagaggttgcagngagctgagatcgtgccattgcactcca

SEQ ID NO: 19502 - DNA, 300 bp, Homo sapiens
  misc_feature 43, 54, 181, 201, 204, 205: n = A,T,C or G
atggctgtaaataaattaagatcctaaactctctagcttaagngtaaatgaagnacagtagtttccctactgaaccctgctcttgtgtccctggaaccttctagaacacctgccttctaccctctggttgggagatgcagccaccacatcccttcatatcatactggtttgaataaatttncaaatccttattgtcagagntgnntgggggtctgttcagagcataaaacctaaaggttatagtagaacaaggcaccttcttaaaagaaacttgcttcagaccatcaggtacagagaatt

SEQ ID NO: 19503 - DNA, 261 bp, Homo sapiens
gagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattcccta

SEQ ID NO: 19504 - DNA, 243 bp, Homo sapiens
cccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatg

SEQ ID NO: 19505 - DNA, 360 bp, Homo sapiens
  misc_feature 30, 181: n = A,T,C or G
gtgaagtataaatttagacgcaaagtccgnaatatcaaacaccacaagtgataattatcagcacctggaaataatttgtaccactaagttaagtaaagaattctctttctgctgatggggagattttaacctcatgatcactgaagcactccctgcagtttacagtgatgtatcttgcggntcattcccagtagtcaacatagcaccaagcaattagtagaacactggaggataagtgttagctctgtacaatgtgactaagattaaaccgggagcaaattagagcaaggataattgtccagtttttaagttgctcgaagtccaactcacttacgtattacattgaggttcctgcaaagc

SEQ ID NO: 19506 - DNA, 134 bp, Homo sapiens
aagatgtacgctcttcttaaataagaagttgagaactgccattacactatgtagtttaaaatttatttatttttgaagccggctttgattgtcactttacaagatgtatgccgttttttcccttctttcacacc

SEQ ID NO: 19507 - DNA, 581 bp, Homo sapiens
  misc_feature 484: n = A,T,C or G
gagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgctataatcgctacttcaggaagcgccgagggaccaaatgagactgagggaagaaaaaaaatctctttttttctggaggctggcacctgattttgtatccccctgtaggcagcattactgaaatacataggcttatatacaatgctctttcctgnatattctcttggctggctgcacccctttttcccgcccccagattgataagtaatgaaagtgcactgcagtgagggtcaaaggagagcaacatatgtg

SEQ ID NO: 19508 - DNA, 105 bp, Homo sapiens
attatgttgctcagttactcaaatggtactgtattgtttatatttgtaccccaaataacatcgtctgtactttctgttttctgtattgtatttgtgcaggattct

SEQ ID NO: 19509 - DNA, 426 bp, Homo sapiens
gagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgggggttttctcataaatgagggctgcacattgctgttctgcttcgaagtattcaataccgctcagtattttaaatgaagtgattctaagatttggttgggatcaataggaaagcatatgcagccaaccaagatgcaaatgttttgaaatgatatgaccaaaattttaagtaggaaagcacccaaacacttctgctttcacttaagtgctggccgcaatactgtaggaacaagcatga

SEQ ID NO: 19510 - DNA, 368 bp, Homo sapiens
  misc_feature 348: n = A,T,C or G
gttcgggagtgcttggcaagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacactattgnctccctttaatcttctcttt

SEQ ID NO: 19511 - DNA, 338 bp, Homo sapiens
  misc_feature 304, 323: n = A,T,C or G
tgaggtaaaccatcaagagagaccgagcgtggttttcaactgtggccaatggtacagtggaaaagaaatagtatgaaattggaggtcataccaactaccatgatctcagaatagccctatgaatcacccaaggcaaacattgttaccacattttacagacgaagatatcaacgtttaaagaggtctcaaaagcaaaaatagcagaaagcaagatgtgtagacttaatgaatgtataatggagattcttaatgttttatgacttgtacattttgaaattagtgggtttttttttgtttgctttgntttgagattgagtttcacncttgttgcccaggct

SEQ ID NO: 19512 - DNA, 289 bp, Homo sapiens
  misc_feature 249: n = A,T,C or G
acaatgtttacttgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgctgatactggcattttgtagatgtggnttgactatttctgtatgtctccatctattgatgagggctt

SEQ ID NO: 19513 - DNA, 274 bp, Homo sapiens
  misc_feature 4: n = A,T,C or G
atgngatcttggtcaataactgggagatggacaaactagagatggaagatgcagtcacatttttgaagactaaaatctattcggtagaagctcttcctgttgctgctgtaaatgtgcaaagccaacaataaagtgaaaatcaaccttttcatattaggagacatgcatttgtaaaaattaataaagatgacaagtcagttgtcaatggaattgagctatctgctaagacaaaaaatgttacctcagttcactattaaaattaattttaggagtg

SEQ ID NO: 19514 - DNA, 94 bp, Homo sapiens
acagaaacaaagcatacatcattattctcgcacggactacaaccacgaccaatgatatgaaaaaccatcgttgtatttcaactacaagaacacc

SEQ ID NO: 19515 - DNA, 318 bp, Homo sapiens
tttctggccttggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggctttctatctcttgtactacactgaattcacccccactgaaaaagatgggtatgcctgccgtgtgaaccatgtgactttgcacaagcccaagatagtaagtgggatcgagacatgtaagc

SEQ ID NO: 19516 - DNA, 332 bp, Homo sapiens
  misc_feature 145, 146, 246: n = A,T,C or G
ccaacccacttccatactcccaaataataatgcctatcagattaaagaagttactttatttttgcatgaaattggttgtatttttgttgcactacttcatcctttgagtattgtgaaaagtctgcgcattgactataatagcatnnaaagccaagtttgaaggtctaagataatggcacacatccatgtcctttgctcacaagttctgcctaaagacttcagcctgcttgaaacactctaaaggtngtgaaattaatggatataccactgatgcaacacaactcaggtcaccagctagggaggtaagacatgtcttgttactgagaagggct

SEQ ID NO: 19517 - DNA, 505 bp, Homo sapiens
ggttcctgctgtgccagaaacccttaagaaaaagcgaaggaatttcgcagagctgaagatcaagcgcctgagaaagaagtttgcccaaaagatgctccgaaagcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtaggagccatatattgcatgggggtaccccaatctgaagcagtaaatgaactaatctacaagcgtggttatggcaaaatcaataagaagcgaattgcttgacagataacgcttttgattgctcgatctc

SEQ ID NO: 19518 - DNA, 188 bp, Homo sapiens
acatggagaaactctgtcactattaaaaatacaaaaattagccgggtgtggtggcgggtgcctgtaatctcagctgcttgggaggctggggcaggagaattgctggaacccagttgatggaggttgcggtgagccaagatcgcatcattgcactctagcccaggcaacaacagcaagactccgtctca

SEQ ID NO: 19519 - DNA, 397 bp, Homo sapiens
atcttttatttataatctcatcagatgagtgagttgttcacagatattttatgtttttttaattttctccaagaatatttatagaattccaaagaatcagaatagtttcaaaataattttcagtgataaaagagtgttgtaattaatcatattacactaaaattgggatacatctaaggaactttatcttactatcagtaggttttgcattgatatttctttttaaataaactactagttctttatattttgacaaaaagaacttaaattttatcaggaactgtaagataaatatctagtgcttataaattttctgtccttaaatttatgtgacagtgcaagatacttttgctcttttcatttaatataggcatcttccattgacattaataaaact

SEQ ID NO: 19520 - DNA, 316 bp, Homo sapiens
agatagggattaatacaactacttaaaaaatatagtcaatagggttactaagatattgcttagcgttaagtttttaacgtaattttaatagcttaagattttaagagaaaatatgaagacttagaagagtagcatgaggaaggaaaagataaaaggttctaaaacatgacggaggttgagatgaagcttcttcatggagtaaaaaatgtatttaaaagaaaattgagagaaagggactacagagccccgaattaataccaatagaagggcaatgcttttagattaaaatgaaggtgcttaaacagcttaaagttag

SEQ ID NO: 19521 - DNA, 228 bp, Homo sapiens
aacttttagcatttgattcaagtggagagtgcttcataggtttctagtacctttccctcttgagctcttcttcctacttatagatcctctttccaatccttcaacattcttattagcacagtcatggttagcttagaggttacaatcaattgggggcaaaatcagggagtttacactatggcaacagagaacatctcattttcatgtgtacgtgggagatctttttgg

SEQ ID NO: 19522 - DNA, 458 bp, Homo sapiens
  misc_feature 353, 407, 439, 442: n = A,T,C or G
tctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggngacttaaacagcttaaagttagtttaaaagttgaggtgattaaaataatttgangcgatcttttaaaaagagattaaaccgaaggngantaaaagaccttgaaat

SEQ ID NO: 19523 - DNA, 207 bp, Homo sapiens
tgctgaatgagaaagtaaaaggggcataaattaaatacttactatatggttctttgagcaacatgggaggtgagagtttaataaaatagtcaaggacacatagcattaactgaaatgaaatcaccagatcatcttccatttgtaatacttcccctgaaaaaaaaatgtacatttttaaagaaagttagagattcagatctttgtatg

SEQ ID NO: 19524 - DNA, 337 bp, Homo sapiens
  misc_feature 14, 16, 88, 286: n = A,T,C or G
attttgggggaaanangacaaggttataattgtaaaggatgattggaatggaaagtctcaccagttgcaatagttgaagggagtattngtgaaagcattagggaaaagagtctttcgtttttcatagagtgtcagagactatgactccaaaacagcaggttaaggataagtcaagctttactatcagtttgaaaactaaagatctgatatatttggaatgatagaggaaaacatagtctttgttttgacagtcatttctaagaaaacatccactggtctttatagntacaatatatcattctcaacacataggaaagaatgaaatgaactttttatg

SEQ ID NO: 19525 - DNA, 532 bp, Homo sapiens
agcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgctataatcgctacttcaggaagcgccgagggaccaaatgagactgagggaagaaaaaaaatctctttttttctggaggctgcacctgattttgtatccccctgtagcagcattactgaaatacataggcttatatacaatgcttctttcctgatattctctggctggctgcccccttttttcccgcccccaggattgataagt

SEQ ID NO: 19526 - DNA, 345 bp, Homo sapiens
  misc_feature 9, 61: n = A,T,C or G
gatgttttntctttgaaagatagagattaatacaactacttaaaaaatatagtcaataggntactaaggatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaagggctacagagccccgaattaataccaatagaagggcaatgcttttagattaaaatgaaggtgacttaaacagcttaaagtttagtttaaaagtt

SEQ ID NO: 19527 - DNA, 420 bp, Homo sapiens
gttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggctgcaaagccaatgttggtgctggcaaaaagtgagctggggattggatcacagccgaaggagtaaaggtgctgcaatgatgtagctgtgccactg

SEQ ID NO: 19528 - DNA, 331 bp, Homo sapiens
  misc_feature 45: n = A,T,C or G
tatgactctacccaaaggagatatcagtatttcagggcccaaggncaatgtggaagccccagatgtcaacttggagggtctggggggaaaacttaaaggccccgatgttaagctgcctgatatgagtgtcaagacaccaaagatctccatgcctgatgtagatttgcacgtgaaaggtacaaaggtgaagggagagtatgatgtaactgtaccaaagctggaaggagaactcaaaggcccaaaagtggacattgatgccccagatgtggatgttcatggccagactgcacttgaagatgcccaagatgaaaatgtccaaattcagtgtgcc

SEQ ID NO: 19529 - DNA, 556 bp, Homo sapiens
  misc_feature 463, 499, 501, 543: n = A,T,C or G
cctggctggagcagcgagtctgtcgatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttcttgggaccaaagatctcttcgngattccttgcaacaatcaatgagaatcttcatgtantnccggagaacaccattcctgatttcccacaaactgcctacatnagataactgcatt

SEQ ID NO: 19530 - DNA, 376 bp, Homo sapiens
  misc_feature 279, 338, 342: n = A,T,C or G
gccatggacaatctcagtacatgttgtttgttatgattttattcacgctaaaggaatggggattaaaattaagtgcatataatatagaattcagtttcaagtctgaagttagcgtaaatttagattcttcagactaacataaaacatgattttgagaagttaaataggaagatgcctttttttagaagtttagcatatttagtttatctcccaaatcttgcttagaaatcaaatgtatataagagaagttaggtacagagctagattgattaactactnctttaatgaagatttgctatgaatttgttactctttcataccaccttcagatagctagncagntcagcaggagcagagaccaggttagcacgcggat

SEQ ID NO: 19531 - DNA, 442 bp, Homo sapiens
  misc_feature 59: n = A,T,C or G
taacagtttcattcttttctatagccaggtgaaggaatcataagttccatgaattgggnaaaaaagttttgtatggtggaaaatgtctcagtcataggcttggctatgtgaatgaaatgattttggttcctttgtagtttgatccttgatgaacctgatattcagtgtaaatgtttcactaacaatatgtgtacattgcagtttggtagaagatgtctttctacctacaacaaatgtttttatagtatatatggctaatactatctatgagtaccttagtaaaatatctctaaaatacaggaaaacctttctgctatggatataaaattatttcatctcaggagactttctagccttactactctcattttaattcatcatattattttgaagaaactactattgaaacacaagacatgaaaacaagaagtgaacagacatg

SEQ ID NO: 19532 - DNA, 352 bp, Homo sapiens
  misc_feature 48: n = A,T,C or G
ggagagaggaaagaaaaaaaatatatgctccacaatttatatttaganagagaacacttagtcttgcctgtcaaaaagtccaacatttcataggtagtaggggccacatattacattcagttgctataggtccagcaactgaacctgccattacctgggcaaggaaagatccctttgctctaggaaagcttgcccaaattgattttcttctttttccccctgtaggactgactgttggctaattttgtcaagcacagctgtggtgggaagagttagggccagtgtcttgaaaatcaatcaagtagtgaatgtgatctctttgcagactatagatagaaacagctggaaaact

SEQ ID NO: 19533 - DNA, 379 bp, Homo sapiens
caaacaaattactggaacagagaaaagtgctaataatgagacccacttgtgtatgggaacttgggatataattgtggttgtgctatagtcaataaaatagagtggccaggcatagtggctcacgcctgtaattccagcactttgggaaggcaaggtgggtggatcatttgagcccaagtgttcgacagcaacccgggcaacatagagaaaccctgtctgtacaaaaaatacaaaaaaagtaaccaggtgtggtggtgcatgcctgtagtcccagctaccagggagacttgaggtgtgggaatcacctgagactgtgaggcaaggctgcagtgcgttgtgatcacacctccagcctggcaacagactgagaccctttctc

SEQ ID NO: 19534 - DNA, 149 bp, Homo sapiens
taaagtcattatatgcctgctccgagaaaaacatcatgataggcactcttcggagactggggtagggacaggagaaagtagcaataaatgacatagacaccaaatggagatggggataggggaggagaggagaaggtaacaggataagt

SEQ ID NO: 19535 - DNA, 282 bp, Homo sapiens
aagccattaccaagcaaaactctttcactggaaacaagggggcagtctagaagtaaaagtgaccttaagaagactctttacaggcaacaaatgaagcttttctaagggatttttgcatcagttcagtcataagaatacttttttccagggtaattaggcaatagcttcactgaaatgacagcttttcattgcattatttaatccttatatttggaattgaagtcgttaacttcttttaaagaatgtactattacaaaaaaaaaaaaaaaaaaaaaaaaaaaa

SEQ ID NO: 19536 - DNA, 100 bp, Homo sapiens
gcctgctccacccagagaagcacactttgggagaaccaatgggaaggagcctgagctgctggaacctattccctatgaattcatggcataataggtgtta

SEQ ID NO: 19537 - DNA, 102 bp, Homo sapiens
tccgtgaaggaacaacacctaaacccaagagggcagctgttgcagcatccagttcatcttaagaatgtcaacgattagtcatgcaataaatgttctggtttt

SEQ ID NO: 19538 - DNA, 405 bp, Homo sapiens
  misc_feature 42: n = A,T,C or G
aataggaaagcatatgcagccaaccaagatgcaaatgttttnaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttgggataattatggtgggtgattattttttatactgtatgtgccaaagctttactactgtggaaagacaactgttttaataaaagatttacattccac

SEQ ID NO: 19539 - DNA, 195 bp, Homo sapiens
tacaccatcaatcactgtgttgacaatgagcggaaaagcgaggtatatgtcaggctaacggcatattgcctttttcagtgagggcatggctgtttatagcactttcattggcaaaatacttttgcactggaataggaatagaaaggagaattagaaaggcagccagtggaaagagctttatgttttcaaattatg

SEQ ID NO: 19540 - DNA, 352 bp, Homo sapiens
  misc_feature 200, 315: n = A,T,C or G
ctaaagaaccagccaaagccttaaattgtgcaaaacatactgttgctatgatgtaactgcatttgacctaaccactgcgaaaattcattccgctgtaatgttttcacaatatttaaagcagaagcacgtcagttagggatttccttctgcataaggttttttgtagtgtaatgtcttaatcatagctaccatcaaatatnttaggagtatctttaatggtagatagtatattagcagcatgcaataattacatcataagttctcaagcagagcagctattgcaaggccttctttgctgcagttatcataggctgntttaagttagaaaactgaatagcaacactgaatactg

SEQ ID NO: 19541 - DNA, 555 bp, Homo sapiens
  misc_feature 466: n = A,T,C or G
tgaaagggagagagcaagcagcgagtcttgaagctctgtttggtgctttggatccatttccatcggtccttacagccgctcgtcagactccagcagccaagatggtgaggcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattggctatttaaaacttgnaatttttttaatttacaaaaatataaaatatgaagacataaacccagttgccatctgcgtgacaataaaacattaatgctaacactttt

SEQ ID NO: 19542 - DNA, 442 bp, Homo sapiens
ggaggttgctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcagcaaggcttcgattaacatgctgaggattgtagagccatatattgcatgggggtaccccaatctgaagcagtaaatgaactaatctacaagc

SEQ ID NO: 19543 - DNA, 120 bp, Homo sapiens
gggaataaataattcctgaagaatgaagaagattaattttgggagttctttgacgaactttgatatgtggaaaaggtatttataatttattgtaagaagaaagtaaaatattactagtgc

SEQ ID NO: 19544 - DNA, 354 bp, Homo sapiens
  misc_feature 59, 61, 81, 90, 94, 99, 118, 121, 138, 152, 154, 166, 187,188, 193, 199, 211: n = A,T,C or G
gaattaatccacatatttgccatttctgatgctcttcaattctttctgtggatttaagncngatgtgttttcctttcagcntaatgggcntccnttagngtttgtttaaggcaggtcnacnagcaaaaaaaattttcncaatatttggttancngggaatattttnttcatttttgaaggatagttnngctgncttctnggcgacagctgnatctttcagctttttgaatatgtgatttccctgctttcttgcctctattgttctaactggaagttagccactaatctctgcatatgctgaatcattattctcttcctgcttcaagattttctccttggtttgctttcaacaag

SEQ ID NO: 19545 - DNA, 422 bp, Homo sapiens
tggtagggcagctcaagagagcccacgaactgctgggtatacagaaatgtccagaggccggagagcgtttcagatcacatgtaccggatggcagttatggctatggtgatcaaagatgaccgtcttaacaaagaccgatgtgtacgcctagccctggtcatgatatggcagaatgcatcgttggggacatagcaccagcagataacatccccaaagaagaaaaacataggcgagaagaggaagctatgaagcagataacccagctctaccagaggacctcagaaaggagctctatgaactttgggaagagtacgagacccaatctagtgcagaagccaaatttgtgaagcagctagaccaatgtgaaatgatcttcaagcatctgaatatgaagaccttgaacacaaacctgggagactgca

SEQ ID NO: 19546 - DNA, 450 bp, Homo sapiens
tagacgggtacaatagtcgcaggctcagtctgcttagtctgcttagaatccctggaaggccctctagaaagataggcacaaataaagctagactgcaaagagtaaaataaatacataattctgcagcatgtagatatcatcgggtgtccacaagtattaagaacattcatggaaatacgacctcaccaaatggcaaaatgagatgccgaagaccaatcataaaatgacagagatgtgtgatctcacaaagatttctaaattgttttaaggaagttcaacatacttcaagaaaacactaagatcaattcagaaacttatcagagaaatttaatagagagattgaaatcattcttaaaaattaaccagaaatcctggactgaaaaatacaatgattgaaaggaaaatgaaaaaatgtaataaagagcatcaacagcagaattgatcacacag

SEQ ID NO: 19547 - DNA, 292 bp, Homo sapiens
agtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagt

SEQ ID NO: 19548 - DNA, 550 bp, Homo sapiens
ataggagaaactgtgaccttggtttaggcaaagagcaatccacatttttaaaaattataatttagacttcatcaaaattaggaacttctgttcttcaagagatactcttaggagaatgaaaggccaagtgacagtctgggaaatgttattttcaaatcacaaatctgataaagggcctgaatccagaatagtaaaagatctctcaaaactcaataagaagaaagcactcccaaaaatggaaaaaagattttgaagagatactgaaatgaacaacaacaaaaaaaactaacatgagcagacacttaaaatatatagatgacaggcacatgtggagatgctcagcctcttttagtcattggggaaatgcagattaacactataatgaaataccactgcacacctattaggatagttaaagtttttaaaaacacgacaaaaactgatcataccatgtgttggcaagtctagcagaatctgagtctcttcacactgctgggggaaatgtaaactgatgcaccacttaaaagttaaacatatatgacctaggcat

SEQ ID NO: 19549 - DNA, 384 bp, Homo sapiens
ataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggtgtccaagataggaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgtcaagctcaacacccactacct

SEQ ID NO: 19550 - DNA, 390 bp, Homo sapiens
gttgatgagggaggggaaactgttttttttctatagacttttttcagataacatcttctgagtcataaccagcctggcagaatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctatagccacaaaaataatgaattgatgagaaatacaatgaagagcaatgtccatctcaaaatactgcttttacaaaagcagaataaaagcg

SEQ ID NO: 19551 - DNA, 475 bp, Homo sapiens
aaacctatgaaaaaatgctcatcatcactaatcatcagagaaatgcagatcaaaaccacaatgagatagcatctcacaccagtcaggaatggccattattaaaaagccaaaaaaacaacagatgccgattgggctgcagagaaaaggaagcacttatacactgtcggtgggaatgtaaattgtttccgcctttgtggaaagcagtttggagttttcccaaaaaaatttaaaacagaactaccatttgacccagcaattcaattactgggtatacatgccaagtgaaatagatcattgtatcaaaaaaatgcatacactcatatgtccattgctgcactattcataatagcaaatacatagaatcaacctacgtgctcatcagtgatggctggataaagaaggtgtggtacatatataccatgaaatattatgcaaccataaaaaagaatgaaatcatgtcctttgcagcaacaca

SEQ ID NO: 19552 - DNA, 308 bp, Homo sapiens
gaaatcacagaaaggcggccaggagcagtgtctcatgcctgtaatcccagcactttgggaggcccaggcgggcagattgcctgaggtcaggagttcgagaccactctggccaacatggtgaaaccccgtctctactaaaaatacaaaaaattagccgggcttgatgacgtgtgcctgtagtcccagctactctggaggctgaggcaggggaattgtttgaaccagggaggtggaggttgcagtgagccgagatcgtgccgctgcactccagcctgggcaagagtgagactccatctaaaaaaaaaaaa

SEQ ID NO: 19553 - DNA, 259 bp, Homo sapiens
  misc_feature 201: n = A,T,C or G
tgtgcataaattcattctgtaggatcttaagaaaaagagtcccagaatgttgcttctattattgtgcacaaccattgagaggtgttacaagaatgcagttaattttaacatgtgtgatgtgccatggtggaaaagtactatcggaataactctgcagtgacagaatttgaagtttggctagcatccatacttttctactgnaaatatttcactctcctctagctatccttgatgagcttctcactttaaagaataaatg

SEQ ID NO: 19554 - DNA, 402 bp, Homo sapiens
agtatatttataaacagaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgtctgggcagaccttatccaaagtctggtacaactgtccc

SEQ ID NO: 19555 - DNA, 463 bp, Homo sapiens
  misc_feature 86, 170, 190, 222, 225, 241, 406: n = A,T,C or G
aaatcaacaaattagttcaagcataagatgaaaacagaatattctgtggttgccagtgcacacttaccttcccacccatacacatncatgttcactgtaacaaactgaatattcacaataaagcttctgagtaacactttctgattactcatgataaactgacatggctnactgcaagaattaaatgttntatctgagagtaataatttatgatgactcagnggngccagagtaaagtttntaaaataacattcctctcacttgtaccccactaaaagtattagactacacattacattgaagttaaacacaaaattatcagtgttttagaaacatgagtcccggactgtgtaagtaaaagtacaaacattatttccaccataaagtatgtattgaaatcaagtgnctctgtgtacagaatacatacttattcccattttaagcatttgcttctgttttccct

SEQ ID NO: 19556 - DNA, 349 bp, Homo sapiens
cagaaaaagtaaaatctcccaaaataaaaatagaaggaattaaaaataaaagcagactccgggtgcagtggctcatgcccagcactttgggaggccgaggcaggtgaatcacttgaggtcaggagtttgagaccagcctcgccaacatgatgaaaccctgtttctactagaaataaaaaaattagccaggtgtagtggtgtgcacctgtaattctggttacttgggaagctaaggcagaagaatcacttgaacccgagaggcagaggttgcagtgagccaagatcatgccattgcactccagcctgggtgacagagcaagattataaagtcttctcaataaaatcgtcg

SEQ ID NO: 19557 - DNA, 276 bp, Homo sapiens
aagcaaagcaaaggaagagcatatgaaagtaaggaaggaaagatatgaaaataatgataaatacagagatagagaaaaacgagaggtagggtgttcagtcttcagaaagaaatcaagacagaaaggaaagcagcccaaattctaggacaaaggataaatttcttgaccaagaaagatccaacaaaatgagaaacatggtaaagggcaatccagagaccaagagaaccattacactgaccgtgattaccggaaagaaagggattctcataggcacag

SEQ ID NO: 19558 - DNA, 263 bp, Homo sapiens
  misc_feature 103, 236: n = A,T,C or G
gagctataacttttgattatattaaactgcctccagctgtactatgtaaaacagatttacttttaaaaattacagtatacctgctttgtctatatgtatatgnttaactcatgaagtggactcttagaaggatttgaaatggctctggcacagaatttgtgagcagacagtaggtaggtgataataataaaagaggcaatcaaaatttaattttatcatgccctctcacaggttgnggtataattgtaaggcccatattactt

SEQ ID NO: 19559 - DNA, 386 bp, Homo sapiens
  misc_feature 157, 186, 232, 257: n = A,T,C or G
atggaggctatgattctgattttagtgatgatgaacactgtggagaatccagcaaaaggaaaaaaaggacagttgaagatgacttactgctccaaaaaccatttcagaaagaaaaacatggaaaggtggcccataaacaagttgcagcagaattgcnggatagggaagaagcaagaaatagaaggnttcatctcatagctatggatgcttatcaaagacatacaaagttcgnaaatgactatattttatactatggnggcaaaaaagaagacttcaagcgtttgggggaaaatgacaagacggacttggatgtatacgagaaaatcatagattcctatggaatgaggaggacgaaatggacatgcttgggagaagagcttgctaag

SEQ ID NO: 19560 - DNA, 214 bp, Homo sapiens
  misc_feature 91: n = A,T,C or G
caaaactccagtagaaggtgcccagacttcatttatttggcctcttcacctgaggtaagaaggagtgtcaggaagatactttggggattgnaaagaggaagaactgttgcccaaagctatggatgaatctgttgcaagaaaactctgggatatcaagtgaagtgatggttgcctgctaaaataggaacaaggagtaaaagagctgttataaaac

SEQ ID NO: 19561 - DNA, 342 bp, Homo sapiens
  misc_feature 39: n = A,T,C or G
ccagaacttacggactttgtttcaagtgcagccctctgntggatcctttgcagtttttgaaagtaccttcaatgaggaattcagagaccaggaaacagtgcgtccagcaggctgttactggaactaagaactggcctgcgtgactcttgagtaaaggaagggagtgtacactgggagcaagagctgagtctggaagcggcttatttccatcaaacagctgaaactcagtagcatccgctaacataatgataatgcaaaagtccgtttccggattacacttcagaatattctttatcctaaatactcttctgtgttctagattaagattaagactccaaaagg

SEQ ID NO: 19562 - DNA, 335 bp, Homo sapiens
aacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctctgcataagcctgcgtcagattaaaacactgaactgacaattaacagcccaatatctacaatcaaccaacaagtcattattacccccactgtcaacccaacacaggcatgctc

SEQ ID NO: 19563 - DNA, 202 bp, Homo sapiens
  misc_feature 31, 36: n = A,T,C or G
attgaaatatttcacttgtactgttgctgantaaangcatcttcttgaagagcaagagtctgtacattattaagcttagaaagtaagcaaaactgatttactggtttgcctttcagtttgttgaaatgtattgtcaagtactgtacaatgaaattgtttaaattttaatatgatttaagctttttagaaattaaaatatttt

SEQ ID NO: 19564 - DNA, 285 bp, Homo sapiens
ttaaggtataaaaacaaagaggaataattccattgaaccttgattctggaaactttgatccacccagcagtcatgatgttagactcattgaaaagaatgtatttctaatgcatgatgcgatcggtctatagatgtgtcatggaaacttggttgcaacttcaagacaaaataaaaagtaaacatttacatgaaaaatggtggatatggaaggtggagaagagaggagataacagctttatctttcaaaatagagaattgagagatggtaccaaaagctgatgaagt

SEQ ID NO: 19565 - DNA, 125 bp, Homo sapiens
gcagcatggttactaacgctatgtcagactaatattaaaatcagaaaatttaaatgctggtgctggtcagactttttttgttagattctctcatttaaaaaaaatactgtttgtttaaagcatgc

SEQ ID NO: 19566 - DNA, 486 bp, Homo sapiens
acggaaaacctcaactgcaatcaagaaagcctgtgcccctgtaggatgcagtgaagaccttggaagagacagcacaaaactgcacttgatgaattttactgcaacatacacaagacatccccctctcttaccaaatggcaaagctctttgtcataccacatcttcccctttaccaggagatgtaaaggttttatcagagaaagcaatcctccaatcatggacagacaatgagagatccattcctaatgatggtacatgctttcaggaacacagtcttatggcagaaattctctggaagacaattcctgggtatttccaagtcctcctaaatcaagtgagacagcatttggggaaactaaaactaaaactttgcctttacccaaccttccaccactgcattacttggatcaacataatcagactgctttataagaattaatttggaagagatcacgatttcaccatgaggacacttatctctttcag

SEQ ID NO: 19567 - DNA, 115 bp, Homo sapiens
  misc_feature 50, 85: n = A,T,C or G
ggaaaacagggctggtattcctacccaggaacctcctttgagcatagagntagcaaccatgcttctcattcccttgactcatgtnttgccaggatggttagatacacagcatggt

SEQ ID NO: 19568 - DNA, 482 bp, Homo sapiens
  misc_feature 107, 118: n = A,T,C or G
tgaacgagatcaccaaagtgcgaaaagttactttcaatggactgatccagatgattgtcatagaactgggcaccaatccgctgaagagctcaggaattgaaaatggngctttccaggnaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggcaacacgcctcatctgagggagcttcacttggacaacaacaagcttaccagagtacctggtgggcttggcaagagcataagtcatccaggttgtctaccttcataacaacaatatctctgtagttggatcaagtgacttctgcccacctgggcacaacacc

SEQ ID NO: 19569 - DNA, 290 bp, Homo sapiens
  misc_feature 60, 266: n = A,T,C or G
tatactcgggcagagaaagagtgcaagatagaatatgatgatttcgtagagtgtttgctncggcaagaaaacgatgagacgtgcaggtaccatcaggaagcagcgggataagctgataaaggaaggaaagtacacccctccacctcaccacattggcaagggggagcctcgccctgaacagagcagctgctgatgtctggagctgattttcctgttctctgtctccactggaaaggttgttacgacaaacctccttgcaaagtggnaaaaataaaggattgctccatcct

SEQ ID NO: 19570 - DNA, 234 bp, Homo sapiens
  misc_feature 116: n = A,T,C or G
tgcctgtaatcccagcactttgggaggctgaggcggggtggatcacaaggccaggagatcgagaccatcctggctaacacggtgaaaccctgtctgtaccgaaaaatacaaaaaantagccaggcatggtggcgggtgcctgtagtcccagctatgggaggtgcttgcagtgagccgagatcatgccactgcactccagcctgggtgacagagtgagactccatctcaaaaaat

SEQ ID NO: 19571 - DNA, 308 bp, Homo sapiens
cgtagggccgccatgttgcagcaggatagtaatgatgacactgaagatgtttcactgtttgatgcggaagaggagacgactaatagaccaagaaaagccaaaatcagaatgtcacaggtagactaatgggtggcctacgttggtggaatcacattgatgaagatggaaagagccattgggtgtttgaatctagaaaggagtcctctcaagagaataaaactgtgtcagaggctgaatcaagaatcttttggttgggacttattgcctgtcagtactgtgggtgatatttgcctttagtgcactcttct

SEQ ID NO: 19572 - DNA, 304 bp, Homo sapiens
ttagctctgatctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgag

SEQ ID NO: 19573 - DNA, 338 bp, Homo sapiens
acccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgctttaataaaagatttacattccaaaaaaaaaaa

SEQ ID NO: 19574 - DNA, 316 bp, Homo sapiens
caaataggagtctttttctgcaatttgtttgcattttttagaagtgcaaacagtaagtaaataaaagccttcggtaataatcatgactatacaagaggctgagctaggctacaggggaaaactattgtgttgtaaagttgcatcgctattttatattaaaatataatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgt

SEQ ID NO: 19575 - DNA, 340 bp, Homo sapiens
taaggatgcatctgctaaatctgatagaatgacaagatcccacaaaagtgctgcaggatgattacaatagaattggttcttcattatatgctttaggaactcaggattctacagatatatgcaagttttttctcaaagtttcagaactgttcgataaaacaagaaaaatagaagcacgagtgtctgctgatgaggacctcaaactttctgatcttttaaaatattactcaagagaatctcaagctgctaaggatctcctgtatcgaaggtctaggtcactagtggattatgaaaatgctaataaagcactggataaagcaagagcaaaaaataaagatgt

SEQ ID NO: 19576 - DNA, 419 bp, Homo sapiens
  misc_feature 369: n = A,T,C or G
atcaaaagagacaaaagacatcttcgaatccatattcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggnttttgtatatttattgatggatcaataataatgaggaaagcatgatatga

SEQ ID NO: 19577 - DNA, 366 bp, Homo sapiens
  misc_feature 245, 364: n = A,T,C or G
gtatgcaactgaaaatgacaagtcacataggcacaacatggggaagtctcatacacaataggaatcatttcttgtaatgcacataagcatagcttccaagtcctctcaagagataccacacaggtggctaaggcctgtgttttccagtcagtttttatactctactcacagttttccatttcagatgtcgtttaccagtcaaggatcgtatgttttcagtaaataacattgcttagcaatatagnggggacatttctcttagaatttttttttgtgattcagtacacttttagggcaacagtgatgggagaaggtaaacccaatgtcatcttcaaatggacatgttaaccatttattcccagangg

SEQ ID NO: 19578 - DNA, 111 bp, Homo sapiens
  misc_feature 14, 67, 88: n = A,T,C or G
tcccaaagtgctgngattacaggcgtgagccactgcacccggctctgtttactttttgtacaacggngatagcagctcttaagtatanccatttgactggatcataaatca

SEQ ID NO: 19579 - DNA, 111 bp, Homo sapiens
  misc_feature 54, 79: n = A,T,C or G
gaaaatcaagagacctcctcctcctcctcctcttcctcttcttcttcaacaatncggaaaatcaagtcttccaaaaatncagctgctaatagagaattacagaagaaactc

SEQ ID NO: 19580 - DNA, 117 bp, Homo sapiens
  misc_feature 80, 90, 93: n = A,T,C or G
aagagtgccaattactgctttgcctctcgcctaaagaatacaaggactgctgctcttatcagaggcagctctaggccagngaaatgaacnacnagaggccaatcctaaggccgaagg

SEQ ID NO: 19581 - DNA, 300 bp, Homo sapiens
  misc_feature 238, 272: n = A,T,C or G
gaaacagcaaaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaattttttttaacattcctcatgaatgtaaatttgnactatttaactgactattcttgatgtaaaatctngcatgtgtataaaaataaaaaagatccc

SEQ ID NO: 19582 - DNA, 398 bp, Homo sapiens
  misc_feature 2, 134, 354: n = A,T,C or G
tnttttctctttgaaagatagagattaatacaactacttaaaaaatatagtcaatagggttactaagatattgcttagcgttaaagtttttaacgtaattttaatagcttaagattttaagagaaaatatgaangcttaagaagagtagcatgaggaaggaaaagataaaaggttctaaaacatgacggaggttgagatgaagcttcttcatggagtaaaaaatgtatttaaaagaaaattgagagaaaggactcagagccccgaattaataccaatagaagggcaatgcttttaggattaaaatgaagggggacttaaacagcttaaagtttaggttaaaagttgtaggtgantaaaataatttgaggcgatcttttaaaaagagattaaaccgagg

SEQ ID NO: 19583 - DNA, 512 bp, Homo sapiens
  misc_feature 335: n = A,T,C or G
agacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggangggaagggatgtgagatgatctgttactgcaacttcagcgaattgctctgctgcccaaaagacgttttctttggaccaaagatctctttcgtgattccttgcaacaatcaatgggaatcttcatgtattctgggagaacaccattcctgatttcccacaaactgcactacatcagta

SEQ ID NO: 19584 - DNA, 385 bp, Homo sapiens
  misc_feature 279, 297, 317: n = A,T,C or G
atgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactgcaagtggaaatgtttaaacagtcaagtgatctttagngcattgttatgtgtgggnttctctctcccctcccttgncttaattcttacatgcaggacactcagcaagacacacgtatgcgaagggcagagaagccagacccagc

SEQ ID NO: 19585 - DNA, 172 bp, Homo sapiens
  misc_feature 25, 98, 125, 139: n = A,T,C or G
ttttaaatgaagtgattctaagatntggttgggatcaataggaaagcatatgcagccaaccaagatgcaaatgttttgaaatgatatgaccaaaattntaagtaggaaagcacccaaacacttcngctttcacttaagngtctggccgcaatactgaaggacaagcatgatc

SEQ ID NO: 19586 - DNA, 424 bp, Homo sapiens
  misc_feature 31, 51, 189: n = A,T,C or G
aatgactctcaacagtcgcttttgacctttncccctagatctttagcagtnaaggagtttttttcaaagcccaagtataaccacattttgaaaccagaagactgtctctctgaaccgtgcactatattgcagttggacatgagaaccgtgcaaatttctgatctagaggtgagaaaaagatgaattgcnccttacattcgataatcagtgaccacgaaacactcagaccagagcctggcttatcaaaaaccttcagtgagtgctgggggtgtgagtgaataactaattattttattatgcaaataagtgaatttataaaacgtttgctactgattttttccagcttttttcttttctacggtctattttgattctttcatattggacaccattttatgtctccagcgcttcatttagatttatg

SEQ ID NO: 19587 - DNA, 318 bp, Homo sapiens
  misc_feature 30: n = A,T,C or G
ttccaaaactatatacgtatagtctttttncaaataaacagtggccaccaagaaaaattacagcagttcacataagacataccgtatacatgatactcaactttgtctatatcctttgtgttcaagtttctagaaattttcatctttgtaaggatatcatgtgagtgtgctcaaggtttgttctaagaatctagctgagcacagtggctcatgcctgtaatcacaataccttgagagtctgaggcaaaaggaacatttgagcccaggagttcaagaccagcctgggcaacatagggagacccccatctctattaatct

SEQ ID NO: 19588 - DNA, 327 bp, Homo sapiens
  misc_feature 7: n = A,T,C or G
ctgttgncacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggagggcaaatattggcaattagttggcagtgcctgttaccggttgggattggtggggtgggtttaggtaattgtttagtttatgattgcagataaactcatgccagagaacttaaagcttagaatgg

SEQ ID NO: 19589 - DNA, 322 bp, Homo sapiens
aaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggcttaagg

SEQ ID NO: 19590 - DNA, 171 bp, Homo sapiens
gggaaagctcacctgtcccctgccctagttgactgcctggtgttgatgcctggtaaatgcattgtaaaagcagcaatgtacagcattcagctgagaggtccatttttatgcatggctttatttacagactctggcaaagagtggcattcaataaatatggattaagtaaac

SEQ ID NO: 19591 - DNA, 140 bp, Homo sapiens
  misc_feature 31, 36, 84, 89, 100: n = A,T,C or G
tcagtttgtcctttttcagctggaggggttnatggnggaagctgtactttgctttccagtgaatcaatgctgtcgtccatgtgntctcnccttgcttgtntgtatgaatcactgaagggctccaaaacaaacaaacaaac

SEQ ID NO: 19592 - DNA, 113 bp, Homo sapiens
aggagagtgagagtagcattgtgtataccgccattttcatctcctttaatcacctcactcactgtgcatgtgtgtgtgtgtgtgtgtgtgtgtgtgtgtgtgtgtgtgtgtgt

SEQ ID NO: 19593 - DNA, 286 bp, Homo sapiens
ttgttcgcggcctataggctactgcagcactggggtgtcagttgttggtccgacccagaacgcttcagttctgctctgaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctg

SEQ ID NO: 19594 - DNA, 303 bp, Homo sapiens
ctgttggtttcaactcagaaggagaatgttgttgcttgagcctcttttgagctttaaaaaggacaagggaaggcactgtacagagtgttttacttttgacttttttttcatgactacaaactgttggatattgaaaaccttgcatttactcgtgaattgccagtctgtgtttgcgtatggaggaaggtaagatttgcagggctggaattattttcattttccttgtaagtttctccagtacttagcttttcattgagcattctatatttatttctgtgtcattatgtcattctttgggcattt

SEQ ID NO: 19595 - DNA, 181 bp, Homo sapiens
  misc_feature 168: n = A,T,C or G
ttgccagcagaagatagaaaaaaatcaaatcactgattattaaaaacagttttgttggctgggcgtggaggctcatgcctgtaattccagtactttgagaggccaatgtgggcggatcacgaggtaggagtttgagaccagcctgaccaacatggtgaaaccctgtcnctactgaaaatac

SEQ ID NO: 19596 - DNA, 108 bp, Homo sapiens
cttgggaagctgagatgggagcattgtttgaagccaggaggtcaagactgcagtgagtgttgatcatgccactgccctttcgcctggatgacagagtgagaccgcctc

SEQ ID NO: 19597 - DNA, 300 bp, Homo sapiens
cccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgcgcataaggaaaggttaaaaaaa

SEQ ID NO: 19598 - DNA, 278 bp, Homo sapiens
ccactgcacctggcccagatgatataatttaactgtgttttaggtaacatgttaatgagggaaaatgtttaccagtgtagcattggatcaaaaagtttatcacacagtgttttaataaatggtttattctgcttaccttatttgaattgtcattataattttatatgcaaccttaatttgtcaagtaaatactttcatttaatttgaaagaattcatattcatttgctctttcatttgacaataataaaatttaaggttattacctgaaaaaaaaaaa

SEQ ID NO: 19599 - DNA, 338 bp, Homo sapiens
aagtattgtaccagagtattaaaagatatgtaatattttattgataaatctatcctttaaaaggaatacgttttaggatgcatcattttggtgtgaatcatgtaaatgttgataatatgctgtttattatacatttagtgtttcaagagattcacttaattgcctttttgcccacgtatattatgtagtctatttgcaactgttcttaaaaaaatgacattaaaagaatagtttatgtagagaaacattagtggatgttaattgctccccacctatatttatgggtgttagcgcaactgctttgctagttgcaaagctgtattatcagagtaaaagtg

SEQ ID NO: 19600 - DNA, 310 bp, Homo sapiens
cctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctggcaacgtgctggctgtgtgctgcccatcactttggaaagaattcaccccaccagtgcaggctgctatcagaaagtggtggctggggtggctaatgccctggccacaagtatcactaagctcg

SEQ ID NO: 19601 - DNA, 144 bp, Homo sapiens
ttagaataagaatttgcatacttacctagtgaaacttttctagaattatttttcactctaagtcatgtatgtttctctttgattatttgcatgttatgtttaataagctactagcaaaataaaacatagcaaatggcatcactg

SEQ ID NO: 19602 - DNA, 338 bp, Homo sapiens
taataaatggtttatagtagaaattaataagacaaaattgaatttttagacgatgactcaggcagcaaaatggaagatggactgaaatagaggaaatatgcaaggcagagatgaattagaagctcttgtagtagtttagggagagatgagaaggcctggatcaaaataattgtggtaggatggagagatgtgactggcttccagagatatttctgaagcagaaattggagatctcctatgtggatagagataattttatctgaccatgtgttaagttccctggttgtgaaaatacatgagataaatcatgaaggccactatcatcctccttctgcttg

SEQ ID NO: 19603 - DNA, 318 bp, Homo sapiens
cacgaaaaggagaagtcacagcacctagaaggcagcgcttcctcttcactctcctctgattagatgaaactgttaccttaccctaaacacagtatttctttttaacttttttatttgtaaactaatagaggtaatcacagccaccaacattccaagctaccctgggtacctttgtgcagtagaagctagtgagcatgtgagcaagcggtgtgcacacggagactcatcggtataatttactatctgccaagagtagaaagaaaggctggggatatttgggttgcttgggtttgaatttttgcttgttggttggttttg

SEQ ID NO: 19604 - DNA, 345 bp, Homo sapiens
gacacaactgtgttcactagcaacctcaaacagacaccatggggcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgaga

SEQ ID NO: 19605 - DNA, 303 bp, Homo sapiens
cttaagtgatactctcacctcagcctcccaagtagctgggactataggtgcacactactgtgcctggctcaagtttcatttttaaaatcctgttgcaaaggtagtttaaatgaaaatactgaccaggcgcagtgctcacacctgtaatcacagcactttgggaggccaatatgggtggatcacctgaggtcgggagttcgagaccatcctggccaacatggcaaaactccatctctactaaaaatgcaaaaattagccaggtgtggtggcacgcctgtaatgccagctattcaggaggctgag

SEQ ID NO: 19606 - DNA, 434 bp, Homo sapiens
ttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgccaaaagacgttttctttggaccaaagatctctttcgtgattccttgcaacaatcaatgagaatcttcatgtattctggagaacaccattcctgatttcccacaaactgcactacatcagtataactgcattctaggttc

SEQ ID NO: 19607 - DNA, 309 bp, Homo sapiens
gatttcagtacaagattttctaaatcagttgctacaaaaactgattgggttttgtcacttcatctcttcactaatggagatagctttacactttctgctttaatagatttaagtggacccaaatatttactaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaagtatttgaatagt

SEQ ID NO: 19608 - DNA, 196 bp, Homo sapiens
agatgtacacaatcttttgcctttatttcgtaaagttttatacagaagagagaagagcatgtctttacttgaaaaactcttgatcaagaatttgggtgggagaaaagaaagtgggttatcaagggtgatttgaaattttctgcagcattaaagctggcgcttaataagaataagtaataataaagaaatttctaac

SEQ ID NO: 19609 - DNA, 202 bp, Homo sapiens
gaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgg

SEQ ID NO: 19610 - DNA, 246 bp, Homo sapiens
  misc_feature 188, 201, 217: n = A,T,C or G
tacaaaattgggggtattggtactgttcctgttggccgagtggagactggtgttctcaaacccggtatggtggtcacctttgctgttgacagcaaaaatgacccaccaatggaagcagctggcttcactgctcaggtgattatcctgaaccatccaggccaaataagcgcggctatgccctgtattgnattgccacacggntacattgcatgcaagnttgctgagctgaaagaaaagattgatcgc

SEQ ID NO: 19611 - DNA, 229 bp, Homo sapiens
  misc_feature 28, 30, 67, 186: n = A,T,C or G
tattcaataaatggggcttgggataacngnctggccatatgtagaagatcaatactggacccctttnttataccatatacaaaaattaatatggagtaaagatttaaatgtaaaacccaaagctataaagattctggaagacaacctaggcaataccattcaggacataggcatgacaaagatttntgacagacaccaaaggcgattgcaacaaaggtttttaaaaaaa

SEQ ID NO: 19612 - DNA, 235 bp, Homo sapiens
atttgtgtcttagatgaaacaatattttttattaaattgactgttttaaagtgtgtgttggggggtgcttgtgtgcatttgtattagctattctgtgtatcctattcttagtctgtggtacatggatttcttggtagagagcagatatgaaccccaattttgtatcaggtgatagtctacaggttttatcagattctctgataggtttgagggaaaaaaaaaaaaaaaaaaaaaa

SEQ ID NO: 19613 - DNA, 106 bp, Homo sapiens
aacttgagatgtatgaaggcttttggtctccctgggagtgggtggaggcagccagggcttacctgtacactgacttgagaccagttgaataaaagtgcacacctta

SEQ ID NO: 19614 - DNA, 347 bp, Homo sapiens
tgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaaa

SEQ ID NO: 19615 - DNA, 292 bp, Homo sapiens
ggcacattcacttctcccactcttggcatgtaagaaataagcatttacataattggaaaaatctggatttctgatgccaaagggttaaagcttcttggatttcacttcattgatatacagccactattttatttttgatcagtggcctttgggccactgttcagggtactgaccatcagtgtcagcattagggttttggtttttgtttcttttgggtctttcttttttggcacatgtgaatcttgttttgtgtaaaatgaaattactttctcttgttctctgatgatgggtt

SEQ ID NO: 19616 - DNA, 327 bp, Homo sapiens
aaggtgttgaggaggaggctgaaaagagaaaatgaaattgatagattatccaatttgctagagcatctgagaggggtggcagatatgagtaccatttggaaaagaaccaaagcaattattaactactagcaaaacagaagttgagccgtaaagcaaatatgtatatattacatacatagtaaataagatttatatatagtaaaaatatgtaaacagtgattgttaatttaactaaaaattgtgatgtaactaggtgaaaaaagggaactggagatcagtataagataattaaatgtttattatgataagaaatgaatagataatggc

SEQ ID NO: 19617 - DNA, 208 bp, Homo sapiens
gaggaagctcagaaggttagttccaaatgtgtgtctcccgctgaacagaagaaacaggtagatgtaaatataaaattatggaaaaacggattcaccgtcaacgacgatttcagaagttattccgatggtgccagtcagcagtttttgaactccatcaaaaagggggaattaccttcagaattacagggaatttttgataaagaagagg

SEQ ID NO: 19618 - DNA, 342 bp, Homo sapiens
acaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccag

SEQ ID NO: 19619 - DNA, 416 bp, Homo sapiens
taatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgccaagatagaatcttagttcaactttaaatttgcccacagaaccctctaaatccccttgtaaatttaactgttagtccaaagaggaacagctctttggacactaggaaaaaaccttgtagagagagtaaaaaaatttaacacccatagtaggcctaaaagcagccaccaattaagaaagcgtcaagctcaacacccactacccaaaaaaaaa

SEQ ID NO: 19620 - DNA, 328 bp, Homo sapiens
atatgaagtgtgtagagagtttcctattattacttccaggttggagatgagattggtcttcataagaattaactgacaatgtttacgaattcacacagctaacatacaatagagtcagaacttgaactctggtttactggctccaactccagtattctttccactactctgcgaaaagtatattatttttaagttggcattagcttcttcaaattaccacgtgttattttattatttttcaaagtcaagtccttttaaagaggaccaaatatcttataaaatcttttaaatatatatatacttagcatacacaaaaatagaataatgg

SEQ ID NO: 19621 - DNA, 205 bp, Homo sapiens
aatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgtcaagctcaacacccactacctaaaaaatcccaa

SEQ ID NO: 19622 - DNA, 317 bp, Homo sapiens
actgttataaaatctttttaacctcttttctgatttcaggagtaattagtaattgtggtttactggaaaattcaatgaatagcgtggtaaaggaagcaattcgttaataatatatctaatctattgggagactgaggcgggtgggtcacctgagatcaggagttcgagaccagcctggccaacatggcaaaactccgtctctactaaaaatacaaaaattcgccgggcatggtggtgcattcctgtattcccaggtactcggaaggctgaggcaggagaatcacctgaactccagaggtggaggttgcagtgagtca

SEQ ID NO: 19623 - DNA, 115 bp, Homo sapiens
gaagcccagtcagcattagactctacatcttcatctatgcagcccagccctgtatcaaatcagtcacttttatcagaatctgtagcatcttctcaattggacagtacatctgtgg

SEQ ID NO: 19624 - DNA, 255 bp, Homo sapiens
  misc_feature 183: n = A,T,C or G
gggggaaaactgtggaaaaccagagttcccaggtgtttacaccaaagtggccaattattttgactggattagctaccatgtaggaaggccttttatttctcagtacaatgtataaaattgttatctctctcttcattctattctttttctctcaagagttccatttaatggaaataaaacggnataattaataattctctaggggggaaaaatgaagcaaatctcattggatatttttaaaggtctcacagagtt

SEQ ID NO: 19625 - DNA, 143 bp, Homo sapiens
aaaaaagtaaaatagtatgaacaaaatgtgcactctaccagatttgaacatctagtgaggttcacattcatactaagttttcaacattgtgttctttttgcattcattttttacttttattaaaggttcaaaaacaaaaaaaa

SEQ ID NO: 19626 - DNA, 327 bp, Homo sapiens
aaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggggtcttcataatgaagttaaag

SEQ ID NO: 19627 - DNA, 140 bp, Homo sapiens
aaaagcctgagatgagaatggggaggatggcaaggtctagattggggagaatttttttttctctttttttttgcggggggctaagaaatttggaatttaagtgtaatggaaaaacatcaaaagtcattaaactaataagt

SEQ ID NO: 19628 - DNA, 284 bp, Homo sapiens
agaaagagatgcggcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttggacaataaattatgaacccggg

SEQ ID NO: 19629 - DNA, 161 bp, Homo sapiens
  misc_feature 33: n = A,T,C or G
aatgataccattcagattgatttggagactggnaagattactgatttcatcaagttcgacactggtaacctgtgtatggtgactggaggtgctaacctaggaagaattggtgtgatcaccaacagagagaggcaccctggatcttttgacgtggttcacgt

SEQ ID NO: 19630 - DNA, 309 bp, Homo sapiens
  misc_feature 222, 244: n = A,T,C or G
aataacaaagaaagtggcagttccttacagccctgctgctggggttgattttgaactggagtcattttctgaaaggaaagaagaggagaaggaagaattgatggaatggtggaaaatgatgtcaagaaactttaaatttttaaaaaggcttctagttaagttgctttaaatctatctatataatgtagtatgatgtaatgtggtcttttttttagattttgngcagttaatacttaacattganttattttttaatcatttaaatattaatcaactttccttaaaataaatagcctcttaggtaaaatt

SEQ ID NO: 19631 - DNA, 285 bp, Homo sapiens
tgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcggaaaatcaagtcttccaaaaattcagctgctaatagagaattacaggagaaactc

SEQ ID NO: 19632 - DNA, 300 bp, Homo sapiens
  misc_feature 23, 294: n = A,T,C or G
gacccacaggaatagagcaagtnacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgtgtgtctccttatgactccatttctgtaagctactctgtaactttgatatatgctgtattttctttctttaaaagatttagatgttttttcagcaagctanccatac

SEQ ID NO: 19633 - DNA, 341 bp, Homo sapiens
tggctgagatcgagaaattcgataagtcgaaactgaagaagacagagacgcaagagaaaaatccactgccttccaaagaaacgattgaacaggagaagcaagcaggcgaatcgtaatgaggcgtgcgccggcaatatgcactgtacattccacaagcattgccttcttattttacttcttttagctgtttaactttgtaagatgcaaagaggtggatcaagttaaatgactgtgctgccctttcacatcaaagaactactgacaacgaaggccgcgcctgctttcccatctgtctatctatctggctggcagggaaaggaaagaacttgcatgttggtgaa

SEQ ID NO: 19634 - DNA, 358 bp, Homo sapiens
  misc_feature 58: n = A,T,C or G
attttgcctcctctacagtttcttattgcagagggactaaggatatttgggaatgttngtaaatatcttctatgccacactgacaaattgtactatgagaaaggatgtgcttctagaaactatgatcatacatttgccaatttacagattgctggtgtgacagacagttcacagctgcttgcttcctaatgttccctggaaattaaagtcactagagattaagaattctaattaatacatgtaagtaaaatcactagaactaataatggaaacaactcttgtatgcaagaatacaaggaaagtaaggatttacttttgataaggaaaagctataagatatgagaatgttatgttttgt

SEQ ID NO: 19635 - DNA, 300 bp, Homo sapiens
gccatgaacgaagtgttaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaa

SEQ ID NO: 19636 - DNA, 265 bp, Homo sapiens
ggatacctcagctatatcactgcccaacatcagaaaacctgacggctatgattactatgccttttctaaagatcaatactataacattgatgtgcctagtagaacagcaagagcaattactactcgttctgggcaagaccttatccaaagtctggtacaactgtccttagactgatgagcaaaggaggagtcaactaatgaagaaatgaataataaattttgacactgaaaaacattttattaataaagaatattgacatgagcc

SEQ ID NO: 19637 - DNA, 375 bp, Homo sapiens
  misc_feature 277: n = A,T,C or G
atattatgaattattaaacatttttgccttgaaaagttttttatatgtatgatatagtatcagttgagcatccctaacccaaaagttaaaaattttagatgctccagattctgaaactttttaagtaccaatgtgatgtcacaagtggaaaattttacatcttgaccttatgtaatgtgttgcagtcaaaatgcaggtagtcaacacagtttattcagcatcctaaagggaaaaaagaccctcccagctatcttcatctgtaatatatctttcctgngcactcccagattcttctatgcaaacattcccacaaagggtaacacaatgacacagctacaggtcagatgtgccaatggcaaggttccatgatgctcc

SEQ ID NO: 19638 - DNA, 320 bp, Homo sapiens
acgataaaaggtaataacattttatacaatttccatatagtctattcattaagtaatctttttacagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgggacaataccg

SEQ ID NO: 19639 - DNA, 243 bp, Homo sapiens
attcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtgcagaaggaatatctcggtgccatttgctcctgcacatgctttggaggccagcgggg

SEQ ID NO: 19640 - DNA, 324 bp, Homo sapiens
ttactcctttcctcttgatttttttcctataatttcattcttgttttttcatctcattatccaagttctgcagaccacacaggaacttgcttcatggctctttagatgaaatagaagttcagggttccccactctagtcactaaagaaggattttactctcccagcccagaaaggtgattctttctttaccatttctggggactttagcttaattaggtaccttattaacaggaaatgctaaggtaccttctctgtggaacaatctgcaatgtctaaatcgccttaaaagagcccatttcttagctgctgaaatcagtgctctt

SEQ ID NO: 19641 - DNA, 331 bp, Homo sapiens
ttgagactcttatttaatgggcttttgattctaatgataattgtacctttatctttcaaaagctgatattccctacctaagcatctcccgagaaaaatatctcattaaaaagcccataaatagtaggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcggttattgagaaactcaaatgaatat

SEQ ID NO: 19642 - DNA, 414 bp, Homo sapiens
  misc_feature 348, 380: n = A,T,C or G
tacacttaggcaagaatttattttcccattaaaatttgaaaaatacacttttctttgcttctacccttgcagtttcccttagttcccctaatttccaagtgatctgaactaaaattaatattacatttactaagaaactatttttgttaattatactgagcaaagtttgctccaaatgaaaagtcattacgaactatgtatagtacccaagaaaaggtcaaattgagtcagaagactgtaagtaccacttttggcgctccagagataaaccttgtcacactgcagtagacaggtgagtagaaaatatgagctataaatagatattatttttaggtttgatagctctgngttggaatacttttttaatgcaggataaaaantatcagggaattaaccttatggcacagaccaaat

SEQ ID NO: 19643 - DNA, 304 bp, Homo sapiens
  misc_feature 99, 120, 205, 252, 276: n = A,T,C or G
cagggaccatcctcagatctttgtggactggccccaggctgaccagatgtatatctccttcatgcagaaacaggagcctcaaagaatcttccagtgggntatagttgtgggtgtaggagntcacccaaccaacttaacttgccaggtgatcacacaggtacaagaggctgataaggggctgggcatggtgctcacacctgtaatnccggcactttgggaggctgaggcaggtggatcacgaggtcaggagancaagaccatcctggctaacacggngaaaccccgtctctaccaaaaaaaaaaa

SEQ ID NO: 19644 - DNA, 240 bp, Homo sapiens
ttggaaacagtattaggaactgaaagatcgggtaaaaatacccaaactgatgcacaaagagaaaaaggaatgtgaaatatagataaaagtttgagacatttgagacatgttaaactgtgctaacacattaggaaaaagagaaagtgagcaaaaaggaagaggggaaggaggaggaggagaagagaaataggagcagaagaaatatttaaaatgatacttactcagaattttccaaaactg

SEQ ID NO: 19645 - DNA, 181 bp, Homo sapiens
tgtcctccagcctcagcagatgagacttttacgcatcatcttcagcgactgagaaaactcattaaaaagcgctctgaactgtatgaagctgaagagagagccctcagagttatgctagaaggagaacaagaggaagagaggaaaagagaattagaaaaaaaaaaaaaaaaaaaaaaaaaaa

SEQ ID NO: 19646 - DNA, 339 bp, Homo sapiens
cgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcag

SEQ ID NO: 19647 - DNA, 140 bp, Homo sapiens
atgtatgcagtgtgctttttcttgccagcttgggccattcttgcttagacagtcagcatttgtctcctcctttaactgagtcatcatcttagtccaactaatgcagtcgatacaatgcgtagatagaagaagccccacgg

SEQ ID NO: 19648 - DNA, 347 bp, Homo sapiens
gagataagctaaagtgtcattagtttccccttctgataaacaggatgttacctagtaaataataaaacagaaatatttcagaaatttaggttggaaactattgaaaaaaaaataatggttttgttgggaggcaaagtcccaatgtctctttgagccaataagcaaccaaataattcaacttgattttttaaattgcactgtttttatgtattggtttttttgttcctctctctcaattttactgttattcctctaataataaatgtctcggggagacaaagcacatctttcttgtgtgatgggaaaagggaaactactaattgaaatatgtactctgcctaaaatta

SEQ ID NO: 19649 - DNA, 366 bp, Homo sapiens
tgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacactta

SEQ ID NO: 19650 - DNA, 322 bp, Homo sapiens
acaagtagatgaagatgccttgacttacctcatgtgggcaaatcatttggttcacacgctgtgtcccgattctataacaatagctgaggatgtatcaggaatgccagctctgtgctctccaatttcccagggagggggtggttttgactatcgactagccatggcaattccagataagtggattcagctacttaaagagtttaaagatgaagactggaacatgggcgatatagtatacacgctcacaaacaggcgctaccttgaaaagtgcattgcttatgcagagagccatgatcaggcattggttggggataagtcgctg

SEQ ID NO: 19651 - DNA, 330 bp, Homo sapiens
gtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgcatgatgtgtaacgaattccttgaaggcttcccagataagcagcccaggaagaaatgaaaactcctctgatgtggttggggggtctgc

SEQ ID NO: 19652 - DNA, 378 bp, Homo sapiens
agctctaagaaagaagcaaattatcactgaacatatttctaattatttctggctttgaattatacgtaacttaaattgtcttaaatgatacagaatattggagaatatgatactttcacataatatactatgaacctattcatataactctgattgactactaacttctgttttatgtatttattaaagagctgacactgtagtttgtggtgagatgtttatttttctaacagagcttataacagttaggacaaggcatttaattaatgcatcattctgtttagtaggaggtgttaatcaatatgaaattctctgttttaaaataaaaatgtaaaaatctaagaataaaaaaaaaccaaaaaaaaaaaaaaaaaaaaa

SEQ ID NO: 19653 - DNA, 187 bp, Homo sapiens
  misc_feature 109, 181: n = A,T,C or G
ccaatggcatgtgctcacttggtgtttctgtgtcacatttcggtaattctcacgatatttcaaacttttattgtatctgttatgatctgtgatcagtgatctttgatgntgctattataattgttttggggtgccatgaacattggccatataagatgcaaacttaattgataaatgttgnatgtgt

SEQ ID NO: 19654 - DNA, 300 bp, Homo sapiens
atattaagcaatgatcttttcccattagaatgtaagtttcatgaacaggtacttgttttaatactgtatctccagtcctaatgtgtaacaggagcccaataaatgtttgctttcaaatggagaggttaagtaacctgctcaaatcacacagctattaagtggcagaacaggttttcaagcaatgcatctggtggttttaactaagtcgagatagtttttattcctaatgcctaaacaggggctaggtaggggagccgggggcacatattaaggattgggtaaacctaaaaataataagca

SEQ ID NO: 19655 - DNA, 178 bp, Homo sapiens
cttaaaatatgcatgtcaccttcaaggttttataattgcactgtttgttttatgtatgtacagattaaaattattgctacatttgaggaaaataaaattgcttgcttctatgtaattcctgtcattccacaggaaattcacctttccagctactgaatagaatttgtttaacaacctc

SEQ ID NO: 19656 - DNA, 179 bp, Homo sapiens
cagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaa

SEQ ID NO: 19657 - DNA, 236 bp, Homo sapiens
aatacgaggatgaactcattgaattcttttcccgagaggcttgacaatgttaaagacaaactttgcagtaagcgaacagatctttgtgaccatgccctgcacatatcgcatgatgagctatgaaccactggagcagccacactggcttgatggatcacccccaggaggggaaaatggtggcaatgccttttatatattatgtttttactgaaattaactgaaaaaatatgaaaccc

SEQ ID NO: 19658 - DNA, 300 bp, Homo sapiens
  misc_feature 38: n = A,T,C or G
agaaccctctaaatccccttgtaaatttaactgttagnccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctctgcataagcctgcgtcaagattaaaacact

SEQ ID NO: 19659 - DNA, 292 bp, Homo sapiens
tagcttaagattttaagagaaagtatgaagacttagaagagtagcatgaggaaggaaaagataaaaggtttctagaacatgacggaggttgagatgaagcttcttcatggagtaaaaaatgtatttaaaagaaaattgagagaaaggactacagagccccgaattaataccaatagaagggcaatgcttttagattaaaatgaaggtgcttaaacagcttaaagttagtttaaaagttgtaggtgattaaaataatttgaaggcgatcttttaaaaagagattaaaccggag

SEQ ID NO: 19660 - DNA, 321 bp, Homo sapiens
tttaagtgcttttattattaaagaaaaatgaatccagatgaactaagcatccaaagatataagaagaagataaacaaaaaaaacataagaaaaacagagaaaagagttcctaaatttaaaaacaaagcaaaattaatgaaatgcaaaataggaaaaaaagaataaaatggatgtataaatccagagaaccagagagctggttctctgtaaagtctaataaaatagataaattgttggcaaatctaattaagaaaagagggcaaaaaatcaaataacctaattatgtaaaccataattatagaaaaaaattcagaaaagagt

SEQ ID NO: 19661 - DNA, 300 bp, Homo sapiens
  misc_feature 42, 70, 207, 278: n = A,T,C or G
tagttgcataaggaaaagaaagagaaaagggcacgagagcgnatgtgaaggaataatggctaaaaaactnctcaaattttaggaatcagacatacgaactgaagctcaacaagctcccatgggataaattcagacacatacagagacacattttaatccaactactgaaagtcaaagataatctcaaaagaagcaagagaaaattgnacatgtacaatgagcctctataagttatcaccaggtttctcaagtagaatccatgcatgctggaaggcagngggatgatatatttaaagtgca

SEQ ID NO: 19662 - DNA, 265 bp, Homo sapiens
  misc_feature 253: n = A,T,C or G
cattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctggtaactgtgaacagcctgatatcttggttcttctacactaatnaatgaaggacag

SEQ ID NO: 19663 - DNA, 177 bp, Homo sapiens
  misc_feature 52: n = A,T,C or G
tccagagaggatgttacttttgctttattcaaatgacactagcctcagacanagcagatgctgggttcttaaaatttgaacctcaaccttaaatcccaaaccgaaattaggcacataaatcttactttgaattttgaggtaagacttttttccccctcttcagagcccagtagaaac

SEQ ID NO: 19664 - DNA, 259 bp, Homo sapiens
  misc_feature 78, 189: n = A,T,C or G
ggcagaggtatgatgatattctgatcaatggacttccagattggcgacagcctgtattctactacaggcgggtgaganaaatgagcaatgctgagctggcattactcttgttcattattctcacagtgggtcattatgctgtggtttggtcaatctacctggaaaaacaactggatgaactactaagtngaaaaaagagagaaaagaaaaaaaagactggcagcaagagtgtggatgtatcaaaactcggtgcttccga

SEQ ID NO: 19665 - DNA, 300 bp, Homo sapiens
  misc_feature 34, 142: n = A,T,C or G
ctccaccaagaatgagaacaaaaagagaagaaanccgaaacataattctgaagctacaggaagatcagagcaaagagaaaagaaagcataaggacacttactcaacagaagcacctttaggcgaaggaacagaacaatatgncaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaattt

SEQ ID NO: 19666 - DNA, 397 bp, Homo sapiens
  misc_feature 267: n = A,T,C or G
agagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgccttcataatgaaggtaaagtgagtatactgtggagaggacttccaaatgtggttacctnagctatatcactgccaacatcagaaaacctgcggctatgattactatgccttttctaaagatcaatactatacattgatgtgcctagtagaacagcaagagcaattactactcgtctgggcagaccttat

SEQ ID NO: 19667 - DNA, 392 bp, Homo sapiens
ggaaggaaggaaggaaggaaggaagcatggaaggaaggaaggaagaaagaaaacccaccatcccttcaactatttcagacaatgagtcataaaattcaactactagaaacttctctatttgtgctaaagcattatttacatcctgttcaaatgccttttatgttgagcaaaggcaactcacagtgctgtattaattcttgagtgtgcaaaagggcattaggttctttccagggcaggtcactggagaagactggtcaagaggataataccagaaatctctcagattctccaaaagagatgagaatagacactgctgaaattgatacaggatacatattccctccctactacaagatcagtggtggcaggggaactagatttcagtggattag

SEQ ID NO: 19668 - DNA, 313 bp, Homo sapiens
ttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaaaaaaaa

SEQ ID NO: 19669 - DNA, 298 bp, Homo sapiens
gatttgcatttctctgatggccagtgatggtgagcattttttcatgtgatttttggctgcataaatgccttcttttgagaagtgtctgttcatgtcctttgcccactttttgatggggttgtttgtttttttcttgtaaatttgtttgagttcgttgtagattctggatattagcccttagtcagatgagtaggttgtgaaaattttctcccattttgtgggttgcctgttcattctgatggagtttcctttgctgtgcagaagctctttagtttaattagatcccatttgtcaattt

SEQ ID NO: 19670 - DNA, 314 bp, Homo sapiens
ggaaaaaccctggaatttccagttcactttcttatcaggattcgaaaggaagtagcaactaatgcaaataacgaagagagtactgagacctgaaaacaatggaaagatgaaaatccattactaattgaaaacagtgaaaaacaactgatgtcatactgaaaatctgatgactataaacccaggtgcttgcgacctgttgagcattgttctggaaattctaatcaatgcataaagaagtggtttagaaataaagaatatacctattgcaagtaaagaggggaaattattgtagaggtatttataaacatttacaa

SEQ ID NO: 19671 - DNA, 370 bp, Homo sapiens
aagggatcaaagtgttctcttcagtatcacaaaatgccagaagtaatggaacaattacttcagagacctaacaaaatcaaagcagaggattgtggctaaaaaagggcatacacagccaaattattgttcatgtatgatggcaatagaattactttttttattttcaacgttcagagacaatgtatcacatatgagctcttcaaaaattatttgaaaatgtactattaagagtttgggaaagggacatgtttgacaaaatcattgagaaaaagcattgaaatgctttttttaaatgtagaagcaagactaaatacttgtttgcaagatgggaaatagtacaaaatgtcagaataacttaaaaagggtatgg

SEQ ID NO: 19672 - DNA, 140 bp, Homo sapiens
gcctgtaatcccagctccttgggaggctgaggcacaagaatcacttgaacccaggaggcggaagttgcagtgagccgagatcacaccactgcactgcagccggggtgacggagtgagactgtcttagatagatagataga

SEQ ID NO: 19673 - DNA, 379 bp, Homo sapiens
agaattcgggctgaaactgggccaaatccaatgaactgaaccgtgtcccctagtttttaatggatgaaccattatttcacattcattcttacctcattcattaacccacactcatctattcattccctccttccttggagaagccccatctatccattcactagatatttattgggcacttactggcagaaatgttgctacgatctgggattataatcatgaatgagatagacacagtccctgctctcttgcagtttatggtctaatggagggagaaagatattaaatcactgcccaaagtaattatacacatatttctcatttaatgtgctttgctttattgcacttcacagatactatgttttttacaaattgaagg

SEQ ID NO: 19674 - DNA, 188 bp, Homo sapiens
aagaggaggccgcctcctcggggctccaggctggcttgcccgcgctctttcttccctcgtgacagtggagtgtggtgtcgtctgtgaatgctaagtccatcaccctttccggcacactgccaaataaacagctatttaaggggaaaaaaaaaaaaaaaaaaaaaaaaaaaaaaaaaaaaaaaaaaaaa

SEQ ID NO: 19675 - DNA, 304 bp, Homo sapiens
taaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgcaatatttagtaaagcttttcttttttaatttccaggaaaaaataaaaagagtatgagtcttctgtaattcattgagcag

SEQ ID NO: 19676 - DNA, 362 bp, Homo sapiens
ccagcgtactccaaagattcaggtttactcacgtcatccagcagagaatggaaagtcaaatttcctgaattgctatgtgtctgggtttcatccatccgacattgaagttgacttactgaagaatgtagagagaattgaaaaagtggagcattcagacttgtctttcagcaaggactgggctttctatctcttgtactacactgaattcacccccactgaaaaagatgagtatgcctgccgtgtgaaccatgtgactttgcacagcccaagataagtaagtgggatcgagacatgtaagcagcatcatggagggttgaagatgccgcatttggattggatgaattccaaattctgcttgcttc

SEQ ID NO: 19677 - DNA, 485 bp, Homo sapiens
  misc_feature 3, 7, 8, 11, 12, 15, 20, 30, 40, 43, 47, 48, 54, 60, 61,79, 86, 94, 101, 105, 124, 131, 136, 149, 152, 154, 157,158, 166, 170, 177, 179, 181, 184, 341, 368, 375, 441, 483,484: n = A,T,C or G
ggngggnnggnnacnctaangaggccccgncattatggcnggngagnnaaactnaagctnngttttactacaacttgtncaaagcngtatgacngggcatnttcnttgctcccaagatttgggntgggggnactcncagctcagagccnggnanaanngccagctntagnctgacanantntangggtatggggcaaggatcacatctaatgcttgcgttccttatactctattatatagtgttattcatgattcagctgatcttaacaaaattcgtagcagtggaccttgaaatgcatgtggctagatttatgctaaaatgattctcaagttagcatttnagtaacacttcaaaggttttttttggntgggttnctagactactaaagcttaggattaattagaagaagcatctagtaaattcccattggatttaatttnctggaaactttttcatagtattggttaaaaagatttaaaaannt

SEQ ID NO: 19678 - DNA, 364 bp, Homo sapiens
atgcccttgacattgagaatgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgacgaccttgaataaaaattgcacacactcagtgcagcaatatattaccagcaagaataaaaaagaaatccatatcttaaagaaacagctttcaagtgcctttctgcaggttttcaggagcgcaagatagatttggaataggaataagc

SEQ ID NO: 19679 - DNA, 318 bp, Homo sapiens
  misc_feature 61: n = A,T,C or G
aaaggatcagttctgtgtctaggtactccgttcccacagtactgtcagaaagtaagcaagngaatttgggatggaatttctacccagtatgttgttgctgtgtggtcttctgacctcctggcttttccattttatcacctccatgggaaaggacttaggcagcagatgtggctgtgccacaactgccacagctgtgggcttgggtggaggagctgtgagctagaggacggccacacccatagcacagctgacatcagccacacatgaagctgggaagctgctctctactctcagcaccctcagggccaagagaagccc

SEQ ID NO: 19680 - DNA, 322 bp, Homo sapiens
cagaccttgaactttccttgcttcagcgattcctagcctaggaactgagtaaaagccctatttttcttaattaaattaacaggttgcagttcgtaggtgttgctcttgggaaaaaaacaaagacttgggtggttgggtgtttgctaacttcatcgtgactaaataaaactattttttttcattcctatttttgaaaatgccacaggcccacaagtgtgttctaccctctgtggacaatgaagtatgtgtatgtgtgtgtgggtgtgcgtgtgttaaagagagagagacacgggagtaaacatcacgtgcttatcaggaccca

SEQ ID NO: 19681 - DNA, 241 bp, Homo sapiens
tatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctgggtgtccaagatagaatcttagtcaactttaaatttgccacaga

SEQ ID NO: 19682 - DNA, 425 bp, Homo sapiens
gaggaggtacaaaagttactattgctcataatgacttacaggctaaaattagttttaaaatactatattaaattctgaatgcaattttttttttgttcccttgagaccaaaatttaagttaactgttgctggcagtctaagtgtaaatgttaacagcaggagaagttaagaattgagcagttctgttgcatgatttcccaaatgaaatactgccttggctagagtttgaaaaactaattgagcctgtgcctggctagaaaacaagcgtttatttgaatgtgaatagtgtttcaaaggtatgtaggtacagaattcctaccaaacagcttaaattcttcaagaaagaattcctgcagcaggtattcccttacctgaaggcttcaatcatttggatcaacaactgctactctcgggaagactcctct

SEQ ID NO: 19683 - DNA, 327 bp, Homo sapiens
cttagtgtttacaaatattaagtactcttgatacaaaatatacttttaaacttcataaccttgttataaaagttgttgcagcaaaataatagcctcggttctatgcatatatggattagctataaaaaatgtcaataagattgtcaaggaaaattagagaaagcacatttaggggttattttttacacttggccagtaaaatagggtaaatcctattagaattttttaaagaactttttttaaggttcctaaatctgtgtgtgtattgtgaagtggtataagaaatgactttgaccactttgcaattgtagattcccaacaataaaa

SEQ ID NO: 19684 - DNA, 104 bp, Homo sapiens
  misc_feature 2, 6: n = A,T,C or G
ancaancacaggggcgggtgtcagcatgaatacacatcttaaagctgcgaaaatgaccctgaagaacagagaacctgtacagctggaaacgctgagtattcgag

SEQ ID NO: 19685 - DNA, 370 bp, Homo sapiens
atctatgtagaaaaccaaatcaaatccattactaagttactgaaaccagcaagtgagtttcgcaacacagcaggatatataattgatatacacaaatcaattgtgtttctccatgttagaagtaaagaattaggaattgaaaatttaaaaataataccatttacaatagcattaaaatataaaattcttgggaataaacccgcaaactatgtggattatccggcactgataactaaaaagcattgctaagaaaaattaagacctaagtaaatatcttgttgataggttgagagactcaacattgttgatgttaattctttcccatattaatctatagatataatgcagtccccatccgaaaaaaaaaaaa

SEQ ID NO: 19686 - DNA, 332 bp, Homo sapiens
aagattttacacctaaaaaatctctcctatcccaaaaataatgtgggatccttatcagcatgcccacagtttatttctttgttcttcactaggcctgcataatacagtcctatgtagacatctgttcccttgggtttccgttctttcttaggatggttgccaacccacaatctcattgatcagcagccaatatgggtttgtttggttttttaattcttaaaaacatcctctagaggaatagaacaaatttttatgagcataaccctatataaagacaaaatgaatttctgaccttaccatatataccattaggccttgccattgctttaatg

SEQ ID NO: 19687 - DNA, 190 bp, Homo sapiens
ggggaaggagaagctggaacatgcgggcgggggtgggaatatctagttatattttttaaattttgataatgatgccatcaagtctgtttgtttgcataactgttttttaaaaaagaattgatattttcagtattttcatataaatatacttgtaatataacgtaaaaaaaaaaaaaaaaaaaaaaaaaaa

SEQ ID NO: 19688 - DNA, 142 bp, Homo sapiens
aatcccagctactcaggaggttgaggcagagaatcgcttgaacccggggggtggaggttgcagtgagctgagatcgcaccactgcactccagcatgaaagagcgagactcaatctcaaaaaaaaaaaaaaaaaaaaaaaaaa

SEQ ID NO: 19689 - DNA, 418 bp, Homo sapiens
aagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaa

SEQ ID NO: 19690 - DNA, 206 bp, Homo sapiens
actttgttaggaagtgagcctagccacaccctcctgagtcactgggtctttactatcctggggtaggcaatatcttttgttcagctgataaaagctttgtcattgtgaagattggctcccaatgataggaaactgctggtgatgaaaataaaggggcttaaagattattctcagcagaaaaaataaagtgttagaaaaaaaaaaaa

SEQ ID NO: 19691 - DNA, 115 bp, Homo sapiens
aacatgtttattcctcaggaatactgaagtgccctggagtaagctgccattcttctgtaacaatgttatcagtaatgctttaaactccagcacctgggtatgcatttgaaaccaa

SEQ ID NO: 19692 - DNA, 275 bp, Homo sapiens
tttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatag

SEQ ID NO: 19693 - DNA, 340 bp, Homo sapiens
ttatgaacttaatcccttcattaacaggagaaatgcaaataccttcatatcccctgagcagagatggagagctaaagtccaagagaggatccgagaacgctctaagcctgtccacgagctcaatagggaagcctgtgatgactacagactttgcgaacgctacgccatggtttatggatacaatgctgctataatcgctacttcaggaagcgcgagggaccaaatgagactgagggaagaaaaaaaatctctttttttctggaggctggcacctgattttgtatccccctgtagcagcattactgaaatacataggcttatatacaatgcttctttcctg

SEQ ID NO: 19694 - DNA, 259 bp, Homo sapiens
ctacatagtaaggtgctgccaaataatatttgaagtcatctgtctctttgtaaattattttatatgacctataaatttaaaaatgtttttcagtgagtgcttttaacaaacttaagcttctgccctgccaagggaattaatgttatcttgtgaaaggggtgctgtttgaattgatgagaaatggaagatgagaactccctaagagtctcataataaatcatctcatcacaaatcgatacggtatacagaggtaaagtgg

SEQ ID NO: 19695 - DNA, 341 bp, Homo sapiens
  misc_feature 177, 239: n = A,T,C or G
taccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgcaaacctaccgagcctggtgatagctggntgccaagatagaatcttagttcaactttaaatttgcccacagaaccctctaaatccccttgnaaatttaactggtagtccaaagaggaacagctctttggacactaggaaaaaaccttgtagagagagtaaaaaatttaacacccatagtaggcctaaaagcag

SEQ ID NO: 19696 - DNA, 321 bp, Homo sapiens
tgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccggcaatatgcactgtacattccacaagcattgccttcttattttacttcttttagctgtttaactttgtaagatgcaaagaggttggatcaagtttaaatgactgtgctgcccctttcacatcaaagaactactgacaacgaa

SEQ ID NO: 19697 - DNA, 318 bp, Homo sapiens
tgatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctaaatgtcgctttgctcaagtaccaaataataataatgctatacttaaattacttgtgaaaaacaacacattttaaagattacgtgcttcttggtacaggtttgtgaatgacag

SEQ ID NO: 19698 - DNA, 306 bp, Homo sapiens
agaagaatcaaatagatgaagcaaaaaatgataaaggggtatcaccactgatcccacagaaatacaaactaccatcagagatattataaacacctctacgcaagtaaactagaaaatctagaagaaatggataaattccttgacacatacactctcccaagactaaaccaggaagaagttgaatctctgaatagaccaataacaggctctgaaattgaggcaataattaatagcttaccaaccaaaaaaaatccaggaccagacgggttcacagcctaattctccagaggtacaaggagggactgg

SEQ ID NO: 19699 - DNA, 331 bp, Homo sapiens
ccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaagatgtgctttcccataatga

SEQ ID NO: 19700 - DNA, 305 bp, Homo sapiens
ccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtt

SEQ ID NO: 19701 - DNA, 254 bp, Homo sapiens
acggtaggtatcagaactttttcttttttacaacttttataacttttataaaggagccgacacctttttctgatattgtcagaacaattgctgaccagtgctatgggctggctgaggttggcaaccaagaatctgttatctcagtctacacagcgtggagttagaagattggattgttgttggttagaattttgtccagagagttagaagatagaagaaaagggagggctgaggacataaacatccaaattttc

SEQ ID NO: 19702 - DNA, 249 bp, Homo sapiens
gactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagaga

SEQ ID NO: 19703 - DNA, 255 bp, Homo sapiens
taccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaaaaaaaaaaaaaaaaaaaaaa

SEQ ID NO: 19704 - DNA, 338 bp, Homo sapiens
ggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaa

SEQ ID NO: 19705 - DNA, 359 bp, Homo sapiens
ttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatgggttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacag

SEQ ID NO: 19706 - DNA, 285 bp, Homo sapiens
  misc_feature 29: n = A,T,C or G
aaaaagaatcgctgattcatgtgcaggangaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgcttgagggtttttttttcctaggcattgggaatgtagagcag

SEQ ID NO: 19707 - DNA, 342 bp, Homo sapiens
gtagcttgctacatgaaaatgctaggctctagggcatgtaaaacatgaatacagaatactagattgttctaagtaatgtcatttcggtttgtgaatttgatttttcccttcatttcatgtcatattgaaaatgcaaacaaactgctctcaagaacacccagaagctatctgtgttaccagatgtgttgtgaacactctactatttttcataggtgcttccttgaaatatatgtccattgtagtggtggagagggactggactctctcaggctctttacttgccagttgtctcccgcaggtaatggaaatatatatacatatatatatatattttatttagaa

SEQ ID NO: 19708 - DNA, 433 bp, Homo sapiens
aacactctgcaggatattatccaggagaacttccccaatctagcaaggcaggccaacattcagattcaggaaatacagagaacgccacaaagatactccttgagaagagcaactccaagacacataattgtcagattcaccaaagttgaaatgaaggaaaaaatgttaagggcagccagagagaaaggtcgggttacccacaaagggaagcccgtcagactaacagcggatatctcggcagaaactctacaagccagaagagagtggggccaatattcaacattcttaaagaaaacaattttcaacccagaatttcatgtccagccaaactaagcttcataagcgaaggagaaataaaatcctttacagataagcaaatgctgagagattttgtcaccaccaggcctgccttacaagagctcctgaaggaagc

SEQ ID NO: 19709 - DNA, 373 bp, Homo sapiens
  misc_feature 67, 76: n = A,T,C or G
acacttgccttctttcaaaaattagtatctctagccgggtgcggtggctcacgcctgtaacctcagntactttggnaggccgaggcagggggatcacgaggtcaggagttcgagaccaccctggccaagatggtgaaaccctgtctctactaaaaatacaaggattggctgggcatggtggtgtgtgcctgtaatcccaactacttgggaggctgaggcaggagagtcgcttgaatctgggaggtggaggtgcagtgagccaagatcgtgccactgcactccagcatgggagacagagcgagacttcatctcaataataataaaaaaaattagtgtctttctcataaaagtccagatttctggattctcttgg

SEQ ID NO: 19710 - DNA, 190 bp, Homo sapiens
aattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggtttttttaataaatccttttgtatt

SEQ ID NO: 19711 - DNA, 326 bp, Homo sapiens
  misc_feature 278: n = A,T,C or G
aaaccaaatgaagatgttttcagatatgtacacatttctgcttctgcacatattttcatggaaaccattatggtaaagaacttagagcaacatcctaattggctcagtgcacgtttggcaatagtgccagcctgtcttgctttaatgcatggattcataaacttcttccctacctgcatcatgtgcatgtagtgcatattaaatgaaagtgatattaagaatgctttcccaaattccattatttgcattgagctgacaacctggtagtttctgggtgnctaactaccatatgagctagaaaatgcccaaacgatattccttatctg

SEQ ID NO: 19712 - DNA, 317 bp, Homo sapiens
cagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagcttgatgccctcctgtatagagccaccatgattcttacagttggtggaacagcatatgccatatatgagctggctgtggcttcatttcccaagaagcaggagtgacttcagtcatcccagcaatcgcttggtcagtttcattcagctctctatgg

SEQ ID NO: 19713 - DNA, 350 bp, Homo sapiens
tcttaaaccacaaaacatcaagtaattccaagttttcctttgctgtttataaactttactcatgtatttgtagtagctgcatttgtcattaataagagagacataatcctcctgttatactcagtatcattatatgctagtcaacctgattcactaacacacagatgaacaaccaaaatatacctaaaaggtatagctctaggaggtttattaatagtaaaggtaaaatctctcagtttcctacctctagaaagaggccatctcactagaataggatattatgcatactgagctagaccagaagagtctggacaaaataaacacagcctttataatcaacttgaatactg

SEQ ID NO: 19714 - DNA, 445 bp, Homo sapiens
  misc_feature 88, 90: n = A,T,C or G
aaacaggaacctgtacagaagtgccctggaagaaggcctgctctaaattatccagtgtatggagaaacgacacaggttaggagacgtngntttgaaccgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgtctgggcagaccttatccaaagctggtacaactgtccttagactgatgagcaaaggaggagtcaactaatggagaaatgaataataaattt

SEQ ID NO: 19715 - DNA, 241 bp, Homo sapiens
atgaaatgtagatctcatttggatcctaatttgaataagacatgtctgcaaaaatcaggcaactttaagttagaatacatgaaacaagattagcaaaatgccgacaatcagttaattgaaactggatggtacggattcatcacttttatttataattttccctttgtttaacgatttccataatcagaaatttaaaaatgaatattgatttttttagatttagtctcagcaactcccatgg

SEQ ID NO: 19716 - DNA, 404 bp, Homo sapiens
ggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagccaagagaggatccgagaacgctctaagcctgtcacgagctcaatagggaagcctgtgatgactacagactttgcgaacgctacgccatgggttatggatacaatgctgcctataatcgctacttcaggaagcgccgagggaccaaatgagactgagggaagaaaaaaaatctctttttttctg

SEQ ID NO: 19717 - DNA, 169 bp, Homo sapiens
caaacttagaagaaaattggaagatagaaacaagatagaaaatgaaaatattgtcaagagtttcagatagaaaatgaaaaacaagctaagacaagtattggagaaatatagaagatagaaaaatataaagccaaaaattggaaaaaaaaaaaaaaaaaaaaaaaaaaaa

SEQ ID NO: 19718 - DNA, 351 bp, Homo sapiens
  misc_feature 64: n = A,T,C or G
ttgacacaggagatgcagttcttaatgaagctgctcaaattctgcgattgctgcacatagaggngctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcgcattctcgggggaggaagcccagaaaattgggtatgttctagagatttaccaccattgcttattgcttttttctttaataaaggttaggaaagtagaaaaaa

SEQ ID NO: 19719 - DNA, 352 bp, Homo sapiens
cttattggcacatgggtggacacggatctgctgggctctgcttaaacacacattgcagcttcaacttttctctttagtgttctgtttgaaactaatacttaccgagtcagactttgtgttcatttcatttcagggtcttggctgcctgtgggcttccccaggtggcctggaggtggcaaagggaagtaacagacacacgatgttgtcaaggatgggtttgggactagagctcagtggtgggagagatccctgcagaacccaccaaccagaacgtggtttgcctgaggctgtaactgagagaaagaatctggggctgtgtatgaaaatatagacattctcacataagcccagt

SEQ ID NO: 19720 - DNA, 321 bp, Homo sapiens
gaaattctactaagttttcccatattcttgataaaggctaaatttgaaataatttatttagatgactaattggcaatttgatagtagttacattttatgtaacacttgatataataacccaaattaattagctcaatattatcttctgtggtttattgatccaaaagtacatatttgttatgtaaacttatactatgtaaacttgaattagttttttgcttccttgaagtaataaagcccattaatgcaaatctaagccttcatagacttttccaatccttagttaaatattaaaaactgagtattgtagttatttgctag

SEQ ID NO: 19721 - DNA, 321 bp, Homo sapiens
ctcagcaatcagactgtcgacattccagaaaatgtggacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtggtacactggcttccgttacaagatgaggtctgtgtatgctcacttccccatcaacgttgttatccaggagaatgggtctcttg

SEQ ID NO: 19722 - DNA, 354 bp, Homo sapiens
  misc_feature 302, 308, 339: n = A,T,C or G
ttggaggcttaatccagttaaaagaaacttctgggaacgaatatcagaagatttggccttaatatatttccatgcgaccagcaggctccccttccttcccccagaaggtgatcacatcaaaggatgatgaagcaagagctgtattttaaatatttagacagtcactgttggctggttcctagttggatggttatcagtgctgccgtggtgcggcctcctatacattatttaaatgtatttaactgttaaatgtgctacccaccaatgatgaaatagacggttatgaaaaccgtccatggggngcatgnttggtttatgtccttttaacattgctattgnactgaatgagatgga

SEQ ID NO: 19723 - DNA, 339 bp, Homo sapiens
ttttagtcttttctctcccccaacccagccatcgccaccagcaagaactatctttctaaagcaccaattatctttccaaaacagaagattttctcttctttgtagggaatttaactttagggcatagtcagataaattagccaaaatatatgtgaagaagctgttcatcacaatattgtttattatagtaaaaaaaggaaaaaaaccttaatatctcaaaaatggatcagtaatatcgagactatacacaatagtcattacattggtattatagatgtataataatttggaaatgatattataaaaaattattaaataatgtgcataggaaaatttggg

SEQ ID NO: 19724 - DNA, 305 bp, Homo sapiens
atacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagc

SEQ ID NO: 19725 - DNA, 203 bp, Homo sapiens
aatttgttatgccatcttcattattcgaattacagactgaaaaaatatggccagtttttaaagaagtttagattatgttttccatggaaggacaagtctgactgttcataggctgattttctttaagaggattattctgttttacaatttcaattctagatcacattttatatatgctgcatgccaaaaaaaaaaaaaaaaaa

SEQ ID NO: 19726 - DNA, 156 bp, Homo sapiens
aagtaataggagggagagtattaggaccaatacctaatgcatgcggggcttaaaacctagatgacaggttaataggtgcaggaaaccatcatggcacatgtatacttatgtaaacaatcccacactttctgcgcatgtatccaggaacttaaagca

SEQ ID NO: 19727 - DNA, 302 bp, Homo sapiens
actaggcctgcataatacagtcctatgtagacatctgttcccttgggtttccgttctttcttaggatggttgccaacccacaatctcattgatcagcagccaatatgggtttgtttgttttttttaattcttaaaaacatcctctagaggaatagaaacaaatttctatgagcataaccctatataaagacaaaatgaatttctgaccttaccatatataccattaggccttgcattgctttaatgtagactcatagttgaaattaggcagaaagaactcagatgtactagattttcattgt

SEQ ID NO: 19728 - DNA, 323 bp, Homo sapiens
aattcaagatgagatttgggtggggacatagagccaagccatatcagaaatatatttagtgatggctaatggctgtgatgggggaatactcagctctttacacatgtggatcagagaagcatacttttagctatctgaaaagaatgaaaacatctcccccctctacccacagaggtaaaactcccatggaggatgggctgattggctttgggttgcccacaagtttcaagccttgggggtatgtccttgcaatgaaatgcatggtaaaagtgttgcactgcttgtgccatagagtttccctcttttaaaggatccaggatccg

SEQ ID NO: 19729 - DNA, 341 bp, Homo sapiens
gcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaaaacatgctgttctacatagatgcttagtccctcatgcaaatcaattactggccaaaagattgctgaaattttatatgcttactgatatattttacaattttttatcatgcatg

SEQ ID NO: 19730 - DNA, 359 bp, Homo sapiens
tggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaat

SEQ ID NO: 19731 - DNA, 132 bp, Homo sapiens
aagtcagcctttcctcctatcagcacaaagaaactcaaagctgttttttccctttctgttccaaagcagtcttatcctgacaggagcggctatactagtgcagatttcaacacttttttttaacgttttaat

SEQ ID NO: 19732 - DNA, 427 bp, Homo sapiens
aagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttg

SEQ ID NO: 19733 - DNA, 308 bp, Homo sapiens
tgcccagcccaaaggcccatgaggggatgcagttatgggctctgtcgccgtggattgttattttgtgtcagtaagtaatccataaagtgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgcaataaagtgaaagataaagctgaagaagaaacagaagaaaagccttcagtttg

SEQ ID NO: 19734 - DNA, 326 bp, Homo sapiens
aaaactactaaatgacactggaatatgtttagtagattagggggaaaaactataaaggtttatacaattgtttgtagttacatttaggatggacttatccctttggagaagagtgaagtttgttttttcgccatgtgatgaagaccactgtgattttttaaaaaagtagataatacttaaaatggcgtaataattctgcacttgaatttgtactgttaacagcacatttggaagattttaaaactttttattgtcttataaatagcattcacttattatttggatatttaagggttccattaagttaacactgtatttggacaaag

SEQ ID NO: 19735 - DNA, 367 bp, Homo sapiens
atggtaagtgaacaatagatgttgaccatatcagccccatgaaataaacaggaataccatgtggcccacagtcagttggtaaatccttaagacttgggaggagggtcatattccagttcacattccagttttagattctcgcttatcttaaagcattatagaccttgaactaaataagaataaaaatttgccccagtgcagtaagaaaatgaaaaggcattgaaatgagattcatactgttgttcattaataatatcttcatttcacaggagtgcaaaaccacatgaaaatttcaagaattcactgatctgatgcaaaataaaaatttatcattacatcttgaacccaggaagcttacagcaaagag

SEQ ID NO: 19736 - DNA, 354 bp, Homo sapiens
ctgagttcagaaaaaaagaaagagaattctccagaggtcatatgtgaaagaaggattaaggaagactggaaataaggatttgtagatggaattgagactcccaaatatacttggaccctcaaggagatactaccctagtagaacggtggactagaaaagctcacttagcacaggaagataacaggaagcttatgtattttaaattaggctctaggtgcaggattttcttttcaaggatacatggagtatttctaaaaaattacctacctacatactaagtcacaaagaaagtatcccaagttataaacaatcaatatcctataactgcatttttaaatcaaatgtagtaaatta

SEQ ID NO: 19737 - DNA, 356 bp, Homo sapiens
tctctgccaagatccatctaaactggtgtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcatttaag

SEQ ID NO: 19738 - DNA, 395 bp, Homo sapiens
ccaagattcccctgtctgcttgttctcattcagaccagttgtattaaatatttcaacttctgttataaagaaaggtcaatatatactattccacctgtcatcctaaattatgcacaaaatattcaaatatcttactcatttaacttcattgcttccagccgttcaaaccagggccagatgaggtaatcaatcatagagatagaattgccaccaaagaaggtcgcttcttattagtcagaacctgaacattaaacagcataaaagtatttcttacttgtgcatgtagtaagactcactagaaatgctgaagggaaataagtagagcaggtgagagaagtagtttttactccgatgtatccaagttgggtttttttctgatcaaaaagcttaattaa

SEQ ID NO: 19739 - DNA, 338 bp, Homo sapiens
agcccagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgctagtttaaggagactggccgaagctctgcccaaacaatctgtggatggaaaagcccacttgctactggagaggatgatgatgatgaaggtccagatcttg

SEQ ID NO: 19740 - DNA, 354 bp, Homo sapiens
ggcaaaagccaaacacacccctgagtcttcagagctcagagtaatggtggggtgaaactgaataggttaaatgaaggtcctttgtccaccgttttaaaaggtagggttgctggcacagtggctcacacctgtaatcccaacactctgggaagccaaggcaggaggattgcttgaggcaggagtttgagaccagcctgagtgacatagtgagactttgtctctacaaaaaatgctttgaaattagccaggcacagtagcatgcaccaaggatcgcttgacttgagcccaggagttggaggccacagtgagctatgactatccactgtactccagcctgggtaacagtaaaaaaaa

SEQ ID NO: 19741 - DNA, 309 bp, Homo sapiens
gacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtt

SEQ ID NO: 19742 - DNA, 402 bp, Homo sapiens
ttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaaacttagaagaaaattggaagatagaaacaagatagaaaatgaaaatattgtcaagagtttcagatagaaaatgaaaaacaagctaagacaagtattggagaagtatagaagatagaaaaatataaagctaaaaaaaaaa

SEQ ID NO: 19743 - DNA, 211 bp, Homo sapiens
cttagctgtctaatttttagagaataagattgttcattgcatttctgagtattatgtaacctatttttgcagaaggtactgttacattaagtgcatcttgtgtatcctgggttaaaaaaatgtaatcttttttgaaataaaccttcatattctgtataggtgctaaagtgttgagaacctttttaattgtaaaatgagaaccgattttcag

SEQ ID NO: 19744 - DNA, 301 bp, Homo sapiens
  misc_feature 31: n = A,T,C or G
taaaaagtgagatgagaaggccaggcgtggngcctcacgcctgtaatcagcaccgtgggaggccaaggcaggggaatcatttgaggtcaggagtttgagaccagccaggccaacatagcaaaaccctgtctctactgaaaatacaaaaattagccaggtgtggtgggtgcatgcctgtaatcccagctactcgggaggcttgtggcaggagaattgcctaaacccaggagatggaggttgcagtgagctgagattgcaacattgtactcgagcctgcgacagagtgagaccctgtctccaa

SEQ ID NO: 19745 - DNA, 317 bp, Homo sapiens
tctcttattcccccctcctagccctgcaaggtgctaggtacttgtgaggcagtgtactggagaggggagagcatggatcctggggtcaaagggcctttgccccacccttacttggcctctacctgcaggtgaccactggcacattctcctgcttgctcagcttcaggttcttcacctctaagatggggatgatgaaaacagtacctgtcatgcagaattgttgggaggattgataatttagatgtttatacatgtaatgtacttagatcagtgtctgctcttttcacttgatatccagtactatgtaagatagaagg

SEQ ID NO: 19746 - DNA, 274 bp, Homo sapiens
ctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggcttaaaaaaaaaaaaaaaa

SEQ ID NO: 19747 - DNA, 209 bp, Homo sapiens
gccaacatggcaaaaccccgtctgtactaaaattacaaaaattagctgggtatggtgcacatgcctttaatcccagctactttggaggctgaggcatgagaatcgcttgaacccgggaggcagaggtggcagtaagctgagatcacaccactgcactccagcctcggggatagagtgagactaggtctcctaaattaataaaaaaaaaa

SEQ ID NO: 19748 - DNA, 379 bp, Homo sapiens
cctatttcatcacaagaacgcacacatatacacgaatagacatcaaactcaatgctttattggtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgctggttaaaaaataggtggtagatattgaggcaagaatattgcaaaatacatgaagcttcatgcacttaaagaagtatttttagaataagaatttgcatacttacctagtgaaacttttctagaattatttttcactctaag

SEQ ID NO: 19749 - DNA, 258 bp, Homo sapiens
aaaaaaaactattaaggcttaggggttgctgagattgtcctggaatgcagtctcatggcctgctggggcaaccacaagtcaatatagagtttctggacaaccatttagctgtaggtattaagaagcttaaagagtttcttatctccctgaacctagtaatattttcctctaggaatctactttggggaagtaataagacaatcagacaatgatcaaaggaatatttataacagcaaaaaaaaaaaaaaaaaaaaaaaa

SEQ ID NO: 19750 - DNA, 342 bp, Homo sapiens
tctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggcagattctagtgctgagaagaaacacgtttggtttggagagccatggatggtgggtttcaggttagctacggcaatcctgaacttcctgaagatgtccttgatgtgcagctggcattccttcgacttctcttcagccgagcttcccagaacat

SEQ ID NO: 19751 - DNA, 370 bp, Homo sapiens
  misc_feature 312, 313, 314, 315, 316, 317, 318, 319, 320, 321, 322, 323,324, 325, 326, 327, 328, 329, 330, 331, 332, 333, 334, 335,336, 337, 338, 339, 340, 341, 342, 343, 344, 345, 346, 347,348, 349, 350, 351, 352, 353, 354, 355, 356, 357, 358: n = A,T,C or G
  misc_feature 359, 360, 361, 362, 363, 364, 365, 366, 367, 368, 369, 370: n = A,T,C or G
tgattatgggtgaattcagggttgtaaaaatggttctagagtgaaaaatcttgtagtataatttatatattaatggattaaagataaaatctcatgatttttcactgttctcagacttatctgattggattgcagctgcaataaaaggatttaatgtatttcaacatttacttagcactacaattcaagtaataggaaaccttaaacattttaaaagtcaaggaggcaaggatgttagccacaattaactgaattaatgttcaacataacgttagaagcctgacaataaaataaaacaaacaaacaaaaatnnnnnnnnnnnnnnnnnnnnnnnnnnnnnnnnnnnnnnnnnnnnnnnnnnnnnnnnnnn

SEQ ID NO: 19752 - DNA, 355 bp, Homo sapiens
aaaagcaaaaatagacaattgtgattacatcaaactaaaaagcttttgcacagccaacaagtaacagagtgaggagacaacctacagaataggagaaaatatctacatactatctatctaacaaggacttaatatccagaatatataagaaacttaacagcaaacaacaacaacaacaacaaataacccaatttaaaaatgggcaaagaaaagaccttaattaacattactcaatgaagacatacaaatggccaggaggtatacgaaaaaagaaaatgctccacatcacaaatcaccagggaaacacaaattaaaaacacaatgagataacacttcactccaattagagtggctg

SEQ ID NO: 19753 - DNA, 267 bp, Homo sapiens
ataatgcattagccattagtcagagttgttttttaacatgccagagaaaaagttgtaatgccttggaagttattctcttttctatagattgtgttcaaaagatgtgtatacttgcaataagatttatgttaaggtggctttaacaattggttgctattttccttctttagtcaatatgactttgatgtcattaactgctaagtgttattttctaagaggaattttatcttttttttaaccttattaaaagcctttgaaaacacaaaa

SEQ ID NO: 19754 - DNA, 315 bp, Homo sapiens
acttaggagcaatgcaattatgaatttcttgaggggggaaaaaggagagataagttcagggaagtcagctaacatggtatatgggtaggtctgggcagcaaaagggttaatcagattttcattttagatagtcgccttagtaacaatcagagagcccaggctgtatcttttccgtttgtggggaatgtttagatttacagagtagcttagcttatcatatacctaccttgattgctggataaggcttgtgattaaaaacagaataagattcatttttataatattgtaaagaagagcaaaacattaaaaatgatg

SEQ ID NO: 19755 - DNA, 375 bp, Homo sapiens
  misc_feature 4: n = A,T,C or G
ttgnagaagatagaagtttgaagtggaaaactggaagacagaagtacgggaaggcgaagaaaagaatagagaagatagggagattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaaattagaagataaaaacatacttttagaagaaaaaagataaatttaaacccgaaaaaaaaaaaaaaaaaaaaaaaaa

SEQ ID NO: 19756 - DNA, 293 bp, Homo sapiens
ggagggaaccgaataacacaagtacaggtgtgcaaaattacttagtaaaactattttttctattactccttttttgcaagtacatacattaaatgataaatttattgtgaagttaataaaatgcccatagctgttctattaccttcagaaactattttcataattgaaaaaaacttggaataagtacatgtgttatataacaacgaccctagatgctcaaatgcataaaggaaacatccacaaatcccctgtagatttataaaactatacggtcaaataaaatcacagtgacg

SEQ ID NO: 19757 - DNA, 228 bp, Homo sapiens
ctattgctgtttcccaatgatatgattggatacctagaaaaccctaaagactcatccaaaaagcttctagaactggtaaatgcattcagcaaagtttcaggatacagagttacacacaagtgtgcacaaatccgtagctgtgctatacaccttcagcgaccaagccaagaatcaaatcaataactcaaccctttttacaatagctaaaaaaaaaaaaaaaaaaaaaaa

SEQ ID NO: 19758 - DNA, 349 bp, Homo sapiens
atttgccacagtagaagtgacagataagcctgtggatgaggctctacgggaagcaatgcccaaggtcgcaaagtatgcggggggcaccaatgacaagggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggacgggaaggcatcactgtctattccatgcagtttggtggttatgccaaggaagcagactacgtagcacaagccacccgtctgcgtgctgccctggagg

SEQ ID NO: 19759 - DNA, 412 bp, Homo sapiens
atccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatgggttatggatacaatgctgcctataatcgctacttcaggaagcgccgaggggaccaaatgagactgagggaagaaaaaaaatcttttttttctggaggctggcacctgattttgtatcccctgtagcagcattactgaaatacataggcttatatacaatgcttctttcctg

SEQ ID NO: 19760 - DNA, 366 bp, Homo sapiens
ggacagagcagaagaaccctcttggactggacgatttgggaattcaaaacttgggacaaactgtcagccttggtaagtcagcaaggctacactttgctttcagaaacatttgaaagagggacatttttgccaattaatagatgaatttttttcctttattttcttcctgcttttctttgtctaaggaaacattgttttgaatttaaaatagtttggttttggaaacacaatgtaaactttgtttctgctcagttaaaatacgtttcccagttttaaagatactatttactgtatgctcctgcttacattgatttttttttaatcaaagtaatactgctcactacaaacaggacaaatgtgtccccc

SEQ ID NO: 19761 - DNA, 360 bp, Homo sapiens
aagagattaacaactaataataaaagagaacagttataacagtataatgcaataaaagtcatgtgaggccaggtgcactggctcacgcctataataccaacactttgaggggccaaggcagaagactcacttgaggccaggagtttgagccagtctgggcaacacagtgagaccccatctctacaaatgtatattttttacattagctaggcgtggtgggacacacctgtagttctaactattcaggagacagatgggaagatcacttgagcccaggagttcaaggctgcagtgagccatgattgcatcactcactccactgtgggtgacagagtgagaccctgtctcttaaaaaaaaaa

SEQ ID NO: 19762 - DNA, 374 bp, Homo sapiens
ggcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgccactcctgatgctgttatggcaaccctaaggtgaaggctcatggcaagaaagtgctcgggtgcctttagtgatggcctggctcacctggacaaccttaagggcacctttgcacactgagtgagctgcactgtgacaagctgcacgtggatcctgagaacttcagctcctggcaacgtctgg

SEQ ID NO: 19763 - DNA, 355 bp, Homo sapiens
tcatgtattaattcttttagtcattttaacaacccacagaggtaggtactactattgttgtattttacagataataaaacttaggcgcaaaaacattaaataacttgcccaaggtcttgaagttagtatgtagcagaggcaggattcatgtttagttggtttggcttcagaggtcatactcttaacctatactactttgggcattattaggtcttatgtttgtaattttggtgcctttgtaatattggttaagatgcttttttgcgagaaatagaatctgatactgggtagcttaagtgaaaatgaaaatatattgggaagataataggacatttcacatactccaaaaaaaaaa

SEQ ID NO: 19764 - DNA, 347 bp, Homo sapiens
  misc_feature 324: n = A,T,C or G
ctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaaagaaaagctggcaacttctatgtacctgcagaacccaaattggcgtttgtcatcagaatcagaggtatcaatggagtgagcccaaaggttcgaaaggtgttgcagcttcttcgcttcgcaaatcttcaatggacctttgtgaagctcaacaaggcttcgattaacatgctgaggattgnagagccatatattgcatgggggt

SEQ ID NO: 19765 - DNA, 334 bp, Homo sapiens
tcattatgtaaaactaattataaacaggacccaatttatattcatagatcctctcaagtattatacaatttaaaaactcttgttccaaagtcctgtcttaactattgaaacaccttaatctgtggttactaatccagcaaattcaaggaaccaggctatgactaagaatttaggtggaattgatgtctgggcaattaaaataaatggcataagagcttaaaaaccaaagttgtgccagtggctttcaactagaggcagtaacctgtcattccagaggatgctgagaaatgtgtaggggcacttttttggttgtcatatttactaggggcttctg

SEQ ID NO: 19766 - DNA, 325 bp, Homo sapiens
aggactctgccttgaatgactatttgctctcgagaaagttcagggcttcttgtgatagagaataaggagagaaatgggagagaatagggagaaaaaacaaaaacacctctcttgaatgtgaaacacagatgttttattttagtgaagttgaagagaaaagtgaagctgaagagaaaattgcacaaagcacagctgcattgtgcaagaaaaattatttgttgaaagaaaaataaatttgatattaggcagttttgctgaggattatatatccattttatttccttaaaaaatacaagtgaagggctgggcacagtggctcatgcct

SEQ ID NO: 19767 - DNA, 383 bp, Homo sapiens
ttgacataccgacgtaggctttcctacaatacagcctctaacaaaactaggctgtcccgaacccctggtaatagaattgtttacctttataccaagaaggttgggaaagcaccaaaatctgcatgtggtgtgtgcccagcagacttcgaggggttcgtgctgtaagacctaaagttcttatgagattgtccaaaacaaagaaacatgtcagcagggctatggtggttccatgtgtgctaaatgtgttcgtgactggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgc

SEQ ID NO: 19768 - DNA, 333 bp, Homo sapiens
tttaacaagaaacttacagcctatttagatcttaacctggataagttctatgtgatccctctgaacatttccattgttatgccacccagaaacctactggagttacttattaacatcaaggctggaacctatttgcctcagtcctatctgattcatgagcacatggttattactgatcgcattgaaaacattgatcacctgggtttctttatttatcgctgtgtcatgacaaggaaacttacaaactgcaacgcagagaaactattaaaggtattcagaaacgtgaagccagcaattgtttcgcaattcggcattttgaaaacaaatttgccg

SEQ ID NO: 19769 - DNA, 343 bp, Homo sapiens
tatttaaaaaagaaaaaggaacataacccaggagtctaagttaaatctaatattgttaatactgaacttgcaggtccaggttggtatacattccaccctctagaagtattttcttacagtagataagctgctcacattttgttttgaatggacatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctaaaaaaaaaa

SEQ ID NO: 19770 - DNA, 443 bp, Homo sapiens
cactaacccagaagtagcaaagcagtcagtgatggtgaacattagaggtcaaacatgagttagatgtttgtgggctgacagccatcgtggctatgaccagtactatttacaaagcatgaattcactacaatgctcaactgtttgtttagctttatctcacttggggaatttattcctgtctgctgcattgtaggtagctgggtaggatatatttccacttgctttttaaattagttcttcacctccattgacactcgttttttggttttctccctatagtatgggttgggctagacaccagtctgacccacagaatgggaggtatttcatccatctttcctccatccttccaaaaaccacatatctacacaaggaaaaatttaatacatctaggaattttttttttaattacaagctatttaaagagatgaatgtggccaaag

SEQ ID NO: 19771 - DNA, 317 bp, Homo sapiens
cctttggaatatacaagacatgcgtttggagttacctttgtttttctatcgtaaatttagattctggaattggggtttggtggtgcaatgtgttgctcacaagtggcagaactcctattcctaaaaggattttgagatggaggaacacatatttaattcccctttatgccttggttcttgctcctctttccacgttggataacaattttttggttgttttgtttaagttggtgctctgaagcttaatctcagtaccctttactctgaattgcaaattttgataaaacgtgccattttctttggtaagagaaagcagg

SEQ ID NO: 19772 - DNA, 406 bp, Homo sapiens
tgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggcaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagagg

SEQ ID NO: 19773 - DNA, 359 bp, Homo sapiens
gtttcataaagacatcgaaaatgctatcttgcaatgtaaattatgtttagggatacttgcaatgaatgtttcatgaagatgaaaatgtatttctagtgaatgtaccaacttgtttataaaaagtaactttatgttaattaactctaaatgattcatcctaattgaggagtaattactgtgaagaaaagataatttttatcttgtaactttactgaataattttcaacgtcctttttcataatatttgctagagttactagtaatagaaacttatgcaggatgttcttttatcaatacatttcaacttatacatgccctttggatgagattgaggtgagaaattaaaaacatgagaatta

SEQ ID NO: 19774 - DNA, 290 bp, Homo sapiens
gtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcag

SEQ ID NO: 19775 - DNA, 318 bp, Homo sapiens
aaaatgatcaagccttcatttattttaggctttgttttttgatccattttgttttccctgctgtaatgagaataattgtttggaaatgtcatattctgtatttatgattctctgagaaatgcttttgtataagtcttaggtttgacattgcagtagttgacatacacggtaaaggataacctagtgacaaatcactgaagatgcttcctttgttacctcaaaaaaaaaaatccagacaaaatagcatttataaatatagaaaacaggattggctgtttccaagaacttcaagttaacaattcttatgcaaggaaaagt

SEQ ID NO: 19776 - DNA, 227 bp, Homo sapiens
aaataatgaaatgagatgaaatgaaataatgaaatgatgagatgagaagaaatgatgagatgaaatgatgaaatgatgagatgagataaaatgagatgaaatgatgagatgaaatgatgagatgaaatgaaatgatgagatgagatgaaatatgatgagatgaaatgacataatgaaatgaaatgatgaaatggaataatgaaatggaaatgatgagatgagatgca

SEQ ID NO: 19777 - DNA, 381 bp, Homo sapiens
aggaggtgagcagggctttgtaatgacaatttttcaaagtttaactttatcagatggaagaaggaagccctttagcattttcaatggcagagtgacatgaaataatttgagattttgaaatttactcttactacattactgtaaaaggatttgtgaaagcattcactggaaacaaggaagtgagttaggactgttttaaaggtgtaagaattgatgatggaggaaggaataaacaaataggtgagtacaaatcacacctgggtgatagaattaaaagatttgccgctataagaagtttggaaatgtactatttatttatgtaattatttctccctcattcaaaatcagtcttgaattaagtctacccagatataaaaagta

SEQ ID NO: 19778 - DNA, 213 bp, Homo sapiens
agatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaaaaaaaaaaaaaaaaaaaaaaaaaaaa

SEQ ID NO: 19779 - DNA, 374 bp, Homo sapiens
gaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgat

SEQ ID NO: 19780 - DNA, 348 bp, Homo sapiens
caatgttattttcactatcgtgtcaccttgtaaagctctggtttaaatcacaagaaccacagtgtggcatttgtttattatgtattttgacaatccacaagctttatccaactcatatgaggtaattctttgaacctaagtatgcatttttaaggatatgaaaggatatatattttgtgaagcaattaaaaccctagagtactttcataggaagaaatttaaattataaccaaatttgtttgactggcacaaaatgaaaggatattaactcattgtttcttgtcttgtggatgattacagtttatgtccactctttgtctaatcaccttctttcttatgcattaaagt

SEQ ID NO: 19781 - DNA, 250 bp, Homo sapiens
  misc_feature 25, 49: n = A,T,C or G
accaacatcgagcagatttttaggnctttcgtggtcagtaaattccggnaaattcaacaggagctttccagtggaaggaatgaaggccagctgaatggtgaaacaaatacacccattgaaggaaaccaggcgggtgatgcagttgcctctgcaaggagtctaccaaatgaagaaatagtgcagaagatagaggaagtactttctggggtcttagatacagaactacgatataagccagacttgaaagagg

SEQ ID NO: 19782 - DNA, 328 bp, Homo sapiens
ctcccaacatgcctgtgctctcattttaccctgtggcgtccacttgaatatcttgacacagacagagctctgttacagcactttatgcatggtcacgtggtactcacaacatgcccaagtgactgagagcgaaaagcaccagggtatgcctgacacattggaagaacccactgcccagcttggcagggcgcctcagagtgtcttccaaataccacctgcagcagaatcacctgagatgcacgttaaggtgcagatcataggactccacccctggctacccaatcagcctttaggtggcagcacctagaaatctgcattttaacaagtt

SEQ ID NO: 19783 - DNA, 353 bp, Homo sapiens
atttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttacttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgtcttagattaaaatgaaatatgctattgaaaccgaaaaaaaaaa

SEQ ID NO: 19784 - DNA, 113 bp, Homo sapiens
  misc_feature 62, 110: n = A,T,C or G
taactattaaaccattgaaactattattttatatttgtgttaatgagagtcaaaattattgngcattcatctcaaataattctattattttgaaaaatacaggttttttnttc

SEQ ID NO: 19785 - DNA, 283 bp, Homo sapiens
atggacgtctgcgttgagattgaaaatgttccctgtgaatttgtgtagaaccttgcccccgttaccccattatcctgggtggcttgggcaacagcgagggaaatgttggatacgtgcagatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaagtataccccacagcacgtgcatcg

SEQ ID NO: 19786 - DNA, 361 bp, Homo sapiens
acagtctgaaatactctctggagccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactggctttttttcctatgtctcttgggaactgcagctgcaatcccgcaaatgcaagattattatctgatcattccaaaccaactgc

SEQ ID NO: 19787 - DNA, 370 bp, Homo sapiens
gattccttgaaggacaaagcacggaagctgtacaccatcatgaactcgttctgcaggagagatttggtattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactggtatgtatctctctaccttctggaaaacagggctggtattcctacccaggaacctcctttgagcatagagttagcaaccatgcttctcattcccttgactcatgtcttgcca

SEQ ID NO: 19788 - DNA, 189 bp, Homo sapiens
  misc_feature 16: n = A,T,C or G
aaagggaaaggagagnaaaactgcaaattgggagacttggtcaacttttgtatttttcgtctaggcacatagttatttactgattaacagctagtaacttgtacccatcataatggatgtgtaagtttagaggaggtggaatatataacagtcatttccctttgtacatgtgccttagagctaacattg

SEQ ID NO: 19789 - DNA, 349 bp, Homo sapiens
tatcaagcacattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgcttagagcccgctttatgtttaaaactaatttcttaaaataaagccttcagtaaatggtcattaccaacttgataaatgctactcataagagctgggttggggctatagcatatgcttttttttttt

SEQ ID NO: 19790 - DNA, 243 bp, Homo sapiens
aggctgaggcaggagaatctctggaacctgggaggcagaggttgcagtgagccaagatcatgccattgcactgcagcctggcaacaagagtgaaactccatctcaaaaaccaaaaaaaagaaagaaagaaagaaatcattagcagtaagcagcaaacatgagttcaggaacttaagggtgacaatgtaagacaaagaattaaaacctttaaaccagcaaaaaaaaaaaaaaaaaaaaaaaaaa

SEQ ID NO: 19791 - DNA, 203 bp, Homo sapiens
aataaaaacacataaataaacttggttaggtattatttatgtggtaactgattttcaacaaaggtgccaaggtaattcaatgggaaaagaatagtcttttcaaaaaaaagaaaggccgggcgcggtagctcacgcctgtaatcccagcactttgggaggctgaggcgggttgatcacgaggtcaggagatcgagaccatcctg

SEQ ID NO: 19792 - DNA, 302 bp, Homo sapiens
accttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggcaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggtg

SEQ ID NO: 19793 - DNA, 325 bp, Homo sapiens
ccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactgg

SEQ ID NO: 19794 - DNA, 322 bp, Homo sapiens
agcacttggacacgtttcttgtattctgccttaactacaaaatggtgggggggagggagactaagttttttccaggtaaaagttgcagcacatgcatagtacatgatttctgcagaatattagtgacaaaaactcagaagtcttcctggtttactactgtgtttccagactgttttaagctcactcgatactatatggctattctctaaattattttgttgcattactgaatgttaatgtaggtattaagattgagttggggaaaaaaatccacagaaatagcatatcaatatctctgaatttcagaatctttcccttttgg

SEQ ID NO: 19795 - DNA, 327 bp, Homo sapiens
gcattatctgcttctcagaggcaagtatgctatcagcttactgtagtatcctgcaccttttgtttttagggactataatttgctgtgccaggagagcacttacttactttattgagccaattatctttagcattttatagaatttctcacactgaattttacaccactggggctcttttgcagggtgaatatagccagagcaaccaaacaaacaaaaaaagaaagtccgttctcaagtatgccttattctccttccacgttgcttcaccgaaaactttttgaggaagaaaatttttgtggagaggattttcagggagtgtttcattt

SEQ ID NO: 19796 - DNA, 347 bp, Homo sapiens
tcacccatttactcaaaaaatatttgacgcctactatgtgtcaggtcgtagtcggtactatttgttggagggaagaggaaatacaccaaaatgaataacacagtttctgtccttaaaggagctcgctgctcagtggaagagaaaagaactaaagaggcagatcagtgagaaaaatgtgcaatataacacattattaaaatgagaagagagagttaaacaatcaacatcattaactctgtggcatttccttaagatatcatgaattataagacatccttttcttaacatcaggtaaaggaaaatctttcattaaatgtgtataatgattctgagcccacgttagtttc

SEQ ID NO: 19797 - DNA, 308 bp, Homo sapiens
cccattccagtgagttcaccctctaaatcaccacgatcaaaagggacaagcatcaagcacgcaacaatgcagctcaaaacgcttagcctagccacacccccacgggaaacagcagtgattaacctttagcaataaacgaaagttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaa

SEQ ID NO: 19798 - DNA, 361 bp, Homo sapiens
ttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgctttta

SEQ ID NO: 19799 - DNA, 347 bp, Homo sapiens
tccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggaaaaaaaaa

SEQ ID NO: 19800 - DNA, 160 bp, Homo sapiens
atgtatttctgccctttctgtaaactttaaaaactacacctacaagtaaacatttcaaagggctgaaagagattagatttgttaattaaacattccaagggtactttcagatgagactagactaagaaagtttgagactacactccaaaaaaaaaaaaaa

SEQ ID NO: 19801 - DNA, 254 bp, Homo sapiens
gatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggataattatggtgggtgattattttttatactgtatgtgccaaagctttactactgtggaaagacaactgttttaataaaagatttacatttca

SEQ ID NO: 19802 - DNA, 129 bp, Homo sapiens
gaaaggaccagttcgaatgcctaccaagactttgagaatcactacaagaaaaactccttgtggtgaaggttctaagacgtgggatcgtttccagatgagaattcacaagcgactcattgacttgcacag

SEQ ID NO: 19803 - DNA, 351 bp, Homo sapiens
atactacttttccattagtgaggctacagttatgttttaaatgtgcgattacagagatggcatctgaacataaactgatggctcgaaaatgaaaatggaaatgtagcagccatatactgctaactttggatctgttcctgaattcaaaactactaggagaaaagtgtcctttataaaaaggaccttattaatgcctaaaaaacatcatattctctaggaaagcttgtgctgtttccttagggaaaatgtttgccttttaaaaactgtgatcctttaggatgatcatgactttccctttccttatggaaatgcaagaataaaatatttcattaaacaatgaaccttgaaaat

SEQ ID NO: 19804 - DNA, 162 bp, Homo sapiens
aaatttaactgttagtccaaagaggaacagctctttggacactaggaaaaaaccttgtagagagagtaaaaaatttaatacccatagtaggcctaaaagcagccaccaattaagaaagcgttcaagctcaacacccactacctaaaaaaaaaaaaaaaaaaa

SEQ ID NO: 19805 - DNA, 170 bp, Homo sapiens
tttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccg

SEQ ID NO: 19806 - DNA, 337 bp, Homo sapiens
aaaaagcactgtaacagaaatgaagaatgccattgatgttcttattagtagtctagacatggctgaaaaagaatcaatgatctttaaaatatgccagtagagactttccaaactgaaaaacaaagaagactgagaaaaaaatggaacagaatatccaccgctgtgggcaattacacatcacatacacacaatgggaataccagaaggagccaaagagcaaaaggaacagaagaaatatttgacgcaataatgacggagaacttcccaaaccacatattcaggaaagtcagaaaacaccaaatagcatgaatgccaaaaatgacatgtaggcatattg

SEQ ID NO: 19807 - DNA, 315 bp, Homo sapiens
ttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggatgccctctttcaatttccttg

SEQ ID NO: 19808 - DNA, 264 bp, Homo sapiens
  misc_feature 115: n = A,T,C or G
aaagaggccagtagagactgaattatcaaatattgatatcccactcatacatcttggtgccattcacatgtgcgtgtgttcaacttgtattcttaggaggaatagtaatagtttngcaagaaagcatattttttctttgtaaacatttacaggtgttaagtcacttttacaaattcagtgctttatagcttcttgatattctgcttttggcactttaatgaagtactacttgtgagaaggtgtggcacataataggttgaatgg

SEQ ID NO: 19809 - DNA, 307 bp, Homo sapiens
actttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattgggtttatttttttgatgaagccgagcaactctgtccaaaaagggttagtttgtctcggaaaccacaaagtagtctcaaagtattttagagggaatcgatattgatggcaaaagaaaatttgcagctatgcatttgcttctaacggt

SEQ ID NO: 19810 - DNA, 370 bp, Homo sapiens
tatactattatataaatcaaaacatttatcctactaaaagtattggagaaagaaattcgtacatctaggagctatagaactagtaccgcaagggaaagatgaaagactaattaaaagtaagaacaagcaaagattaaaccttgtccttttgcataatgaactaactagaaaacttctaactaaaagaattacagctagaaaccccgaaaccaaacgagctacctaaaaacaattttatgaatcaactcgtctatgtggcaaaatagtgagaagatttttaggtagaggtgaaaagcctaacgagcttggtgatagctggttacccaaaaaatgaatttaagttaattttaaacttgctaaaaaaacaacc

SEQ ID NO: 19811 - DNA, 233 bp, Homo sapiens
gacacagaagagaagcccactatctcatttaatctttacaactctcttgcaaggctccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctcc

SEQ ID NO: 19812 - DNA, 141 bp, Homo sapiens
gggtcacacaaggtctacattacaaaaagacagaattcaggggatggaaaggagaatgaacaaatgtgggagttcatagttttccttgaatccaacttttaattaccagagtaagttgccaaaatgtgattgttgaagtac

SEQ ID NO: 19813 - DNA, 287 bp, Homo sapiens
aaagcttggattaaatacatatggatgttactctcttgcaccaaattatcttgatacattcaaatttgtctggttaaaaaatagatggtagatattgaggccaagaatattgcaaaatacatgaagcttcatgcacttaaagaagtatttttagaataagaatttgcatacttacctagtgaaacttttctagaattatttttcactctaagtcatgtatgtttctctttgaatatttgcatgttatgtttaataagctactagcaaaataaaacatagcaaatggc

SEQ ID NO: 19814 - DNA, 249 bp, Homo sapiens
aacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgtcaagctcaacacccactacctaaaaaaaaaaaaaaaaa

SEQ ID NO: 19815 - DNA, 374 bp, Homo sapiens
  misc_feature 9, 53: n = A,T,C or G
acaaccctntctcctcagcgcttcttctttcttggtttgatcctgactgctgncatggggtgccctctggagaaggccctggatgtgatggtgtccaccttccacaagtactcgggcaaagagggtgacaagttcaagctcaacaagtcagaactaaaggagctgctgacccgggagctgccagcttcttggggaaaaggacagatgaagctgctttccagaactgatgagcaacttggacagcaacagggacaacgaggtggacttccaagagtactgtgtcttctgtcctgcatcgccatgatgtgtaacgaattctttgaaggcttcccagataagcagcccaggaagaaatgaaaactcctctgatgtgg

SEQ ID NO: 19816 - DNA, 314 bp, Homo sapiens
cacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagtctacacattacattgaaggtaaacacaaaattatcagtgttttagaaacatgagtccggactgtgtaagtaaaagtcaaacattattt

SEQ ID NO: 19817 - DNA, 428 bp, Homo sapiens
gagccctcagaaataatgccacatatctacaactatccgatctttgacaaacctgacaaagaacaaacaatggggaaaggattccctatttaataaatggtgctgggaaaactggctagccatacgtagaaagctgaaactggatcccttccttacaccttagacaaaaattaattcaagatggattaaagacttacatgttagacccaaaaccataaaaaccctagaagaaaacctaggcaatactattcaggacatgggcatgggcaaagacttcatgtctaatacaccaaaagcaacggcaacaaaagccaaaattgacaaatgggatctaattaaactaaagagcttctgcacagcaaaagaaactaccatcagagtgaacaggcaacctacagaatgggagaaaatttttgcaacctaatcat

SEQ ID NO: 19818 - DNA, 367 bp, Homo sapiens
  misc_feature 300: n = A,T,C or G
acctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgcagtccttttgcttcccaaccctgctgntaggctgctggtccctttgctcttgattaggagagatggaaggagatgagctccataactgaattgg

SEQ ID NO: 19819 - DNA, 321 bp, Homo sapiens
cattcatcccaccctctcacagttcggacttttctcccctctctttctaagagacctgaactgggcagactgcaaaataaaatctcggtgttctatttatttattgtcttcctgtaagaccttcgggtcaaggcaagaggcaggaaactaactggtgtgagtcaaatgccccctgagtgactgctcccagcccaggccagaagacctcccttcaggtgccggcgcaggaactgtgtgtgcctacacaatggtgctattctgtgtcaaacacctctgtattttttaaaacatcaattgatattaaaaatgaaaagattattg

SEQ ID NO: 19820 - DNA, 276 bp, Homo sapiens
aagatatctgaagataaacagctagcagtttgcctgaaatatgctggagtatttgcagaaaatgcagaagatgctgatggaaaagatgtatttaataccaaatctgttgggctttctattaaagaggcaatgacttatcaccccaaccaggtagtagaaggctgttgttcagatatggctgttacttttaatggactgactccaaatcagatgcatgtgatgatgtatggggtataccgccttagggcatttggcatattttcaatgatgcattgg

SEQ ID NO: 19821 - DNA, 217 bp, Homo sapiens
  misc_feature 165: n = A,T,C or G
aaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgcgaagntggcattggtgacgtccaggttgccttgagtaataaaaacgtatgttgcaaa

SEQ ID NO: 19822 - DNA, 283 bp, Homo sapiens
ataaatgcctcatttaaaaaagcagtatgaaatttactatgaatacaccaactaatacaacaaaataggaagaacaataatagaaataaatacatgtgggaatttagaatataataaaagtagtacctcaaatcagcaaggaaggagataggttattcaataaatatcattaggacaactggaaggtgatctggataaaaaaaagttgggtctatatcttgcatcttttaccctgacatatttttacaaatggcttatcttcctaatatatatagagatccta

SEQ ID NO: 19823 - DNA, 311 bp, Homo sapiens
tacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattagtttgttaaaagcaaaagtggtcgtgtgatatgctaaatgttaattactgattttatatgtttaaatcacgccaaacaaattatgtctgtgccatccagggctgttggtaatctttttctgag

SEQ ID NO: 19824 - DNA, 235 bp, Homo sapiens
caaaggacatgaactcatcatttttatggctgcatagtattccatggtgtatatgtgccacattttcttaatccagtctatcattgttgaacatttgggtttggttccaagtctttgctattgtgaatagtgccgcaataatgctatttaagaaaattacaaatagaagcccccaccgttctatctcagaaagaaaatatatgatataggtattagatagagagtgtgaatagtg

SEQ ID NO: 19825 - DNA, 385 bp, Homo sapiens
  misc_feature 40, 277: n = A,T,C or G
cacaaacaaatttactattcggacaaatacgacgacgagnagtttgagtatcgacatgtcatgctgcccaaggacatagccaagctggccctaaaacccatctgatgtctgaatctgaatggaggaatcttggcgttcagcagagtcagggatgggtccattatatgatccatgaaccagaacctcacatcttgctgtccggcgcccactacccaagaaaccaaagaaatgaagctggcaagctacttttcaggctcaagctttacacagctgtccntactttctaacatctttctgataacattattatggtgccttcttggttctcactttgatatttaaaagatgtcaatacactgtttgaatgtgctggaactgctttgct

SEQ ID NO: 19826 - DNA, 398 bp, Homo sapiens
aattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggacagctctttggacactaggaaaaaaccttgtagagaggtaaaaaatttaacacccatagtaggcctaaaagcagccccaattaagaaagcgt

SEQ ID NO: 19827 - DNA, 327 bp, Homo sapiens
ccctcctgaaaactgcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggcaaacctaacatgatcatcagtgtgaatggggatgtgatcaccattaaatctgaaagtacctttaaaaatactgagatttccttcatactgggccaggaatttgacgaagcactgcagatgacaggaaagtcaagagcaccataaccttagatggggg

SEQ ID NO: 19828 - DNA, 339 bp, Homo sapiens
tgacatcacgtgataaagcaaatgaacacaagtgactagattttgtgtcttatttagtcaaggctgcttctgtggcagcagggcaaacaatgttatcattatatagaggagcagtgtttacttcagtgtctcttcctagctcttaaaaatccagcctgtcttgaggtaaaacaattaatcttgtttgtcgatatctctaaactacaaactgatatttgaagggttaataaaaacattaaaatggagataggatatgaaaaagatgataggggtatagctccaaatgtagctttataaatttatgtaaaaaatagaaactaggtgccacaaaaaaaaaaa

SEQ ID NO: 19829 - DNA, 367 bp, Homo sapiens
ataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagccctgaataaagataagaagcatcactgaagataatacctggaagcatcatagtggtttcttaactctccaaaataagatttcttctctgtagcctacttgctgggttatcccttacagaatattagtaagatt

SEQ ID NO: 19830 - DNA, 331 bp, Homo sapiens
attcacaagcgcatccatggagtgggcttcaagaagcgtgcacctcgggcactcaaagagattcggaaattggccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattac

SEQ ID NO: 19831 - DNA, 339 bp, Homo sapiens
gtagataaggcacaaagcaggagagctgagggtgtccaggttccatgccctgcatcaccaagaacccttctccctggcttgaaatctttggaaattcctggtttgagtcacagagaagcattgtcatgggctcagtaaccctgccacccctgttatctccattctccctttggtcacagcagctgtcttaagacacaagaccatgcctgggccctacgtaggctggctgagaaggaaggttgctgcaatggcttccgaactccagggagcaagtgctgcttcagctcaaagtttccaggggctgggaataaggtggaggaatagccatcagaagaaagg

SEQ ID NO: 19832 - DNA, 352 bp, Homo sapiens
aacatagacttgaattatttttagggaaagcccctataatgaattcagaaatcactacaagcagcattaagactgaagttggaatattctggtgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcaatatggatg

SEQ ID NO: 19833 - DNA, 315 bp, Homo sapiens
  misc_feature 218, 224, 274, 277, 302: n = A,T,C or G
gaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgattgtaatctgaaattactgaacaacttctattcccatttttgctaaactcaatttctggntttggnatatatccattccagcttaatgcctctaattttaatgccaccaaattggntgnaatcaaattttaaaataataataanttgggccccccca

SEQ ID NO: 19834 - DNA, 143 bp, Homo sapiens
ccacccaccaacccaaactggaagccagctgggtgggaagtatggtggtaggtttcctgcaatggcagtaagggaggttcctgagtagggtgagtgtggcgctgagtgcaccgcacaccgtcctgcccaccgttagaagctgc

SEQ ID NO: 19835 - DNA, 181 bp, Homo sapiens
ccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaagg

SEQ ID NO: 19836 - DNA, 346 bp, Homo sapiens
gagattggtgttaaaaagtttgtgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctg

SEQ ID NO: 19837 - DNA, 378 bp, Homo sapiens
aaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgcatctaattcaagattacaacatctgtacattctaagtgtgtcagcttctgaaggtaaagggacactggatccagaagctatgga

SEQ ID NO: 19838 - DNA, 287 bp, Homo sapiens
aggccaggcacggttgctcatgcctgtaatcccagcactttgggaggccaaggtgggcagatcacttgagatcaggagtttgagaccagcctggccaacatggcgaaaccccatctctactgaaaatacaaaaattagctgggcatggtggcatgtgcctgtaatcccaactactagggaagctgagacatgagaattgcttgaacctgggaggcagaggttgcagtgagctgagatcgtaccactgcactccagcctgggcaacagagggagactctgtctccaaa

SEQ ID NO: 19839 - DNA, 340 bp, Homo sapiens
atgaatcttattcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcggctccactttagaaattttcaataaccagatgagaaaaaaattaagaaattgctcaagggaaacatttgtaaatggatttgaaagattgagccaaattctgttgtcaggtctaagcatgcagt

SEQ ID NO: 19840 - DNA, 365 bp, Homo sapiens
tacatgacagggaaaagtttctggttttggattacttctgtcaaagctcagtactcgcaggcttgtatttaatcctctccctttgctactttccctaccaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattgctatttaaaacttgtaatttttttaatttacaaaaatataaaatatgaagacataaacccagttgccatctgcgtgcaataaaacattaatgctaacacttttt

SEQ ID NO: 19841 - DNA, 190 bp, Homo sapiens
gcattatatttttaagaatggcagacctgtttgctgaagtgttcataagataacaataggcttgaatctccaattcaaatgaatgtcaaagcacatatctttaatatgctgaatgaatatttatttttgtatccattaaaacagtatattgatctcttttattctttattaaaataaaatgctctttttt

SEQ ID NO: 19842 - DNA, 175 bp, Homo sapiens
  misc_feature 42, 45, 55, 56, 62, 125, 164: n = A,T,C or G
cacctctacaaactgggaaaaatgaagacaagaactctatcnacngaaattattnncaaccnttccccaaataacaatatttcagaggctttgaaaaaatttggtatctcagcaaacgacacttnaattctaattgtttacattgaagagggagaaaaacaaanaaatcaagaat

SEQ ID NO: 19843 - DNA, 286 bp, Homo sapiens
  misc_feature 56: n = A,T,C or G
tgcacgaggagcgattcctcaagaacattggctggggaacagaccagggaattggnggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaaggtattactttggcattattggaatatttatatcttagctggctgaccttgcac

SEQ ID NO: 19844 - DNA, 352 bp, Homo sapiens
gaaagaacagaagcaatactgctgaaaataaaagtattttaatagaaggaagcccagtaaggaagcccagtaaattcaactgaaaagggacaaagattaagaagaaagaagctattatgaaagacaaaatacaatcaagaattgggaccactgaagtcccagatgtagagaagtcaacaaatgggacagaaaattcaaataaaaataagtccaaagaaagcttattgggatgaagaaaaaatggtctgtaggccaaaggaacatgccatgttccagaaaatgtcatgtgggaatacggaagcactacgatatcttaaactatttaaattcaaagaaaaagatttaggaatcc

SEQ ID NO: 19845 - DNA, 304 bp, Homo sapiens
  misc_feature 253: n = A,T,C or G
aaggggtttgtccaaaataaatattgtggccttatatatcacactattgtagaaagtattatttaatttaaatggatgcagattgtctactaaagaaagattatatataactatgctaattgttcataatcaacagaaaccaagatagagctacaaactcagctgtacagttcgtacactaaactcttcttgcttttgcattataaggaattaagtctccgattattaaggtgatcaccctggatgatcagtnttctgctgaaggcacctactcagtatcttttcctctttatcactctgcatt

SEQ ID NO: 19846 - DNA, 463 bp, Homo sapiens
caatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtgggctgaccagggaattctttggtggacattggcccagtctggttcaaataaatgaactcaatctaaataaaaaaagaaagaaatttggaaaaaacttctcttggcaa

SEQ ID NO: 19847 - DNA, 370 bp, Homo sapiens
  misc_feature 73, 278, 323, 357, 364: n = A,T,C or G
ggggttgataactgtgccatctgcaggaaccacattatggatctttgcatagaatgtcaagctaaccaggcgnccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgntacctaattacaaattggatggaactgtgtttttttctgctttgntttttcaagtttgctgtttctgtagccatattgnattctgngcaaat

SEQ ID NO: 19848 - DNA, 230 bp, Homo sapiens
  misc_feature 132, 133, 134, 141: n = A,T,C or G
gccactaattttagtattcattctgcattgctagataaaagctgaagttactttatgtttgtcttttaatgcttcattcaatattgacatttgtagttgagcggggggtttggttgctttggattatatttnnncagctgntggttttgcttgttatattaagcagaaatcctgcaatgaaaggtactatatttgctaagactctagacaagatattggacataaaagaa

SEQ ID NO: 19849 - DNA, 352 bp, Homo sapiens
tgaactaatctttacttttcttaccatgatacaggctcagaaaattgtaacatctgcagaaagcaaatgcataaagaatgtatgtatgcaccctacaaacaggtcataaaatgtacttttttagctaccatgatgtatttggagtcaaaagaattctacctgtcactctacttgttagttatgtgactctaaacagattactcaagcctggtttgttcagactataggctgggatcataatacttgcagagctacactgaaattgaaaagtccatattagccaggtgtggtggctcacacctgttatctcagcactttcagaggcctccacaggagaatcactggagcccag

SEQ ID NO: 19850 - DNA, 134 bp, Homo sapiens
caactatgaagaattcgtacagatgatgactgcaaaatgaagacctactttcaactcctttttcccccctctagaagaatcaaattgaatcttttacttacctcttgtaaaaaaaaaaaaaaaaaaaaaaaaaa

SEQ ID NO: 19851 - DNA, 355 bp, Homo sapiens
gagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggag

SEQ ID NO: 19852 - DNA, 137 bp, Homo sapiens
gcctcgctgaggaaaaataactaaacatgggcaaaggagatcctaagaagccgagaggcataatgtcatcatgcattttttgtgcaaacttgtcgggaggagcataagaagaagcacccagatgcttcagtcaactt

SEQ ID NO: 19853 - DNA, 282 bp, Homo sapiens
aacggggatatcgtctttcatcacgttctcacacaattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaact

SEQ ID NO: 19854 - DNA, 305 bp, Homo sapiens
ttgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgtcattgtaacaaaattcaatcaaaaaggcagctaggtcagaaggaaacataccactctcatggttcatagtattcactgtatgtatgctagggaaaagacttgctc

SEQ ID NO: 19855 - DNA, 245 bp, Homo sapiens
ggtcccaatgtagctccatttccttgattctgacaactttacacataggtatgctgccatttacattccacatggctcctcacacatgtgtacaacatccatttaattcatttcgttataatgctgaaattcagtgagttccaaccatatgctaaggactgtgctaggtgctggaaattggtagtgagcaacacactgatttttagaagcgtgtatgttgaggagagggactaaaatattaaaaa

SEQ ID NO: 19856 - DNA, 247 bp, Homo sapiens
ccttccctcggtgtatcgcacacttctaggttctcattaaatattactaaaataagtaattcagagtatgataagctttgttcaggataagtgctgtaaactctacccaccaggatcacttcctctctatctataatccaacagttatttttgggttatggacctagtgggtaggttttgcaaacaagcagcttgagaacctctctaaacatagatgtatttctaaggggaattccaaaaaaaaaaa

SEQ ID NO: 19857 - DNA, 235 bp, Homo sapiens
cattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaccaccccccccttctg

SEQ ID NO: 19858 - DNA, 192 bp, Homo sapiens
gcttttaccagaaaaacatgggcaatatggtctagccttacacctcattgaagctgtggaagccatatctcttccttctttatgacacttacctactgtaaatagtctaaaattatgattataacatgaaggagtgcatggttattttacatagtaagacctggaattttatgggaaaagtatgtctttttt

SEQ ID NO: 19859 - DNA, 207 bp, Homo sapiens
ttttaaaaatgcttatagagaaaaaaattttaaaaagaaagctaatgctagtatatactgcaatgttaggggaatgaacatgttttcctactgcattggggacttctagatagggtaatgaaaggccttttattctgttactggacatgaaaactttggctaatttcttactctattgtacgtttacagtcgcagcactaaaaatgg

SEQ ID NO: 19860 - DNA, 139 bp, Homo sapiens
ttcttcttttggcaatacatttgatttggtcatgaatatattaatcagcattagagaaatgaattataactagacatctgctgttatcaccatagttttgtttaatttgcttccttttaaataaacccattggtgaagg

SEQ ID NO: 19861 - DNA, 171 bp, Homo sapiens
tgttttctctttgaaagatagagattaatacaactacttaaaaaatatagcaataggttactaagatattgcttagcgttaagtttttaacgtaattttaatagcttaagattttaagagaatatatgaagacttagaagagtagcatgaggaaggaaaagataaaaggtt

SEQ ID NO: 19862 - DNA, 317 bp, Homo sapiens
cagaataaaataacaatttaaaatatctagaaaaatctccaattatttggaaataaattaataatcttctgaatagctcatgattcaaaggataaatcacatgagaaatttggaaatatttcaaaatgaataataaaaatgcagtctatccaaatttatgagatgcaggttagtcactacttagagggacatttatagtttaaatacttttttaagagagagagagaaagaaggagggatagaggaaggaagaaaatcaatgctataacttttcatcttaaatagatggaaaatgaagagcaaattaaacccaaagt

SEQ ID NO: 19863 - DNA, 197 bp, Homo sapiens
tggttcagcataccttatagttcatatataacctgtattaattgtatagattgtgcattaaaagctgttaccaagttgtcagaacataagagcgaaaacaaggtcatatgtaatattttgtttgtaagtatcctttgtatcatagcaaaggaaatgtttaaaaaaatcaactgtaataaagtaattttagtacaccg

SEQ ID NO: 19864 - DNA, 302 bp, Homo sapiens
ttacaaactgcaacgagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtgg

SEQ ID NO: 19865 - DNA, 285 bp, Homo sapiens
gaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagct

SEQ ID NO: 19866 - DNA, 171 bp, Homo sapiens
cctgcctccagccgcccgcgccagattttgaaatctcggagacaaaactagtactgtaagataaatttttttgtactgtatttattgtgtataacgatttttttaaaggagaattctgtacatttagaactcttgtaaattaaaaaccgatcctttttttaaaactggaaa

SEQ ID NO: 19867 - DNA, 378 bp, Homo sapiens
ttcaaaaaatcaatgaatccaggagctggttttttgaaaagatcaacaaaattgatagactgctagcaagactaataaagaagaaaagagaagaatcaaatagacgcaataaaaaatgataaaggggatatcaccaccgatcccacagaaatacaaactaccatcagagaatactataaacacctctgtgcaaataaactagaaaatctagaaatggataaattcctggacacatacaccctccctagactaaaccaggaagaaggtgaatctctgaatagaccaataacaggctctgaaattgaggcaataattaatagcttaccaaccaaaaaaagtccaggaccagatggattcacagccgaattctaccagagg

SEQ ID NO: 19868 - DNA, 335 bp, Homo sapiens
acaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgacattgcctgttctgcttcgaagtattcaataccgctcagtattttaaatgaagtgattctaagatttggtttgggatcaataggaaagcatatgcag

SEQ ID NO: 19869 - DNA, 171 bp, Homo sapiens
tcaaaacaggtcctgttttgcacggcagttgattcaatattttcagaaacaaatttgccatttatatcagataaagttactagagtactgtatatacattttcctttctaattttacacacgctattatttatagagcacaaaacactcaaaactaaatcaggaaggatag

SEQ ID NO: 19870 - DNA, 197 bp, Homo sapiens
tttctggcctggaggctatccagcgtactccaaagattcaggtttactcacgtcatccagcagagaatggaaagtcaaatttcctgaattgttatgtgtctgggtttcatccatccgacattgaagttgacttactgaagaatggagagagaattgaaaaagtggagcattcagacttgtctttcagcaaggactgg

SEQ ID NO: 19871 - DNA, 186 bp, Homo sapiens
cttgattttgtttgtgtgtgcctttgctggcataagagaatccaggctgtgactgcctgttgtgtttcaggtggaggagtctggcgagcatgtgatcctgggcactggggagctctacctggactgtgtgatgcatgatttgcggaagatgtactcagagatagacatcaaggtacagcagtatct

SEQ ID NO: 19872 - DNA, 383 bp, Homo sapiens
tacatcctcagtgacctgggatcaatattttaaaaacctagcacatttaattgaaatctgggagggagaagaaaaacaatgaggaagaaaaatatatttaaaaatttaatggctgaaaatttcccaaatttggtgggtgccttatagttaaactattgacagacaaaaggaaaaatctagaaaacagcaaagaaaacaacacattagatacagggagagaattctgtttaccactgacgaatcatcagaaacagtggaggtcagaagcgaatagagaatctttaaaatgctgaaggaaaaaacatgtcagcccagaatttcagattcagcagaatagccttcaagaaagaatatgggaccgggtgtagtggctcactcctgta

SEQ ID NO: 19873 - DNA, 329 bp, Homo sapiens
gacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgg

SEQ ID NO: 19874 - DNA, 128 bp, Homo sapiens
cttagtgctcgaatgtcccaacctgaagctgaagaagccgccctggttgcacatgccgtcggccatgactgtgtatgctctggtggtggtgtcttacttcctcatcaccggaggaataatttatgatg

SEQ ID NO: 19875 - DNA, 456 bp, Homo sapiens
atttgcaacaaaatggagggaactggagattaccattttaagtgatataagccaagaacagagagacgatcaccacgttctcacttatttgtgggatctaaaaatcaagcaattgaactcatggagatagagaatagaaagatggttaccagaggttgagaaaggtagtgggtgattgagaagtgggtttggttaatggcacaaaaaacagaaacaatgagtaagatctagtatttgataccaaaacatgaagactacggtcaaaaataaattaattgtatactttaagataactaataatataataattatgttgtttataatacaaacaatacatattggagttatggataccccgtttacccagatgtgattattatccattgcatgcctgtatcaaaacatgtcatatacccaataaatatatatacctactatgtacatacaaaaaaaaaa

SEQ ID NO: 19876 - DNA, 191 bp, Homo sapiens
tgtctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcaggttcatgtatgtatataatcatgctcatgtatatttagt

SEQ ID NO: 19877 - DNA, 165 bp, Homo sapiens
ttcagatgtgtctacgtgcgctctgccattcaactcggaaactataagtaattctcaagaaagccctcatttttataacctggcaaaatcttgttaatgtcattgctaaaaaataaataaaagctagatactggaaacctcaaaaaaaaaaaaaaaaaaaaaaaa

SEQ ID NO: 19878 - DNA, 270 bp, Homo sapiens
gatagcactgtagaaagaaaagatgaaggcacaattctgtgagcccctgtacacggacaacgttaagattaggcacttattttcttaagagattctgcacgatcagttcagatgagtcagctcactgccatctttatcaattcgatagatttcaggttcctctaaggcactaagatatgtttattaaaaggcttgaggctgggcatggtggctcacatcttaaatcccagcactttgagaggctgatgcgggaggatcacttgagcccag

SEQ ID NO: 19879 - DNA, 374 bp, Homo sapiens
gctaagtttcctttcatcaaaatttaatattacgaattgtgcaaagaagtatgttactttgatcagctttattttagagcttctttatcaagttatcatcagtcctcttgaattatttctgaaataaggggaaggaaggaagggaaaaaatatgaatgcatagatagatctaagcagatgccttcagagccctggaataatcctagctgggatatgggacatgaaaacaactctggcctactgctgctgggggctgttgcatgggtgtgacataggaagtaaaatgttgctgtatgaataggaaggagggtcttcctgtcaatgagaattaatgttttcctaatgattaacttttttactgaaaaaataatatg

SEQ ID NO: 19880 - DNA, 154 bp, Homo sapiens
tcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtg

SEQ ID NO: 19881 - DNA, 325 bp, Homo sapiens
ctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagggaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatg

SEQ ID NO: 19882 - DNA, 139 bp, Homo sapiens
ggaacagcacaatggcaagaccattttcgcctactttacgggttctaaggacgccggggggaaaagctggtgccccgactgcgtgcaggctgaaccagtcgtacgagaggggctgaagcacattagtgaaggatgtgtg

SEQ ID NO: 19883 - DNA, 150 bp, Homo sapiens
tatacagttttctaacatagctataaggccttgttgctgtttgtgataactgatagataactcattggaaacgtgcatacatttatattcagatgaaattatggtttgcactgtctattaaatatctcgattaattttcaaaaaaaaaaa

SEQ ID NO: 19884 - DNA, 338 bp, Homo sapiens
gatgcttccctttaggaaaaaatgctcaggcagaacggggtacatccacaggaggaatcggacgagaggatgtgacattcggtccaggagagaaagagcagtttctgttaaagatgtaacaaatggatttccaaagtctacatgacattcacttttcaaacttcccaccagttgaatttctttttttccttaagaaacaggtgatggcttggaaaacagctccttatgtctctctgtgcatctccattttcctagtctctggagtctcaaaaagagtggcaaagcactttacagtagtaactgaggaatcagagtctctgcttcagcgatatctagtt

SEQ ID NO: 19885 - DNA, 341 bp, Homo sapiens
aaatattttctaaggctaagatgctcctttctgtaaatttccatggcattttgtacataattctattatgtttagaagtttcctgatataaacagaaggtgcaatagctggacgagtacatattcttttaatttaatgcaagaaattctaattcggcataaagggtaaaacgtatcagactctcatacagagttatgaagtagtataaatggaaaaacactaaattcctttgtgttgtcccataaaacaggaagcatcttaagctattggatgcctaaatatttgtatatcagaatctagaaaggagatggtaacctgtaatttgacattagatacagaat

SEQ ID NO: 19886 - DNA, 222 bp, Homo sapiens
ggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctggctagtctctcctgtaagccaaagaaatgaacattccaaggag

SEQ ID NO: 19887 - DNA, 262 bp, Homo sapiens
agagtgatctttctaaatgctttctgagaatctaagatgactacagagttttttgttgccattaatggctaaatgataaaatttacttctgtttttttaaaaactgaacttttctttaataaagacctattcttataatttattaagccaactctcatttctgtaaattatgcattataacatgccttaattgcctgctaccaacctagcaccagatggaaaggtacagaagatgaagtaaaattaaaaatcagaaattgct

SEQ ID NO: 19888 - DNA, 247 bp, Homo sapiens
tggatcccctgaggccaggagttgagaccagcctggccaacatagggaaacctaaaaatgttaaaaatactaaaaatactaaaaaattagccaggcatggtggcacacacctataatctcaactacttgggaggcaagaggcacaagaattgcttgagctcaggaggcagcagttgcagtgagttgagattgtgccactgcacaccagcctgggtgacagagcaagaccctgttcccccgcctccgc

SEQ ID NO: 19889 - DNA, 147 bp, Homo sapiens
tttatcggcagcgtgaaaatgaactcatacacacacacagaagtatatctttacagttcccaggatggactgcaagtttggctctaaatttcctttgcctggccaaaacaaaaagaacacattttattataaggttcacaggctttt

SEQ ID NO: 19890 - DNA, 280 bp, Homo sapiens
gatcttgactcactgcaatctccacctcccacaggttcaggcgattcccgtgcctcagcctcctgagtagctgggactacaggcacgcaccaccatgccaggctaatttttttgtattttagcagagacggggtttcaccatgttgccaggatggtctcgatctcctgacctcgtgatccacccgactcggcctcccaaagtgctggcattacaggtgtaagccaccgtgcccagccctaaacatcattcttgagagcattgggatatctcctgaaaagg

SEQ ID NO: 19891 - DNA, 295 bp, Homo sapiens
gagggagaaagcagcatcttgcctggatgagccaggggacacagaagagaagcccactatctcatttaatctttacaactctcttgcaaggttccctggttgtgaaaatacatgagatagatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgcccttccgctg

SEQ ID NO: 19892 - DNA, 165 bp, Homo sapiens
gttactatgtaaaccctgacattaaatgttttatctctaccagcatcaggaggaatcactgctttaagggtattatgtaatgcctagtgccttctatttacagtgaaaaagaggttttgtgaaggcatttatggtcattaccaaaaactaaattaaaggccttgg

SEQ ID NO: 19893 - DNA, 322 bp, Homo sapiens
acagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatgg

SEQ ID NO: 19894 - DNA, 353 bp, Homo sapiens
aaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagtgtcatcggaatagtctggccaagtgtaatgagcactgtggaatggaacaaaaaagaggagct

SEQ ID NO: 19895 - DNA, 187 bp, Homo sapiens
aaaaagtacagtgttagatgtgcacaaggaaagttattttcagacatatatgaatgactgctgtactgcaatatttggattgacattcttacaaaacattttttgttctctagtaaaaagagtagttattagttctgctttagctttccaatatgctggatagcctttgtcattttataattttaat

SEQ ID NO: 19896 - DNA, 312 bp, Homo sapiens
gcttagccataatgataccactacagtcaatgctcatcgaactaccatttgtgggaaactgccttatactttgctttccaaaagccatttttggtactgtcctctgattgagagtccatgcttcactcaaacagaagtctatcttgaaattctggccattacataattttcagaagctgggagaaaggcatttgcatcatttctgttcccagatctgttcaatatatacttccagtctgtcatgcctgaaattaattttttttacaatctggatctttactatatgctaaaaattcagtacaaaaaaggacc

SEQ ID NO: 19897 - DNA, 245 bp, Homo sapiens
tattgggtgctatgctttgggcactgtgctaggagctggaggtatatagagtgggacagcacagtccttgctttgaaaagactcacagaataatagagaaagccagtatttctccaatattggcttcagaattaaaatagaaaagtgtatagatctcttccttcaggtaatcattcattcatacatgagccactcattcattcatttgtatatgatgaacaggaactataaggtctctgcccttg

SEQ ID NO: 19898 - DNA, 134 bp, Homo sapiens
tcaaaaatccccacgccccagaggaaatcacctgccagcaaattggacaagtcctcaaagagatagtgcaattggttctaccaaggcccttccttgagcatttattatttaagtttgaacgatgtaaaatatgg

SEQ ID NO: 19899 - DNA, 136 bp, Homo sapiens
tactacggtcaatgctctgaaatctgtggagcaaaccacagtttcatacccatcgtcctagaattaattcccctaaaaatctttgaaatagggccgtatttaccctatagcaccccctctaccccctctagagcca

SEQ ID NO: 19900 - DNA, 213 bp, Homo sapiens
attattttgtgtccttttatttttttttaatttttactgacctactacaaagcactaaatattttatgttcttaatctgaagaacaatagacattctctataaaacaactcttgcttattcatgaactttgtacacaagaagcttaataagacgggctcaaaattatttttctaaatatatttcctatacaaaataatttcaagatataattg

SEQ ID NO: 19901 - DNA, 101 bp, Homo sapiens
actggcgttgggatttagagtgtattagtcacgcatgtatggggaagtagtctcgggtatgctgttgtgaaattgaaactgtaaaagtagatggttgaaag

SEQ ID NO: 19902 - DNA, 300 bp, Homo sapiens
  misc_feature 76, 98, 209, 282: n = A,T,C or G
tttgtaggtaccttggaaacttgtctccagtgaaaactttgatgattatatgaaagaagtaggagtgggctttgcnaccaggaaagtggctggcatgncaaacctaacatgatcatcagtgtgaatggggatgtgatcaccattaaatctgaaagtacctttaaaaatactgagatttccttcatactgggccaggaatttgacgaagnccctgcagatgacaggaaagtcaagagcaccataaccttagatggggggtcctggtacatgtgcagaaatggnatggaaaatcaaccccat

SEQ ID NO: 19903 - DNA, 300 bp, Homo sapiens
agaaaagcatggaacaaaccatactaaacataaaattagtagaaggaaagaaataacgaagatcagagcagaactaaacaagaaactaaataaatataaaggatcaatgaaatgcaaaatcggtttttgaaaagaaacaaaataaccagtggctaaactatccaagaagaaaagagagaagacctacatgaataaaatcaaaaatgaaaaaggggatattacaactcataccatgaaatacaaaaatcaaaactcttcagtctgatcaataaattgattacagttacaggatttaaaaat

SEQ ID NO: 19904 - DNA, 197 bp, Homo sapiens
cattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggcgaaaaaaaaa

SEQ ID NO: 19905 - DNA, 290 bp, Homo sapiens
  misc_feature 24, 272: n = A,T,C or G
gagaaggcagcgtctcagcctggngaactcaaggactggtttgtgggtcgaagcaatgcccagggaatagatctgaaccggaactttccagacctggataggatagtgtatgtggatgagaaagaaggtggtccaaataatcatctgttgaaaaatatgaagaaaattggggatcaaaacacaaagcttgctcctgagaccaaggctgtcattcattggattatggatattccttttgtgctttctgcaatctccatggagggagaccttgnggccaattatccatatga

SEQ ID NO: 19906 - DNA, 166 bp, Homo sapiens
  misc_feature 56, 81, 82, 84, 100, 107, 111, 112: n = A,T,C or G
tccattaaagctaacctatgtttcaatatttatgataatctatgtacatatattgnctgccatatgtatttgtaaataggnngnatataatgtcaggttngggtctngggnncaagtgtatatattcctgtgagtttcttaactgcattgtgatgaatgcacatta

SEQ ID NO: 19907 - DNA, 458 bp, Homo sapiens
  misc_feature 86, 402, 409: n = A,T,C or G
gataaaccagagacggttatcaagagactaaaggcttatgaagaccaaacaaagccagtcctggaatattaccagaaaaaaggggngctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaagggatgtgccaaatgattcggatactaagatgcatcgtttgaaatcatctagtgggtgnatgcagntatcctcaaaaacatcagcgatgctgacctttaaaacatctgtaggagc

SEQ ID NO: 19908 - DNA, 430 bp, Homo sapiens
  misc_feature 412, 425: n = A,T,C or G
agtgtatgggagaaacgacacaggttaggagacgtcgctttgatcgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtccggtacaactgtccttagactgatgagcaaaggaggagtcaactaatgaagaaatgaataataaattttgacactgaaaaacattntattaataaagantattg

SEQ ID NO: 19909 - DNA, 537 bp, Homo sapiens
  misc_feature 510: n = A,T,C or G
aaccataagtcaacgtaaaatacacttttatgaaattattaaatctagagatatgctgaaataaaagttacttcttatatcaagacccttttagtattattttatatgtagacagcatttcttgtgctcacttggaaattcataggccatgataagaggagtgaaggtggctttgtttgggagcttgtatatagctggtaatgacttgaaaggaatcagtctagcaaatgactgagaaggatgaagacttcaaatcagaaaacacaacccacctatttgctcttttacagggcttctataagaggaccccagactacgttcagattcgagaatggaagaggacaggctgcttccccgtccccatggtccactccaccttcctaattgacctcaggaaggaggcctcggacaagctgactttctaccccccacaccaggactacacctggacctttgatgacatcattgtctttgcctctccagcagcaagcaggactgttggctttggtngagggccacaatggagacacagcaaaa

SEQ ID NO: 19910 - DNA, 247 bp, Homo sapiens
  misc_feature 65, 114, 125: n = A,T,C or G
cctgcaagtgcaaagagtgcaaatgcacctcctgcaagaagagctgctgttcctgctgcccgtgncttgtccaagtgtcccaggcttgtgtctgcaaaggggcatcggagaagngcagctgctgncctgatgtgggacagctcttctcccagatgtaaatagaacaacctgcacaacctggatttttttaaaaatacaacactgagccatttgctgcatttctttttatactaaatatgtgactgac

SEQ ID NO: 19911 - DNA, 390 bp, Homo sapiens
  misc_feature 33, 217, 340: n = A,T,C or G
ccgtaaccttgtggagaagaccccggcgctggngaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggnttggtgccactgaggtgttgatgtggtttatgtcggagagattatagcaagcggtgcatcattggctatgatgtttgaagaccaatctttaacatctgattatatttgatttattatttgagngttgttggccatgtgtgatcagactgctatctgaataaaataagatttgc

SEQ ID NO: 19912 - DNA, 361 bp, Homo sapiens
  misc_feature 88, 114, 129, 351: n = A,T,C or G
gacaagaagaagaaggacgctggaaagtcggccaagaaagacaaagacccagtgaacaaatccgggggcaaggccaaaaagaagaagnggtccaaaggcaaagttcggggacangctcaataacttagncttgtttgacaaagctacctatgataaactctgtaaggaagttcccaactataaacttataaccccagctgtggtctctgagagactgaagattcgaggctccctggccagggcagccttcaggagctccttagtaaaggacttatcaaactgggttcaaagcacagagctcaagtaatttacaccagaaataccaagggtggagatgctccagctgctggngaagatgcat

SEQ ID NO: 19913 - DNA, 129 bp, Homo sapiens
gaggtttccccttttgcttagttctcattctctcttgcctgccgcatgtaagacgtgcctttctgtcatgcttgtgaggcctccccagccacgtggagctgtgagttcattaaacctctttttctttat

SEQ ID NO: 19914 - DNA, 302 bp, Homo sapiens
aataggatacaatgaaaagggaagagtcagagaataagaatgagatcttgatgagcaaaatattatggacaaaatgaaacagtctgtagaagaattagaagtaacacataaaggagacaaacatgaaaatatgagagacaaggtaagtgacagaagaccaatgcaggagctctaatagtcaattgatagaagttacacaaagaaaagaaagaaaatgaatgaaagaaaatgttcaaataaatcatgggacacagttttgaagagctgaaggccatcaaatattcgacatgataaatataaat

SEQ ID NO: 19915 - DNA, 307 bp, Homo sapiens
cccctcataaggaattagggacttgtgtcacatctctctggagttttctattttaaagaggaatctgaaagcaataagctctttggcttcttaagatggctacacctcaatttaagatggggtattctttcactagttgaggagtagaagaggatgaccagctagactcccatggaattgggactcctattccttgcttagacattacgggttatgctttgagatctctttggggtgaaggattgaaattaaaccctgagccaccgtgtccttgtagagcacagagtagagaacaactggcagcttt

SEQ ID NO: 19916 - DNA, 257 bp, Homo sapiens
cattgctaacattgttgatttgtgtattcctttgaatgtattgaaattttatcattacttaccttttcatctgtagtaattccttggccttaaagtctatttgggacattaatatagttacttcaaggggctgggcatagtgctcatttctgtagcccagtgctttgggaggctgaagtggggggacacttaaggctaggtgtttgagataagcttggcaacataccaggaccttgctctccccccaaaaaaaaaaa

SEQ ID NO: 19917 - DNA, 307 bp, Homo sapiens
ctagcctttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaa

SEQ ID NO: 19918 - DNA, 437 bp, Homo sapiens
  misc_feature 403: n = A,T,C or G
aataatcctaataaatatatatctaatagagcttcaaaattcatgaaggacagaccgacagaactaaaggtaaaacaaatctgtggtcaccagtcattactggggattttgacctctattccttagaaactgatagaattactaaacaaacaaaagcaatcagaaatatagaagatctaaagactattaacttgacttatttaacatttatagaatactacatctaacaactgaagaaaatatatgttttttaagtgcatatggaagtttcacagatacagaccatatgctgggcttaaaagtaagtctcagtaaatttcagaagactgagatatgctaaagttggtctctaaccatagtagaattcagttagaagttaataagatcttagaaaatggttggnaattagataacataattctaaataccatggctta

SEQ ID NO: 19919 - DNA, 351 bp, Homo sapiens
gcctaaaacacacattgaacagattcagaagcattttagtgagggcaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgactcgaagatctagatttcactcttcatctacaacttggtcacccaacaaaggacctccacaagaaaagaagcggccc

SEQ ID NO: 19920 - DNA, 318 bp, Homo sapiens
  misc_feature 308: n = A,T,C or G
gaggacacagcaacaaggcaccatcttggaaggagagagaagccctcaccagacaacagtgcacatgccttgatcttagacttcccagcctccagagctataataaatacatttctgttctttataaattacttggtctctggtattttgttatagaagcactaatggactaagacaaaaagattccattatgaaagtgaaaaggcaaccgcagagtggcagaagcttttggagatgatgaatatgtttacttcctgaattgcggtgatgataccatgagtgtatacatatgtgtgtatacataatgnatacaaattg

SEQ ID NO: 19921 - DNA, 355 bp, Homo sapiens
ttgataaagaggatgataaattttggttaatgttggtgaatttcagcctttccactcaataataactattttccataccccattattgcagggatccatgggaactgctgcccatgttcttgtaatgaattcctgcagccagggtgaacaataagcacctttttgtccaaatatcagggttattgctgatttctgcctttgaatgctgaggggcagacacagaagtgggctatcattgcatcagtcctcatcagctgaagtggcttcccaaggatttaaataaatagtatgtggttttcctccctttaggaagcagcatttaagacaatttttattaagataactggctgacagc

SEQ ID NO: 19922 - DNA, 146 bp, Homo sapiens
gggagtgatgcacctgtactcacagctacttgggaggctgaggtgggatcatctgagcccgggagccagtttgcagtgagccatgatcatgccactgcactccagcctgggtgacagagcaagaccctgtcccaaaaaaaaaaaaa

SEQ ID NO: 19923 - DNA, 177 bp, Homo sapiens
gaagtaggcaacacagagaacagagctgtcccagccagccagcgagcgatgctggtcttcggagacccgtttcatagacggaagtaagattccatgggcctccaagacaataggatcctctctccattcctcgccatatgggttttgttttttaagtcatttggtttggggagggcc

SEQ ID NO: 19924 - DNA, 412 bp, Homo sapiens
acccaggcaagaggatggaaatacaacagaagaatttgacccttttcgaatatttagattggtgggatgtgctcttcttgctcttggagtcagagcttttgtttgcaaatacttgtccatatttgctccatttcttactttacaacttgcggacatgggattatacaaatattttcccaagagtgaaaagaagataaagacaacagtactaacagctgcacttctattgcgggaattcctgccgaagtgataaatcgatcaatggatacctatagcaaaatgggcgaaggcttcacagatctctgtggctactttttcacttttatcttttggcatgaactacttgataatgggggctctgaaggaccatgaagcctggaggaactgagaaggagaagcctacaaaaaaaaa

SEQ ID NO: 19925 - DNA, 296 bp, Homo sapiens
  misc_feature 79, 87, 132: n = A,T,C or G
agcccccaggtactaagatattgcttagcggtaagtttttaacggaattttaatagcttaagattttaagagaaaatangaagactnagaagaggagcatgaggaaggaaaagataaaaggttctaaaacangacggaggttgagatgaagcttcttcatggaggaaaaaatgtatttaaaagaaaattgagagaaaggctacagagccccgaattaataccaatagaagggcaatgcttttagattaaaatgaaggggcttaaacagcttaaagtttaggttaaaaggtggaggg

SEQ ID NO: 19926 - DNA, 219 bp, Homo sapiens
atgcactgacagtccacaagcattgccttcttattgtactgctttgagctgtttaactttgtaagatgcaaagaggttggatcaagtttaaatgactgtgctgccctttcacatcaaagaactactgacaacgaaggccgccctgcctttcccatctgtctatctatctggctggcagggaaggaaagaactcgcatgttggtgaaggaagaagggggg

SEQ ID NO: 19927 - DNA, 210 bp, Homo sapiens
  misc_feature 29, 30: n = A,T,C or G
aaaaaagacaagctaggaaacaaaaagcnnagggcaaaatgtacaaacttagaagaaaattggaagatagaaacaagatagaaaatgaaaatattgtcaagagtttcagatagaaaatgaaaaacaagctaagacaagtattggagaaatatagaagatagaaaaatataaagccaaaaattggataaaatagcactaaaaaaaaaaaaa

SEQ ID NO: 19928 - DNA, 272 bp, Homo sapiens
  misc_feature 31, 91, 172, 193, 219, 223, 227: n = A,T,C or G
cctggaggttaattcctcttgcccaacggcngatggagtgccccattgctaaaaaggattccgtctccttcaaagaagttttatttttggnccagagtacttgttttcccgatgtgccagccagctccgcagcagcttttcaaaatgcactatgcctgattgctgatcgggntttaactttttcttttcctgnttttattttggaattaagcggtgccnttanttgnaaagctgtataaatatatattatataaatatattaaaaaggaaaa

SEQ ID NO: 19929 - DNA, 302 bp, Homo sapiens
  misc_feature 10, 37, 47: n = A,T,C or G
cgaattgttntttctctcaactacccccaactaaaanttacaaacgnatataaaaatcctgtttgtacttggttggctcgttagagaaataccgagtcaaaggtctgtgatatttcacagtgctgcccccaggtgaaaagaagcaaaatgcacattaaaaaaaaataaatatgagatccataaggggaaaataaaatattagcatataaaatgctacaaattaaaaagcctgcttctcctgtagatttgaagctggataaacttgatggattctaggagcagcagatgttttgctaaatggg

SEQ ID NO: 19930 - DNA, 122 bp, Homo sapiens
  misc_feature 18, 41: n = A,T,C or G
ggcacttaaaacttgggngactgacatgcagataagtgaanttcctttttttaaaagcaaatgtagattattcaataaagcagcaaaccaatattaaacataattagaactaaaaaaaaaaa

SEQ ID NO: 19931 - DNA, 171 bp, Homo sapiens
  misc_feature 154: n = A,T,C or G
ccaaggtcaacaccctgattcggcctgacggagagaagaaggcatatgttcgactggctcctgattacgatgctttggatgttgccaacaaaattgggatcatctaaactgagtccagctgcctaattctgaatatatatatatatatatcttntcaccataagaaaaaaa

SEQ ID NO: 19932 - DNA, 458 bp, Homo sapiens
  misc_feature 17, 39, 54, 67, 200, 244, 306, 430: n = A,T,C or G
ttttcaggagctgcganccatgagaatgagattccaaantgcgaaaagttactngcaacggactganccagatgattgtcatagaactgggcaccaatccgctgaagagctcaggaattgaaaatggggctttccagggaatgaagaagctctcctacatccgcattgctgataccaatatcaccagcattcctcaaggncttcctccttcccttacggaattacatcttgatggcaacaaaancagcagagttgatgcagctaggcctgaaaggactgaataatttggctaagttgggattgagnttcaacagcatctctgctggtgacaatggctctctggcaacacgcctcatctgagggagcttcacttggacaacaacaagcttaccagagtacctgggggctggcagagataagacatccaggnggctaccttcataacaacaatatctctg

SEQ ID NO: 19933 - DNA, 269 bp, Homo sapiens
  misc_feature 23, 25, 50, 61, 96, 108, 132, 143, 188, 209: n = A,T,C or G
gcgggaggcggccagacatgttntntgttttcctggcccttgcaacaccngaaaactcacntgcccacagttaattagagaagagaactgacagangtcagccaaatntagttgaaagcgggtagtctgtangtcagaaggcnctattgttctttcattatatgaggtagggcaggtggctgcatctntgaactctagtttcctcctcngtgagaagatggcttagaggttccacaatctctctactttttctcattctctggtcctga

SEQ ID NO: 19934 - DNA, 140 bp, Homo sapiens
ccattccacctaggaggcttccatctctgcttaggagctgagtaatggaggagattggggtaagagttcaggacctatgaagacctaactcttgagggagagactccaatgtaaactgcctactcaatactgccgagaaa

SEQ ID NO: 19935 - DNA, 401 bp, Homo sapiens
  misc_feature 31, 32, 137, 276, 312, 334, 351: n = A,T,C or G
atatttactgtacttcccagtaaccctaagnngctaacccaaaaaaccgcatcccaggttctgttaatttagtaaataaacaagtcaaagacttgtggaaaataggaagtgaacccatattttaaattctcataagnagcattcatgtaataaacaggtttttagtttgttcttcagattgatagggagttttaaggaaattttagtagttactaaaattatgttactgtatttttcagaaatcaaactgcttatgaaaagactaatagaacttgntaacctttctaaccttcacgattaactgtgaaatgnacggcatttgtgcaaggaccgnttgccacttcattttgnataatcacaggtgggtcctgacactcaataaacagcattggaaaaaaaaa

SEQ ID NO: 19936 - DNA, 195 bp, Homo sapiens
  misc_feature 51, 61, 109, 118, 148: n = A,T,C or G
aactgtgtacttagacaacaatttgatcagcaacatccctgatgaggattncaagcgcccnaatgcattgcagtatctgcgtttatctcacaacgaactggctgatagnggaataccnggaaattctttcaatgtgtcatccctggtngagctggatctgtcctataacaagcttaaaaacataccaactgcgaa

SEQ ID NO: 19937 - DNA, 327 bp, Homo sapiens
  misc_feature 28, 39: n = A,T,C or G
tattgccttaagtcttaatattaaatanatgattagccnggcacggtggctgacacctgtaatcccagcactttgggaggccaaggtggggggattacccgaggtcaggaattcgagaccagcctgaccaacatggagaaaccccgtctctactaaaaatacaaaattagccggtcatggtggtgcatgtctgcaaacccagctactcgggaggctgaagcaggagaatcacttgaacctgggaggcagaggttgtggtgagccaacatcacaccattgcactccagcctgggcaacaagagtaaaactctgctcaaaaaaaaaaaa

SEQ ID NO: 19938 - DNA, 297 bp, Homo sapiens
  misc_feature 146, 172, 195, 209, 221, 227, 234, 243, 272: n = A,T,C or G
ggacaacaacaagctgacgagagtacctggtgggcgggcagagcataagtacatccaggttgtataccttcatagcaacaatatgtctgtagtaggagcaagtgacttctgcccacctggacacaacaccaaaaaggcctcttatncgggagtgagctttgcagcaacccgngcagtactgggagatacagccanccacctgcagatgnggctacggcgcnctgccnttcaacncggaaactntaagtaagtctcaagaaagccctcatttntataacctggcaaaatcttgtaatg

SEQ ID NO: 19939 - DNA, 126 bp, Homo sapiens
  misc_feature 11, 102: n = A,T,C or G
atctccacacnagcagagaccaaccgaacccccttcgaccttgccgaaggggagtccgaactagtctcaggcttcaacatcgaatacgccgcaggccccctngccctattcttcataaaaaaaaaa

SEQ ID NO: 19940 - DNA, 185 bp, Homo sapiens
  misc_feature 56, 100, 102, 124, 176: n = A,T,C or G
ctggatggccaagagagaatcgaagtgcatgtttaaatttgcccacagaacccgcnaaatccccccgcaaatttaactgttagtccaaagaggaacagcncnttggacactaggaaaaaacctngtagagagagtaaaaaatttaacacccatagtaggcctaaaagcagccacanaaaaaaaaa

SEQ ID NO: 19941 - DNA, 278 bp, Homo sapiens
  misc_feature 19, 109, 113: n = A,T,C or G
cgaagttttgccaaaaccncggatgcgcggccttctggccaggcgtctgcagaaatcatatggctgtagcattcgtgctatccctgggggttgcagctttgtataagtntcgngtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgcactgacttg

SEQ ID NO: 19942 - DNA, 226 bp, Homo sapiens
  misc_feature 201: n = A,T,C or G
gggggttgggaccctgtggcgcatacttgtcgctcgtgtccttctcatgcccggcgacgcgtctttgtggtaacgccctgctgccatctcttttcttctctatgcgaggatttggactggcagtgagaataagagacaacgattcacgctactttctaggatgacttccatgtgctccatctcgcgcgtcctgagcatgtngaatttccaaatcctaaataagccg

SEQ ID NO: 19943 - DNA, 289 bp, Homo sapiens
  misc_feature 59, 69, 137: n = A,T,C or G
tgaacaaaacaaaacaacaacaaaaaacattttaacaaaaaagctatggcactagaatntaagaaacgntttggtttcatttttactttctgtttttgtttttgtttcgtttcattttgtactacatgaagaactgntttttgcctgctggtacattacatttccggaggcttgggtgaataatagttttcccagtctccctcggatggtggcttaaggcctggaagtgcttcaagaggccactggttggatctctagctactggctctaaatacaacccttctttaca

SEQ ID NO: 19944 - DNA, 395 bp, Homo sapiens
  misc_feature 265, 277, 365: n = A,T,C or G
tgtttgactccttgggaatggccttaaaaataaacgtaataaagtcagagtggtggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggnaaatgaccttgnatataaatattgccatatcatgggacctataatggggatatatttggttctatgaaaaatggattgggctttgatactaaaaatctgnaaaaggtaggtttgggaattttttttctgc

SEQ ID NO: 19945 - DNA, 142 bp, Homo sapiens
gggacaactactcacaaaatataggcaataggttactaagatattgcttagcggttaagtttttaacgaattttaataagctgaagattttaagagaaaatatgaagacctagaagagtagcatggaggaaggaaaagataa

SEQ ID NO: 19946 - DNA, 423 bp, Homo sapiens
  misc_feature 64, 131, 335, 352: n = A,T,C or G
tggaaatgctaaatagtactggcgtggaatttgaaacattcgatatattggaggatgaagaagncccggcaaggattaaaagcttactcaaattggccaacataccctcagctgtatgtgaaaggggagcnggtgggaggattggatattgtgaaggaactgaaagaaaatggtgaattgctgcctatactgagaggagaaaattaataaatcttaaacttggtgcccaactattgtaagaaatatttaattacattgggagcagttcatgatttaagtcctcagaaatggactaggaatagaaaattcctgctttctcaagttacatgttttgngtatttcacaatgtcgngctaaataaatgtatgttacatttttttcccaccaaaaatagaatgcaataaacatcttcaaattattaac

SEQ ID NO: 19947 - DNA, 456 bp, Homo sapiens
  misc_feature 187, 207, 210, 329, 386: n = A,T,C or G
ccttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggntacttgcttcgctgttctgnggnggtttactaaaaaacgcaacaatcagatacggaagacctcttatgctcagcaccaacaggtccgcaaatccggaagaagatgatggaaatcatgacccgagagggcagcaaatgacttngaaagaaggggccaataaattgatccagacagcattggaaaagacatagaaaagctngcaaatctatttatcctctccatgaggcctcggtagaaaaggaaaaaagctgaagaagcccaggttgaat

SEQ ID NO: 19948 - DNA, 186 bp, Homo sapiens
  misc_feature 47, 103: n = A,T,C or G
gaatagagaaatttttacagataatcattagcccacataccagtttnttatacttaaagatgggatggagttgtaaagagcccttataatacaatataattgntaaaggcaagggttgactctttgttttattttgacatggcatgtcctgaaataaatattgattcaatatggaaaaaaaaaaaa

SEQ ID NO: 19949 - DNA, 584 bp, Homo sapiens
  misc_feature 160, 161, 167, 172, 194, 198, 203, 213, 214, 224, 225, 235,238, 277, 302, 305, 317, 331, 332, 335, 383, 401, 410, 422,436, 445, 456, 457, 462, 472, 498, 502, 512, 515, 519, 525,526, 533, 535, 539, 545, 547, 549, 553, 554, 555, 556: n = A,T,C or G
  misc_feature 557, 558, 559: n = A,T,C or G
atgggggagaccgagaaacccgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcanngcttcntattntacttcttttagctggttaacnttgnaagangcaaagaggnnggatcaaggnnaaatgactgngcngccctttcacatcaaagaactactgcaacgaaggccggnctgctttcccatctgctatctatcnggnggaagggaaggnaagaacctgcatgnnggngaaggaagaagtggggaggaagaaggggggcgggaccgacagggaaanctaggggaaaaccaagcnggccaaggnggcccgcaggcnggaaagcaggtaancagagggcnccttttttttnngggcnaaaggagttnaaaaaggggggagggcccaaattttngganaagggcaaanaanggtnaaaagnntgcgggnanaaangggaangncnaaannnnnnnggggggggccgggcccccccccccc

SEQ ID NO: 19950 - DNA, 521 bp, Homo sapiens
tttatatgccagtatcaccctaataccaaaaccagggaagaacatagcaaaaaaagaaaactacagaccagtattcttgatgaacataaatgcaaaaatcctcaacaaaatactagtgaactgaatccaacagcttatcaaaaagataatccaccattatcaagtgggtttcataccagggatgtaaggatggtttaacgtatgcaatctaaaaattcaatgcaattcttatcttaataccaccattattcttcacagaaccagaaaaaaaataaaaaaatcctaaaattcatatggaaccaaaacagagcccattagctaaagcaagactaaacaaaaagaacaaatctggaggcatcacattaggggcttcaaactatactacaaggccatagtcacaaaaacagcatggtactggggataaaaataggcgcatagaccaatggacagaatggagacccagaaataagccaaatacttacaaccaactggacttcaacaaggcaatggaaaacataaaa

SEQ ID NO: 19951 - DNA, 241 bp, Homo sapiens
caggacatcccgatggtgcagccgctattaaaggttcgttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttaagtataatacccacacccacccaagaacagggtttgttaagatggc

SEQ ID NO: 19952 - DNA, 290 bp, Homo sapiens
ccttcatccctctccagaagagttgaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggata

SEQ ID NO: 19953 - DNA, 145 bp, Homo sapiens
  misc_feature 94, 122, 124: n = A,T,C or G
caataggttactaagatattgcttagcggtaagtttttaacggtaattttaatagcttaagattttaagagaaaatatgaagacttagaagagnagcatgaggaaggaaaagataaaaggtncnaaaacatgacagagggtgaga

SEQ ID NO: 19954 - DNA, 153 bp, Homo sapiens
  misc_feature 55: n = A,T,C or G
atcatttttaaaacgaagataatcatacttcactgtgtctttgtgagcgttaggntcccctccttgagattttcccataaaacatttcagcagctgctgccctacacatagtcacagttacacttttaaacatatattggctaagaagtcaca

SEQ ID NO: 19955 - DNA, 280 bp, Homo sapiens
tcatgggagtaaaaaatgtatttaaaagaaaattgagagaaagggctacagagccccgaattaataccaatagaagggcaatgcttttaggattaaaatgaaggggacttaaacagcttaaagtttagtttaaaaggtgggagggtgattaaaataatttgaaggcgatcttttaaaaagagattaaaccgaaggggattaaaaagaccttgaaatccatgacgcaggggggaattgcgcaatttaaagcctaggtaacgcatttactaaacgcggccgg

SEQ ID NO: 19956 - DNA, 445 bp, Homo sapiens
  misc_feature 139, 148: n = A,T,C or G
ctgctggctgcgagaccttgagcatgccttttaggctcattcttcttatctgtaaaatgtgaaacggatggtgttcagaaagttgtgttagcattgtaaaacttccctttgtttagagggacacctgtggtagagtagncaagagtgnaagttccagcttttctgcctgctggctgtgtgaccttcagcatgccatttagggtcatttttctcatctgtaaaatgtgaaataacatcaagtacctcacaggattattgtgaggatcaattgagataatgtgttaacggttacttggacatggctggcgcagtgctcacgcctgtaatcccagcactttgggaggctgaggcgggcggtcatgacatcaaggagatcgagaccatcctggctaacaaggtgaaaccctgctctactaaaaaaatacaaaaaattagccaggcttag

SEQ ID NO: 19957 - DNA, 178 bp, Homo sapiens
acgtttttagaaaagccctccctattggtaactacctcaactggtcagaaacacagattgtattctatgagtcccagaagatgaaaaaaattttatacgttgataaaacttataaatttcattgattaatctcctggaagattggtttaaaaagaaaagtgtgtacaaaaaaaaaaaa

SEQ ID NO: 19958 - DNA, 404 bp, Homo sapiens
  misc_feature 86, 304, 380: n = A,T,C or G
cttctcaccttgaagattttcctagaaaactcacaaaatgtgtgatgcttttgtaggtacctggaaacttggctccagtgaaaacnttgatgattatatgaaagaagtaggagtgggctttgcaccaggaaagtggctggcatggcaaacctaacatgatcatcagtgtgaatggggatgtgatcaccattaaatctgaaagtacctttaaaaatactgagatttccttcatactgggccaggaatttgacgaagcactgcagatgacaggaaagtcaagagcaccataaccttagatgggggngcctggtacatgtgcagaaatgggatggaaaatcaaccaccataaagagaaaacgagaggatgataaactgggggnggaatgcgcatgaaaggcgcactt

SEQ ID NO: 19959 - DNA, 589 bp, Homo sapiens
  misc_feature 279, 308, 311, 318, 339, 370, 374, 384, 405, 417, 510, 517,529, 537, 551, 561, 563, 567, 568: n = A,T,C or G
ggaaaaagccccgctcttcagaaggtgagtgggttgagggaggcagtaatatgaagtgactgctgtgtattttaactaccagattttttatatttgccactgttaaatagttggaaaggggaaattctgattaagcgaaagtgggatcatcctaggtaagcttatttcagaacaaggctaatatttcaagattctttcttttcgactttatactctgaggtattacttactggaagggggggatatgaaacctccatgcattttccaggatggactgcnaatatgcacaggaaaaccatggcttggtnggntttctantaaaaagcaatcaagaaaganaatgggaaaaaggaaaggaatttagagggangggnaaagaagaanggcagacatttggaggaccanaggaaaaagganaacactaaatatacttgggaaaactttcttaaaatgccaaggagggaggcccggacctttggaaaaggggaaaagggaaacaaggcattcccnagggganacccggataaanaagggggnggggggggaccccngggaaggccnancggnngggggggtctgggaaaaaggc

SEQ ID NO: 19960 - DNA, 440 bp, Homo sapiens
  misc_feature 258, 309, 371: n = A,T,C or G
cggaaatgcttttgtgtctcctgaagacttccctgaaaattagctccgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgnacttaagaataagaataacatggccattcacctttatggtataagatatgnctttggggaaatcatttggtttggagtttcaaagaataagcccattggtcattcttggctgnacaatgaccactgtattgtactttgacttttcaagagacacccttcccctgggttttggatattaatgg

SEQ ID NO: 19961 - DNA, 397 bp, Homo sapiens
  misc_feature 169, 222, 235, 294, 312: n = A,T,C or G
aaattaaatggtggcagacatgtccaaggaatattgcggggatttgatccctttatgaaccttgtgatagatgaatgtgtggagatggcgactagtggacaacagaacaatattggaatggtggaatacgaggaaatagtatcatcatgttagaagccttggaacgagnataaataatggctgtcagcagagaaacccatggcctctctccatagggcctgntttactatgatgnaaaaattaggcatgtacattttcatattagactttttggtaaataaactttggaatagncaaaaatgcttctcagangtctgaatatagaatatcaagctctcattccagtttttctaacatgaattttcctgggtgacattgattcaaaggggtttatgca

SEQ ID NO: 19962 - DNA, 349 bp, Homo sapiens
  misc_feature 18, 54, 57, 74, 131, 301, 311, 333: n = A,T,C or G
ggaggcagagacatactnttggaagtgaagttctgatggaagcatgcctgtcancangaggtcttgaagcggangcccaaataaaagagtatattttatctaaatcttaagtgggtaacattttatgcagnttaaatgaatggaatattttcctcttgtttaggtgtatctgtttgtatttttctttgatgaatgattggcatgaggctcttgcacactccagaaatacgtgtgcggctgcttttaagaactatgtgctggcacttatttctctaaaattatctcattgcctgcaatcagncttctcttgnatacttgcctagcacattatgnacatgggaaatgtaaa

SEQ ID NO: 19963 - DNA, 385 bp, Homo sapiens
  misc_feature 235, 327, 360: n = A,T,C or G
tacctcaagcaaaagggctacttcttcacagaaggggagctgtactgcgaaacccacgcaagagcccgcacaaagcccccagagggctatgacacgggtcactctgtatcccaaagcttaagtctctgcaggcgtggcacgcacgcacgcacccacccacgcgcacttacacgagaagacattcatggctttgggcagaaggattgtgcaggattgtcaactccaaatctaaagncaaggctttagacctttatcctattgtttattgaggaaaaggaatgggaggcaaatgcctgctatgtgaaaaaaacatacacttagctatgntttgcaactctttttggggctagcaataatganatttaaagcaataattttttggatg

SEQ ID NO: 19964 - DNA, 454 bp, Homo sapiens
  misc_feature 363: n = A,T,C or G
acagacctaaatagaaaagctgtatccccaaagctaatagaaaaaacatagaatatcttcacaaacttggaataggtaaagatttcttaaggacgcaaagtatcactaattatataaaaatgatgacaaattagacttcatcaaacttaaaaatatttgctcaacaaaaaataccactaagaaaaaggaaaagcaagtcaccaaagaggaggaaatattcactatgtttctgtgtgtgagagacaaagcacttgtatctacgatacatgtaagaatgcaaacagtcaggtttttaaatggacaagcgatttagacactttacaaaagaagatacgtcaacagcctacaagccatgaagaaggnttaacatgagtaatcagggagatgcaaattaaaattacaatgagaataccacttcacacccattagaataccacttcacacccaaaaaaaa

SEQ ID NO: 19965 - DNA, 158 bp, Homo sapiens
tggaaaggtaactgttagaccaaagaggttttgctctttggacactaggaaaaaaccttgtagagcgagtaaaaaatttaacacccatagtaggcctaaaagcagccaccaattaagaaagcgttcaagctcaacacccactaccctaagaaaaaaaa

SEQ ID NO: 19966 - DNA, 325 bp, Homo sapiens
ggtagaaaactcagagaggtaaactctgcttttgagttttatcttcttgagaaaaatttcagttcaaaaagtagaggctaaaagattaagaaacttagcagagctttcaacaagttcatgggcttgagggtgtggtaattgtatttaggtcctgtgaaaaggcagaagccctagtaaacaacctaggctttcattgagaaccctgagtctaggtgaatcagaaataaaacataggtagtgaagccaaaactcaaataatttcagattagtgcccctagcctagatgtctgcctgaagccagaataaaaattctctttggaggaag

SEQ ID NO: 19967 - DNA, 431 bp, Homo sapiens
  misc_feature 30, 40, 42, 370: n = A,T,C or G
gaggaaagggatttaaagagtttttcttgngtgtttgtcntnacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagatgaagaaaatgaaaaagaaacagcagtatccacagaagacgattcccaccataaggctgaaaaatcatcagtactaaagcaaaagaggnaagccatgaacagtcagcagacaggcaagagtctagccaagagctgggattgaaggatcaa

SEQ ID NO: 19968 - DNA, 307 bp, Homo sapiens
acaaattgaggtgccttccttgtatgctttttgttagtattttttgtttttgttccttaactgctgagcctcagccagcgtgggtcctgggggaaataccattccaaaggaagccatccctatggggaaattggttttactgggtaaattaatacttttatttcttcccctatcccttccttcctagttgtgataaacatgggagaggagtgactttgactgctggggaatttcctcctaagaaccttattcccaaaataagccagggattatgtcaaggcttctttcaaggagctcataaaagcag

SEQ ID NO: 19969 - DNA, 267 bp, Homo sapiens
  misc_feature 184: n = A,T,C or G
aatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagnttcatgtatgtatataatcatgctcatgtatatttaggtacgtataatgctttctgagtgagttttactcttaaatcatttgg

SEQ ID NO: 19970 - DNA, 295 bp, Homo sapiens
  misc_feature 262: n = A,T,C or G
caaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttgggggagaaggtaaatggcacagatcctgaagatgcatcaagaaatgcctttgcttgctttgatgaagaagcaactggaccatacaggaagantacttgagagagctgctgacaaccatgggggga

SEQ ID NO: 19971 - DNA, 152 bp, Homo sapiens
cgtagcatagtatatactttgttaccacgttagcatttacacgggaattactgacaagaaaggaagaagttggtgaataaaagccagggaaactgggtgtattctcattttccaatagcactaatgtataatccctttaaccttccatatgg

SEQ ID NO: 19972 - DNA, 220 bp, Homo sapiens
  misc_feature 147, 195: n = A,T,C or G
aagcatatgactttcattatttctttttaattctcagtctccctatgatatggcttgtattacttttcctctttcaattaaaaaaacaagcttgtggccgggtacggtggctcacacctgtaacccaggcactttgggattcgaggngggcatatcatgaggtcaggagatcaagaccatcctggccaacacggngaaaccccgctctactaaaaaaaaa

SEQ ID NO: 19973 - DNA, 460 bp, Homo sapiens
  misc_feature 24, 276, 438: n = A,T,C or G
ttgaaataactttgcaaggagagncaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgnagagagagtaaaaaatttaacacccatagtaggcctaaaagcagcaccaattaagaaagcgtcaagctcaacacccactacctaaaaaatcccaaacatataactgaactcctcacacccaattggaccaatctatcaccctatagaagaactaatggtagnataaggaacatgaaaacattct

SEQ ID NO: 19974 - DNA, 417 bp, Homo sapiens
  misc_feature 37, 39, 61, 126, 131, 160, 280, 326: n = A,T,C or G
tttagaagaagaaggacgctggaaaggccggcaagancngacaaagacccagtgaacaaanccgggggcaaggcaaaaagaagaagtggccaaaggcaaagttcgggacaagctcaataacttagncttgnttgacaaagctacctatgataaactctgnaaggaagtcccaactataaacttataaccccagctgtggtctctgagagactgaagattcgaggctccctggccaggcagcccttcaggagctccttagtaaaggacttatcaaactggnttcaaagcacagagctcaagtaatttacaccagaaataccaagggnggagatgctccagctgctggggaaggatgcatgaatagggccaaccagctggacatttggaaaaataaaactttattaaatcggaaaaaaa

SEQ ID NO: 19975 - DNA, 158 bp, Homo sapiens
  misc_feature 20, 141: n = A,T,C or G
tgtagaaaatggtgcagacnccgatgaagatgataacagcttcctcaaacaacaatctccacaagaacccaagtctctgaatgcggacgagttttgtagacaacacctttgctgaagaatgcactactcagaatcagaaancccaggatggggaactc

SEQ ID NO: 19976 - DNA, 137 bp, Homo sapiens
  misc_feature 104: n = A,T,C or G
caaaagaaatgcagatgagtgtaaaacatctgttctcaattatggtgatctgtgtgcgcagtactggagcatttacccattcatgttgagcctcaaatgcttgntttctggggccacaaaagacagtttatacattt

SEQ ID NO: 19977 - DNA, 229 bp, Homo sapiens
tggttgttgctgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcg

SEQ ID NO: 19978 - DNA, 306 bp, Homo sapiens
  misc_feature 22, 75, 148, 166, 178: n = A,T,C or G
tgcaaataacaagtttactacngcaggcaaactccccggttattcatttgacagatttatattgaggggcactgntctaggagctggggatttgataataaataagatagtcatggccgtaacctcatagagcttacacataaactgntttgctttaaaatattgnacattcagaggngttgtgctccgaccatatgactgcaatatgcatttgataaacctttcaggcatgacttggacccacccagaacttagctttaaagctatcagattgacaggaggagagaacactggctttagatgaca

SEQ ID NO: 19979 - DNA, 236 bp, Homo sapiens
aggttttaatatctagaatatatgataaactcaacagcccccaaacaaataatccctttttaaaatgggcaaatgatctgactagacatttctcaaaagaagacatacaaattatcagtaagtgtatgagaaaacgcttgacatcgctagtcatcagggtagtgcatatcaaaactatgatgagatgatgattcaccacagttagaattactattattaaaaaaaaaaaaaaaaaa

SEQ ID NO: 19980 - DNA, 534 bp, Homo sapiens
  misc_feature 30, 53, 66, 298, 323, 367, 506: n = A,T,C or G
taaaaatgttgatctcatgaaggtagagtnttgaataatggttaccagagggngagaagggtaggnggaagagagaatgaagagaggttggttaatgggtgcaaaaatacagtttgatagaaggaataagttttagtgtttgatagcacagtagggtgacagtagttaacaataatttattatatatttcaaaatagctagaagagtggatttggaatgttcccaacacaaagcaatgattgattaatatttgaggtgatggatatcaaattatgctcatttgatcattacacattgnatgcatgtatcaaaatatcacttgnaccccacaaacatgaacaattatgtatcagtaaaaaagtaaagncatgataagcagtattttttaatggttaacttacacgaagaaaaccaccaccacaaaaccatggtttttacaaaacaaaatcaaaacagcatcaggtgccaccttggaatatgttatactttaaaattatttaggtaanattacttttactcaacaaaaatcctacg

SEQ ID NO: 19981 - DNA, 438 bp, Homo sapiens
  misc_feature 36, 43, 168, 285, 335, 350, 395: n = A,T,C or G
ttattggtacgtgaaaaaaaaaagccatacttcccngccaggngcagtggctcacgccactttgggaagccaaggcaggcggatcacctgaggccaggagttcaaaaccagcctggcaacatggcaaaaccccatctctactaaaaatacaaaaattagatgcctggnggtacgtgttgtaccagctacttgggaggctgcagcaggagaactgcttgaactcgggaggcagaggttgcagtgagccgagatcacaccactgtactccagcctggagaacagagngagactctgtctcaacaacaaaataaaaaaggcatacttcctcaataaangggaccattattagncggaaatgaatttaggtaggtccatgatttggggcaaggatctgnaagcaaaataactcctcatataggaaaaaaaaacttaactcag

SEQ ID NO: 19982 - DNA, 413 bp, Homo sapiens
  misc_feature 105, 115, 120, 121, 129, 314: n = A,T,C or G
aaaaagaaatatgaacctcctgtaccaaccagagtggggaaaaagaagaagaaaacaaagggaccagatgctgccagcaaactgccactggtgacacctcacacncagagccggnaaaannactgaagntagagagaattaaagactatcttctcatggaggaagaattcattagaaatcaggaacaaatgaaaccattagaagaaaagcaagaggaggaaagatcaaaagtggatgatctgagggggaccccgatgcagtaggaaccttggaagagatcattgatgacaatcatgccatcgggctacatctgnggctcaagaacactacggcagcattctttcatttggagacaaggatctgctggaacctggctgctcggcctgctcaaccacaagggggcatgccgggga

SEQ ID NO: 19983 - DNA, 137 bp, Homo sapiens
ccatccgacattgaagttgacttactgaagaatggagagagaatggaaaaagtggagcatccagacttgtctttcagcaaggaccggctctctatctctggtactacactgaatgcacccccactgaaaaagatgag

SEQ ID NO: 19984 - DNA, 213 bp, Homo sapiens
  misc_feature 30, 78, 96, 110, 132, 165, 191: n = A,T,C or G
atggaaaaaacggatgccgattctctactncacatcattcataacaaattgtagatggacggttgatctaaatgtganaggcaaaacaatagagcntctagagaatgccnaggggaacttatgatcttgaanacaccaatatttcttaaactacatacataaagnactaaccataatggaaaaagttaatnacatataatacaattaagaatg

SEQ ID NO: 19985 - DNA, 182 bp, Homo sapiens
  misc_feature 48, 109: n = A,T,C or G
ttttatagggagaggcagacaaacctaccgagtttggtgatagctggntgccaagagagaatcttagccaactttaaatttgcccacagaaccctctaaatccccttgnaaatttaactgttagtccaaagaggaacagctctttggacactaggaaaaaaccttgtagagagagcttaata

SEQ ID NO: 19986 - DNA, 194 bp, Homo sapiens
  misc_feature 17, 41, 62, 94, 147, 167, 183: n = A,T,C or G
gagctcaaggccgcagntagctatgatcacaccaatgcacnccagcctggatgatgctggcntaaaaatattaaaaccaaaatatggcaggagnttgagagcagctggcaatacagcaagaccccatctcaagaaaaaaaaaaaggnggaaaaaaccaataaaaaanccaaaacatttcgggntccaagcattt

SEQ ID NO: 19987 - DNA, 283 bp, Homo sapiens
  misc_feature 24, 34, 256: n = A,T,C or G
ttggcttggaggctatccagcggnctccaaagancaggtttactcacgtcatccagcagagaatggaaagtcaaatttcctgaattgctatgtgtctgggtttcatccatccgacattgaagttgacttactgaagaatggagagagaattgaaaaagtggagcattcagacttgctttcagcaaggactggctttctatctcttggactacactgaattcacccccactgaaaaagatgagtatgcctgccgggngaccatgtgactttgcacagcccaaga

SEQ ID NO: 19988 - DNA, 129 bp, Homo sapiens
  misc_feature 40: n = A,T,C or G
tttttgctgttccaccaaatacaattcaaatgctttttgntttatttttttaccaattccaatttcaaaatgtctcaatggtgctataataaataaacttcaacactctttatgataaaaaaaaaaaaa

SEQ ID NO: 19989 - DNA, 140 bp, Homo sapiens
  misc_feature 68: n = A,T,C or G
ggcggtgcatacctgtggtcctagctactcgggaggctgaggcatgagagcgcttgaacctgggaggngaagtttgcagtgagccaagatcatgccactgcactccagcctgagcaacagagtgaactctgtttaaaaaa

SEQ ID NO: 19990 - DNA, 131 bp, Homo sapiens
gcatcaaagcagtggacaagaaggctgctggagctgcaaggcaccaagctgcccagaaagctcagaaggctaaatgaatattatccctaatacctgccaccccactcttaatcaggggggggaaagaacgg

SEQ ID NO: 19991 - DNA, 154 bp, Homo sapiens
  misc_feature 115: n = A,T,C or G
ttatgtgggaggagcatcacctttctctttatatggcaaggagactgatgcatgcagagttgaagtaacttgacagttcagtaagcagttgtgttcagagtttcatcttagctgnctgaccacattctgtgttcttctgtgtgaaaaaaaaaaa

SEQ ID NO: 19992 - DNA, 377 bp, Homo sapiens
  misc_feature 38, 59, 98, 137, 353: n = A,T,C or G
tttgaagtaacagacacacgatggggcaaggatgcccntgggactagaggctcagtggngggagagatccctgcagaacccaccaaccagaacgtggnttgctgaggctgtaactgagagaaagattctggggctgngttatgaaaatatagacattctcacataagcccagttcatcaccatttcctcctttacctttcagtgcaggttcttttcacattaggctggtgggtcaaacttttggggagcacggctgcaagtctctgggaaggggcagcgcatcctgcaggcttctcctcctctgcttttggagaaccagggctcttctcagggctctagggactgccggctgntcagccaggaagccaaaacaagag

SEQ ID NO: 19993 - DNA, 241 bp, Homo sapiens
ggaaacttaaaatattaaaggaacactagaggctgcattagaacgaatgaagaaaagaattaaagctatagaacactaaatgatgtcaatgaaaacataggagtcttccttaggatccaagggaaagggacaaagagacaataagagataagaaaaggatatatatggggggataaaaatatataccccaagtaaaaatcagtgtttctagaaaatagaaaaagagaataaatgaggagcg

SEQ ID NO: 19994 - DNA, 303 bp, Homo sapiens
  misc_feature 217, 246, 277: n = A,T,C or G
gctgctgccttggaatgcaccaaaagaaacacttattcaaaagcccaagtcagcaggagaaaataggtgacgtgtgccacgaaaactcaaatcccttggagaatcaacatttcattggttcagaagacaatgaccaaaaggataacatacaaaccggtgtggaaaatgttgcctttgagtggcaagaattagaaaaatcttcaaaaatatagttggngggttttttagttatgatttaagtttagnttcattttgccatgtgacggcatgaaggagngaaattaaaaaaaaaaaactcattgg

SEQ ID NO: 19995 - DNA, 265 bp, Homo sapiens
  misc_feature 24, 37, 185: n = A,T,C or G
ttgtgatataatacaaaaatgctnaggaggcgacagnctaaccacttttacactttgatctttccttctaggctgtacattattttttcagtgttagctggtgagtcaaattcattttttaaaacccgggacacatgttccacgtggcaaggcttccataaaaacatttggtgaacgaataaagnaacaaaaacttacagtcagactctcaaattgctatcatgcttttgaaggaccggcatacattaagctaaggcttcccccc

SEQ ID NO: 19996 - DNA, 329 bp, Homo sapiens
  misc_feature 83: n = A,T,C or G
ccaatgaaatattaaagggataggtagcaccatgaaatgaacaattgtaagaagcacagaattaagacatgtttgaagtgatnaatcgctctacgaattaaacctcctcaaaattttattttaagtctctctagtcaaaaagtgccactactaattgattttcccattatgggatgaacttaccttatactcatataaaaatgggggagaatcatcttttgatatttttaaagcaatacatcaaatatcattttactaacaaggcatagagcttaagaaaaactgcagcttaaggcattctttgaccacttggtgcataaattctatcc

SEQ ID NO: 19997 - DNA, 165 bp, Homo sapiens
gaaatacacaggcttatatacaatgcttctttcctgtatattctcttgtctggctgcacccctttttcccgcccccagattgataagtaatgaaagtgcactgcagtgagggcaaaggagagtcaacatatgtgattgtccataataaacttctggtgtgataaa

SEQ ID NO: 19998 - DNA, 304 bp, Homo sapiens
  misc_feature 12, 32, 87, 162, 194, 231: n = A,T,C or G
ggggtttaagancctgtacaaggattggggangaacttccccaatggggaaattatcgacatcttcaagccagtgcgcaagcacttngatatgcctcatgatattgttgcatcttgaagatgggactgtgtacattgggagatgctcataccaacaccgggnggaagttcaccttgactgagaaatgggaacancgatcagttaaaaaggctggcattgaggccaggaaancaaagcagatctgaacacaactcgggacgagtcaggaagagactgggaagattaagaggaaaggaaggggggc

SEQ ID NO: 19999 - DNA, 115 bp, Homo sapiens
tcaaacggccgaagttgcctcttttaggaatctctttggaattgggagcacgatgactctgagtttgagctattaaagtacttcttacacattgaaaaaaagaaaaaaaaaaaaa

SEQ ID NO: 20000 - DNA, 265 bp, Homo sapiens
gtaaatgagaccaaaacggggtttgcttttttcataaaataatttctattgggggcactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttgg

SEQ ID NO: 20001 - DNA, 182 bp, Homo sapiens
  misc_feature 161: n = A,T,C or G
ggcgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgctngaagaccacaaggctgaaaag

SEQ ID NO: 20002 - DNA, 189 bp, Homo sapiens
  misc_feature 35, 37, 98, 110, 124, 128, 146, 148: n = A,T,C or G
atacaagtgtgagttttgttccacattggggacangnatttaccgcaggaactttttgttttgtcttagaacatgtctaaagtaacacatgcactagngctgggggctgnggcaaaattactgnaatncaaattggaaaaaaaaangntccagacttgggccaacatttattcctatggcaaaggaaat

SEQ ID NO: 20003 - DNA, 138 bp, Homo sapiens
  misc_feature 36, 59: n = A,T,C or G
catgcctgtaatcccagctactttggaggctgaggnggggagaattgcttgaacctggnaggtggaggttgcagtgagccaaggtcgcgacactgcactccagccttgggtgacaagagtgagactccatctcaacag

SEQ ID NO: 20004 - DNA, 311 bp, Homo sapiens
tataccttcttgcataatgaattaactagaaataactttgcaaggagagccaaagctaagacccccgaaaccagacgagctacctaagaacagctaaaagagcacacccgtctatgtagcaaaatggtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagt

SEQ ID NO: 20005 - DNA, 128 bp, Homo sapiens
tactgaagtcctaaagagcaagcctaactcaagccattggcacacaggcattagacagaaagctggaagttgaaatggtggagtccaacttgcctggaccagcttaatggttctgctcctgggtaacg

SEQ ID NO: 20006 - DNA, 323 bp, Homo sapiens
  misc_feature 80, 85, 91: n = A,T,C or G
aatagaaacaagatagaaaatgaaaatattgtcaagagtttcagatagaaaatgaaaaacaagctaagacaagtattggngaaanatagangatagaaaaatataaagccaaaaattggataaatttaaacctgaaaagtaggaagcagaagaaaaaagacaagctaggaaacaaaaagctaagggcaaaatgtacaaacttagaagaaaattggaagatagaaacaagatagggaaattagaagataaaaacatacttttagaagaaaaaagataaatttaaacctgaaaagtaggaagcagaagaaaaaagacaagctagg

SEQ ID NO: 20007 - DNA, 143 bp, Homo sapiens
gaaagcaacttcagctgagtaacttttaaggtataaacatctaaagattattgggataaatgtgacattatctccagagaactggtccttcataaatctgctattctgtgctctggtatttctgggattctccccctacctcc

SEQ ID NO: 20008 - DNA, 340 bp, Homo sapiens
  misc_feature 45, 72, 79, 143, 185, 210: n = A,T,C or G
ttctgtcgcatccaccagtgtatcagcattaacatgttggcaganaaattgaacatgactccagaagaagcngaaaggnggattgtaaatttgattagaaatgcaagactggatgccaagattgattctaaattaggtcatgnggatatgggtaacaatgcagtctcaccctatcagcaagtgantgaaaagaccaaaagcctttccttnagaagccagatgttggccatgaatattgagaagaaacttaatcagaatagcaggtcagaggctcctaactgggcaactcaagattctggcttctactgaagaaccataaagaaaagatgaaaaaaaaacc

SEQ ID NO: 20009 - DNA, 300 bp, Homo sapiens
tgtgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataaccc

SEQ ID NO: 20010 - DNA, 388 bp, Homo sapiens
ataaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttgggggcaggtctggtgcgttgaaaaattttgtcattccgaaaatcaagagggataaagatggcaatgttactcaggagacaaagaaaatggaaatgaaaggagagccgaaagacaaa

SEQ ID NO: 20011 - DNA, 180 bp, Homo sapiens
  misc_feature 19, 29, 35, 37: n = A,T,C or G
aaaataagcatctaaaggntgttgtgaangactcngngctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatct

SEQ ID NO: 20012 - DNA, 419 bp, Homo sapiens
cgcctttctggacactggggcctttctgtgccgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggact

SEQ ID NO: 20013 - DNA, 331 bp, Homo sapiens
  misc_feature 39, 42, 43, 49: n = A,T,C or G
tgtagcaaacttgccagtggttactaatagctttattgnatnncaaagnttgtgcgtgtgtttattttatgaagagggtggaaattgagatgtcgcgtgcccttaaaatgcagaaaataatgcaaggctttccagtgaatgtgtaacttctacctcatgtgaatacttttaggaagattcatgatttggtgccctatgcaagtggcaactcatcttcagtggaaagatctttaagggagagatgctttcttttgagaattgagaggaattctagactttttaagaaatgaaaaggtaaaataataagagtatctcaaaatatatacaacaa

SEQ ID NO: 20014 - DNA, 351 bp, Homo sapiens
tgagttgtaaaaaactccagttgacacaaaataaactacgaaagtggctttaacacatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgcatcttcagcaaaccctgatgaaggctacaaagtaagcgcaagtacccacgtaaagacgttaggtcaaggtg

SEQ ID NO: 20015 - DNA, 228 bp, Homo sapiens
gtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatg

SEQ ID NO: 20016 - DNA, 411 bp, Homo sapiens
  misc_feature 15, 49: n = A,T,C or G
gacaaagatggtganggaactataacaacaaagaattgggaactgtaangagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggtcaagtaaactatgaagagtttgtacaaatgatgacagcaatgaagaccttgacagaatgggtaaatt

SEQ ID NO: 20017 - DNA, 398 bp, Homo sapiens
acccaccataaatgtacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactaactgtttaattcaatctgtaataaaaatctaactaactaactcatttatttctattaaaaaggtattgcctttaggcggggaatgggaatccttgctgcactgttgcagcattctgaaaggacctttccctgtacttacctttcaacatgcttcaatct

SEQ ID NO: 20018 - DNA, 380 bp, Homo sapiens
cggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgatta

SEQ ID NO: 20019 - DNA, 255 bp, Homo sapiens
atttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgcaatcataagaagccaactcgtacattcatgatacagattgctgtctagccaatcaccagaat

SEQ ID NO: 20020 - DNA, 335 bp, Homo sapiens
ttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaaggcaatgcttttagattaaaatgaagggacttaaacagcttaaagttagtttaaaag

SEQ ID NO: 20021 - DNA, 281 bp, Homo sapiens
  misc_feature 88: n = A,T,C or G
aaatgcagaggtgcacgttcagcaagcaaatcagcagctgtcaagggcagcagattatcagcgcaaatccagaaaaaccctgtgcatnatcattcttatccttgtcattggagttgcgattatcagtctcatcatatggggattgaaccactgaagttataaaggagcacactgtcgcactacattgtctaaattatgtagggaagattcctgtaatcatgtttttttaattattattttaaagctattgtataaaggatggtcccatactttggtatttt

SEQ ID NO: 20022 - DNA, 383 bp, Homo sapiens
gaaaattttgtgccccaaataatatattaatccaagtctaccaaggtaactaagtaatggatgttttctctcttttattacaagcaagaaagttcatttgcagttgtaaaaatgattaccgaactccagacctatttgctataactgattggaaataatgattctgatttttagtctgggtaaacacatacttcggtgtgaattttgataagggaaagacttgtttggtagcccaaggaaaaacaggatgtatttatacagtgaatgttcactctgcagaggaacttccctccagttacatcttcctcatacattagccacctccacacttgacatagatgccaacatgttcaaaaccaatcttgaaggagcctaaagagttg

SEQ ID NO: 20023 - DNA, 381 bp, Homo sapiens
  misc_feature 22, 339: n = A,T,C or G
ctttaaggaccagctgggctgnagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgcttttaagtatatgtttaaaataataatttatgtgnctgcatatgcagaacagctctgagagcacagtttcccattaa

SEQ ID NO: 20024 - DNA, 164 bp, Homo sapiens
  misc_feature 13, 89, 95, 127, 128, 129: n = A,T,C or G
agacagaaagagngatgaacggctaactgccttccggaacaagagtatgttatttaaaagggaattgcaacccagtgaagaagttaccnggaagnaaagactggctagattatcgaatgttcacatnnnaaagttctgagagaaataaaaacatgaagaatctc

SEQ ID NO: 20025 - DNA, 118 bp, Homo sapiens
tatactatctctgagtcagcaaatgacaagtgacagaatccacctttacacaccttcttctgttaatggtagcctctgggaagcaggaattgaggaacagattctccagccatggatt

SEQ ID NO: 20026 - DNA, 154 bp, Homo sapiens
aaacagcagtgattaacctttagcaataaacgaaaggttaactaagctatactaaccccagggttggtcaatttcgtgccagccaccgcggtcacacgattaacccaagtcaatagaagccggcgtaaagagtgttttagatcacccccccccc

SEQ ID NO: 20027 - DNA, 360 bp, Homo sapiens
ttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgctttcccatctgtctatctatctggctggcagggaaggaaaga

SEQ ID NO: 20028 - DNA, 381 bp, Homo sapiens
caatctaattatgagaaaacaccagagaaacccaaactgagtaacattgtacaaaataactgacttgtactttataagtatcaagatcatgaaaggcatggaaaggatgaatatatactgcagaatagaagagactaagaagatatgacaactaaatgcaatctgggatgctgaattggatcctgagaaaataaaaggacattagtggaaaaatcagtgaaatctgaataaagcctgtagtttagttaataacattatggcagtattaatttcctagttttgatatgtgtatcatagtcaaattttaatgttagggaaagccagaggaaagatatatgtaaactctgtactgtttctgcaaatcttctgtaaatataaact

SEQ ID NO: 20029 - DNA, 347 bp, Homo sapiens
  misc_feature 94, 147, 238: n = A,T,C or G
catattcttctgtcaacagacatttattttctcctctcccttgaataagaaaataagttttccattcctatgaactgtctaatatctttctatnacagaaggggaaactgaggctgggaaaggctaaatgacttatcctccatcagntataacagcccctggtcttcttaaatttaaacacgggacttcccgaactaatttttttaaggatactgaaaaatgagagagagtggcgaangcctgaaattttgcttaacttactgtacttaaaatcaattataacttctttttgtactcagggccccactttttgttgctttctagacttgtgtgtagaaagaagatta

SEQ ID NO: 20030 - DNA, 373 bp, Homo sapiens
aagaaaaaattagttgaaactgatttctcaactccaacacaaggaaggaaaaccccatttaacacagacttaggagaaaactctggtattggaaaacttttcactaatgctgtggaatctttagatgaagaagagaaagattattatttttcgaactctgattctgcatagtaaaatgagaaaatatgattcctgggatttttaccataaagcagacagtgtttgtattttcaactggagtacatgtattttctttgtaaagtagcttcctatgaaaatgtggcttttttgaaggtttcatatgtttgtgttcaaagtaaaatatcctcattgctgcagcttactaaaaatgtaaagaaaattgtttttgctc

SEQ ID NO: 20031 - DNA, 325 bp, Homo sapiens
  misc_feature 59: n = A,T,C or G
ccagcagcggtatgttgggccagagcatccggaggttcacaacctctgtggtccgtagnagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagctctggaagtggatcaaactagaactcatatgccatactagatatgtttgcaataaacttatgacgtg

SEQ ID NO: 20032 - DNA, 266 bp, Homo sapiens
  misc_feature 222: n = A,T,C or G
tatggaaactgcatatatccaaaggatggaagaacaggctgaactgctccctgactgtgcacttcctgaaatccagactggtggaaacttcacaggtcaaatggctgagcttgcaacagatgaaatgaaaagaagggagagggagaagatgaatgcctgtagattaaaagaaactttaaatgacatatcaagtcttgaaaatgggaaagacaaaattatagngtctagatatgtcacctgagaaataaaaccacaagaaacctttg

SEQ ID NO: 20033 - DNA, 348 bp, Homo sapiens
  misc_feature 211: n = A,T,C or G
catcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggngtccatacatatgaactggctatgaaccacctgggggacatgaccagtgaagaggtggttcagaagatgactggactcaaagtacccctgtctcattcccgcagtaatgacaccctttatatcccagaatgggaagg

SEQ ID NO: 20034 - DNA, 186 bp, Homo sapiens
gtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttc

SEQ ID NO: 20035 - DNA, 305 bp, Homo sapiens
ccagatcagcttgttgctgcagataatagaaggttcttatgaatccaagttgtatattcacttgtaggataatttaaaaattagattttttttgcatatgagcaaaaaccttttgctggatacaggagaaggttggctttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgcta

SEQ ID NO: 20036 - DNA, 416 bp, Homo sapiens
  misc_feature 35: n = A,T,C or G
tgaagctgacagcattcgggccgagatgtctgctncgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggatcgagacatgtaagcagcatcatggagggtttgaagatgccgat

SEQ ID NO: 20037 - DNA, 307 bp, Homo sapiens
tcctagcacatatttgcaactgaaaggtccgaaaagggcacccacggcagcttgagccccttagcaccatgtaaggagcacagcatccaaacggcttcttgagaaccattggggaatgtctttctttttcacatccaattgtttagtgtctatttattcttgggtggccagttttgaaacctaaaaagggacaataaagcaaaaagtatcagtaaggataggtggctgagacccactgccctgagctactagtgtggctgtgcctgtgggtctctagaaccatctgcattggacgtgaagccacagc

SEQ ID NO: 20038 - DNA, 149 bp, Homo sapiens
gcagtgattaacctttagcaataaacgaaaggttaactaagctatactaaccccagggttggtcaatttcgtgccagccaccgcggtcacacgattaacccaagtcaatagaagccggcgtaaagagtgttttagatcaccccctcccc

SEQ ID NO: 20039 - DNA, 302 bp, Homo sapiens
  misc_feature 7, 55, 68, 133, 134, 137, 180, 181, 270: n = A,T,C or G
ctgtagncccagctatttgggaggctgaggccgagaattgcttgaatccgggagntggaggttgcagngagccaagatggggccactgcactctaacgtgggcaacagagaccctgtctcaaaaagaaaatannccngttagccctaaaggctttacatgaggaatggtagaagtggctnntgtttaaattagttgcattcagcatatatgaattgcttaaatattttggggatactcccccgccttttaaacagggcataagatctggnaaactctctgtatatcttcctacctttcaaaa

SEQ ID NO: 20040 - DNA, 367 bp, Homo sapiens
gaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaaggttagtttaaaagttggaggg

SEQ ID NO: 20041 - DNA, 170 bp, Homo sapiens
aaacatcctttcatgatgaaaattctcaacaaatgtaggtatagaaggaacgtacctcaacacaataaaggtcatatatgataagcctacagctaacattctcaacagtgaaaagttgaaggcatttcctttaagatcaggaacaagaaaaggatgcccactcttactgc

SEQ ID NO: 20042 - DNA, 285 bp, Homo sapiens
  misc_feature 33: n = A,T,C or G
aaacgtattttatgctggtttgagttattttgngtaatagaagactcttcacagtatttagcgtagcatattgctctaagtagaaagcccctgattgttttataagaaataatgttcattattttatttttacttttgagactagagtctcactgtgtcatacaggctggagtgcagtggtgcaatcttggctcactgcaatctccgcttctggggttcaagtgattcttgtgcctcagcctcctgagtagctgggattacaggtgaatgccatcatgctgctaa

SEQ ID NO: 20043 - DNA, 299 bp, Homo sapiens
  misc_feature 41: n = A,T,C or G
aaacacgggacccgctatggggcctccctccggaaaatggngaagaaaattgaaatcagccagcacggccaagtacacttgctctttctgtggcaaaaccaagatgaagagacgagctgtggggatctggcactgtggttcatgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatg

SEQ ID NO: 20044 - DNA, 235 bp, Homo sapiens
  misc_feature 32, 133, 186: n = A,T,C or G
gggtaattccagaattgattggccataccatngtcactgtattactgctcatgtcattgcactggttcatcttccttctcaacttacctgtgccacttggaatatatatcgtatgatcccagctttgataaangactgaagctggagaagccgtggttgaagtcagcctacactacagtgcacagntgaggagccagagacttcttaaatcatccttagaaccgtgaccatagca

SEQ ID NO: 20045 - DNA, 105 bp, Homo sapiens
  misc_feature 8: n = A,T,C or G
acctaggngacaggatgataggtgcagcaaaccaccatggcacacatttacctatgtaacctgcacatcctgcacatgtaccctggaacttataaaataagattt

SEQ ID NO: 20046 - DNA, 191 bp, Homo sapiens
  misc_feature 3: n = A,T,C or G
aangaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctg

SEQ ID NO: 20047 - DNA, 162 bp, Homo sapiens
  misc_feature 17: n = A,T,C or G
gacaacaagtgtctgtnacgagctaccgatgggaagaagaagatcagcactgtggtgagctccaaggaagtgaataagtttcagatggcttattcaaacctccttagagctaacatggatgggctgaagaagagagacaaaaagaacaaaactaagaagaat

SEQ ID NO: 20048 - DNA, 245 bp, Homo sapiens
tgttcaaaaaggaatgccccacaagtgttaccatggcaaaactggaagagtctacaatgttacccagcatgctgttggcattgttgtaaacaaacaagttaagggcaagattcttgccaagagaattaatgtgccgtattgagcacattaagcactctaagagccgagatagcttcctgaaacgtgtgaaggaaaatgatcagaaaaagaaagaagccaaagagaaaggtacctgggttcaacta

SEQ ID NO: 20049 - DNA, 157 bp, Homo sapiens
ttttattaaccgcttcaccagtaaattttgcatgatggctaagctaacataaaaaaagaataataataacttggaagttttagcttacaaaacagagattccttcaacactggacacgtcgagcattttgtagcttaattaaacctcatgtaaggcc

SEQ ID NO: 20050 - DNA, 157 bp, Homo sapiens
acccagggttaaggacccccatgctagagtatgggaagagttagattcaggggcttagctgtcgggggacagttagattcaggggtgtgttagttacctatttgagcccagcttgggcaacatagtgagactccctctctaagaaacaaatatagct

SEQ ID NO: 20051 - DNA, 414 bp, Homo sapiens
  misc_feature 35: n = A,T,C or G
tggaaagtcttctaatattttaaagacctagtagnttacaaggcctttttttgttgttgttgttagacttttggttcacatttacaaactagccacagggtgttcataaatatttccccaaattagttgagtatttttaattgtaaacaaagaattttctgcccctactacactggtttactgctagggtaaagaccattgtctgaagacactaaacttggtgttaacagtgttgattgtttaatggatatggactacatgccactacctgcaactttgtcatcctggagtttttatttggttggttgatttttcgttttttgcttttaaaattcaaagcaaaacaaaattgaagataccattgagaatcagaattcaagatgacttgattctcactaagatcactgcgctttt

SEQ ID NO: 20052 - DNA, 146 bp, Homo sapiens
  misc_feature 101: n = A,T,C or G
ttttaatagcttaagatagaagtttgaagtggaaaactggaagacagaagtacgggaaggcgaagaaaagaatagagaagatagggaaattagaagataanaacatacttttagaagaaaaaagataaatttaaacctgaaaagta

SEQ ID NO: 20053 - DNA, 127 bp, Homo sapiens
  misc_feature 16, 34, 39, 40: n = A,T,C or G
aaattcttttttaaantttcttcagttggagtgntttgnnatgtcttatttttagatggttacactgttagaacactattttcagaatctgaatgtaatttgtgtaataaagtgttttcagagcatt

SEQ ID NO: 20054 - DNA, 230 bp, Homo sapiens
aaaatcttttgtgaaagtgtataactacaatccacctaatgcccacaaggtactctgtggatatccccttgggcaaaactgtcgtcaataaggatgtcttcagagatcctgctcttaaacgcaaggcccggacggggggccaaggtcaagtttgaaggagaggatacaagaacaggcaagaacaagtggttcttccagaaactgcggttttagatgcctttgtttttgat

SEQ ID NO: 20055 - DNA, 158 bp, Homo sapiens
  misc_feature 11, 127: n = A,T,C or G
agtccaggaantggtgtatgtgtggcctcagaagttccaactacttggaaagctgaggcaagaaggatcgcttgagcctagggagttcaaggttgcagtgatctataatcaccactgcactccagcnctgggtgacagaacaaggaccctgtcttcgg

SEQ ID NO: 20056 - DNA, 150 bp, Homo sapiens
  misc_feature 55, 89: n = A,T,C or G
catagccccaccggccatggtgccagccatttgtccagcagtaaaggtggtagcntgtggtgcctttaacaggctactcctgagcgggngtggacttgtgccccttcccccttggctcctgcccaagcctggttctcagtgttcccctga

SEQ ID NO: 20057 - DNA, 277 bp, Homo sapiens
  misc_feature 24, 110, 111, 135, 255: n = A,T,C or G
acctcagctatatcactgcccaanatcaggaaaacctgacggctatggattactatgccttttctaaagatcaatactataacattgatgtgcctagtagaacagcaagnncaattactactcgttctgggcagnccttatccaaagtctggtacaactgtccttagactgatgagcaaaggaggagtcaactaatgaagaaatgaataataaattttgacactgaaaaacattttattaataaaggaatattgncatgagaaaaaaaaaaaaaaaa

SEQ ID NO: 20058 - DNA, 270 bp, Homo sapiens
  misc_feature 132, 249, 250: n = A,T,C or G
tgggcaacattctaaatgactgtggccataaatatagaagctccaaagtttagagcctgaagcttttatgcctaggagcatggcaatctctggtttcattatagtccttgctaaaatttaacttaaaaaagnataacagataaattagacactattggcaccattgaaaaacaatctagcattattttatcaaataaccttaacatgtttataaggctttcatctaataacttcatatctgggatagtnnagaaaatatatacattcaga

SEQ ID NO: 20059 - DNA, 180 bp, Homo sapiens
  misc_feature 14, 32, 50, 71, 76, 77: n = A,T,C or G
ccccggaaaccggnagcgcttgcagcatggcngaccaactgactgaaggncagattgcagaaattcaaagnaagcnntttcactatttgacaaaagatggtgatggaactataacaacaaaggaattgggaactgtaatgagatctcttgggcagaatcccacagaagcagagttacagg

SEQ ID NO: 20060 - DNA, 160 bp, Homo sapiens
  misc_feature 44, 63: n = A,T,C or G
gttgagcactatcattatttagtcttcattacgccaaggagcanttacctgaatttggatgtntgaattataacttatgcaggaatagttctgtaaatacatttaaataaactgtaaagatatttaataaatatagtattatactaaaaaaaaaaaaaaa

SEQ ID NO: 20061 - DNA, 260 bp, Homo sapiens
  misc_feature 37, 144: n = A,T,C or G
agtatgaaatgggaaattgtcatttattgagtacagnaatttcagttgaatgattaaaaagttctggtagatggagagcggtgatggttacatgatgatgtgaatgtgcctaatcccactaaagtatacacttaaaaataaagnggtaaattttatgttaaatatattttaccacaataaaaaataaagggaaaggggaagggaaagaaatgaaaccactagtgatctagttacctcttgggaacattctggaaaaaatt

SEQ ID NO: 20062 - DNA, 100 bp, Homo sapiens
  misc_feature 37, 78: n = A,T,C or G
aaagtgcctagaattctctccctggatctgtcactancttgctgcgtgacctgaacacgtcacctttacctgctctgngcctcagttttcccatgcgtgg

SEQ ID NO: 20063 - DNA, 170 bp, Homo sapiens
  misc_feature 23, 33, 49, 104: n = A,T,C or G
ttagcaaggtacaagtagaaacntctatttgcnggcaacatcatcatgnatatagaaaatattcagggaattcaattaaaaattataaatgagtttatcagggnttcaaggatgcaagatatttacaaaactctattatatttctatatactaacaatgcaaaattaaaa

SEQ ID NO: 20064 - DNA, 300 bp, Homo sapiens
aagtaggagcggcaccccgatatatgttctctaggccttttagaaaacatggagttgttcctttggccacatatatgcgaatctataagaaaaggtgatatttgtagacatcaaggggaatgggtacctgttcaaaaaggaatgccccacaagtgttaccatggcaaaactgggagagtctacaatgttacccagcatgcttgttggatttgttgtaaacaaacaagttaagggcaagattcttgccaagagaattaatgtgcgtattgagcacattaagcactctaagagccgagatag

SEQ ID NO: 20065 - DNA, 470 bp, Homo sapiens
  misc_feature 322, 412: n = A,T,C or G
ggtgtggcagtcctcatttctttggaatctgaagagcccacgcagcatttaattcccactctagattctgtatctagatcaccatggcgactggacagaagttgatgagagctgttagagtttttgaatttggtggaccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgntggagataatgcatctgctttcaagaaaggtgacagagtttttcactagcagcacgatctctggggggttatgcaagagtatgctcttgnagcagaccacacctgtttacaaactacctgaaaactggactttaaacaaggagctgcc

SEQ ID NO: 20066 - DNA, 170 bp, Homo sapiens
  misc_feature 74, 153, 155: n = A,T,C or G
cagcagcgcaggcggtggtccctgcagcccgtgaaaggagtcaaacttgcgggaattttgcagtttatctgcanggctgttgtttccagcaagacccaaagctagaaaagggaggaggaagaaactgacccgatcagtgccagaagtcatttntnttcaaagaagaataa

SEQ ID NO: 20067 - DNA, 130 bp, Homo sapiens
  misc_feature 43, 58: n = A,T,C or G
caataaaatatctggaaaaagaccagtctggtaaactacacancaaacttaatacctnatgggtgaaagccatgaaattttaaaataattaaattaagttatgtagtatattggaagtttttgaaactga

SEQ ID NO: 20068 - DNA, 310 bp, Homo sapiens
  misc_feature 23, 218: n = A,T,C or G
tggccctaaaaatatatctcagngaggaaaggaaaactggtgtaagcctcagaaggatgcctcaccctgagtgtctctgtggcctctctcactacatagtgcagccccagctccactggcctctgaggttggggagggaagggagaattctcctcccttaacattcttgtccaatcacagacacaaaatcactgtttgcattcctcctgccacagccnaagggaagggctgaaattgtcctgttctagtaaggcttggggacaacaaaagcacccccagagaagtctgcttctgggttgcactttctgca

SEQ ID NO: 20069 - DNA, 333 bp, Homo sapiens
  misc_feature 31, 124, 297: n = A,T,C or G
ccttacaccttatacaaaaattacttcaagnatgggattaaagaacttaaatgctagacctaaaaccataaaaaccctagaagaaaacctaggcagtaccattcaggacacaggcatgggcaangggcttcatgactaaaacaccaaaagcaatggcaacaaaagccaaaactgacaaatgggatctaattaaactaaagagcttctgcacagaaaaagaaactaccatcagagtgaacaggcaacctacagaatgggagaaaatttttgcaatctactcatctgacaaagggctantatccagaatctaaaaaaaaaaaaaaaaaaaaaaaa

SEQ ID NO: 20070 - DNA, 267 bp, Homo sapiens
  misc_feature 17, 154: n = A,T,C or G
ccttctcaccttgaagnaataatcctaggaaaactcacaaaatgtgtgatgcttttgtaggtacctggaaacttgtctccagtgaaaactttgatgattatatgaaagaagtaggagtgggctttgccaccagggaaagtggcttggcatggcnaaacctaacatgatcatcagtgtgaatggggatgtgatcaccattaaatctgaaggtacctttaaaaatactgagatttccttcatactgggccagggaatttgacgaaagtc

SEQ ID NO: 20071 - DNA, 370 bp, Homo sapiens
  misc_feature 37, 179, 253, 269, 331, 360: n = A,T,C or G
ctcccttcacagaaaacacttgctccccccttctctngttcttggcatcccctaggaacttgcaccacccaggtctctcgacttctggacctgcttcttaccatgccgtcttaagcagtcaggagtcgctgcctgggttcgagtcctagttaaattacttagtgctgagaccttggggnaggtaaacttttccaagccaggtttattctcagtttcaaaatagggttaatcgtctttatctggcaggtcaggngggatgtctcacaggnaagcacccagatgccatttgaaaggcttgaagcaaagtcaataaagcattcatggggaaaanacaacctggaggcaccactagattttcgnatacattaag

SEQ ID NO: 20072 - DNA, 310 bp, Homo sapiens
  misc_feature 17, 37, 44, 208, 237, 272, 292: n = A,T,C or G
ttcagtttgcttagtangcaaccattggaatgttagnagttccncggaggaacatgaggaattttaaactgtgagttccactgtaatacattttaatgtctgtaggaagaatcaaaacacctatttaaagatggcaatatataataatcattttaaaagtatttggattcaacctaattttccagaaatgaaaaaaaaaaatcagctntaaaaccaaagctgatttcagaaaaattngaaaatgtaaatcagccctatccataatatagttnctctaaaactttatcttagncattttaaaatattataa

SEQ ID NO: 20073 - DNA, 418 bp, Homo sapiens
  misc_feature 63, 92: n = A,T,C or G
aaacaaaggctctttggggtccccaataatttttaagagtgcgaaggggttccagggccaagnacatttatgaaggggttccaggaccaagncatttacgaactactgagccagagttactactgatgccagtatatggtgtaattctatggggaaaataaaaagcttaataccactgacagaaaatattgataaagtcaactcagttacctctgtttggtgtgtgtatcactttgcagatgctgtctaccaccttttcagtgacatcctagaagcttctctattaccacagtaactggctaactaggaaatgatctttccctaattttcatgagcatcttttttctgatataaaccagggagggaaaaaaacaaagttccttcactttgaaggaatattctcctttagtactgtgca

SEQ ID NO: 20074 - DNA, 310 bp, Homo sapiens
  misc_feature 186, 217, 218: n = A,T,C or G
atgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtacagggccaaagacttgagacgtggngttttacatggggactcacattatgaatggnntttactagaagaacattgctgctccttatttattggaagtgtgctgcatgggacgtatttatttgaaagcattaaaataaaatgatcctaga

SEQ ID NO: 20075 - DNA, 307 bp, Homo sapiens
  misc_feature 179: n = A,T,C or G
atttgcttctcagtacatgtttttaaaattgaggaatctctgatgtgacaaaatcaatttttacaaaagttgaattaaaaacttttaaaaattgcttgtctttgggggtatgtctacatattcgtttaaatttagaattcccacatgtttaagatatatgcccatcccctttttagagnaatcaaaatttctatcacagttcacatactggaatacatagtaaaattgagatgtgtccaagagattttcaatgttaattagctcattctaaatagccaatataaggtaactttctgtttaaaaaaaa

SEQ ID NO: 20076 - DNA, 120 bp, Homo sapiens
  misc_feature 77: n = A,T,C or G
tttgaatttttttttcaacactcttacacctgttatggaaatatgtcaacctttgtaagaaaaccaaaataaaaatngaaaaataaaaaccataaacatttgcgaaaaaaaaaaaaaaaa

SEQ ID NO: 20077 - DNA, 310 bp, Homo sapiens
  misc_feature 13, 19, 30, 60, 83, 120, 141, 178, 210, 236: n = A,T,C or G
agccacaccaggnctgtgnctgaagggtgntttttttcttttaaatgtaatacctccctnatcttttcttcttacacagtgtntgagaacatttacattatagaaaagtagtacatgggnggataacttctacttttaggnaggactacctctctttctggacagtcctagaactggncttctacactaagacaccatgaaggaagaatngtgctcctattatttcctggctttgngctctgccaaaaccccttctttagcccttcacacattcagcgctggaagaaatatgatgctgaaggatatggaa

SEQ ID NO: 20078 - DNA, 310 bp, Homo sapiens
  misc_feature 84: n = A,T,C or G
ggagggaaaccagttaatttaagcccaggaatgctttcagaaatgtgcaatattatttaggacctttactgtaatagccccagnagtatgtctgagcatccatgcagattagatcttgaacagctgcatggagtacacagaagtcatgattcctgcctctgtgaactaacttgaataaagggtttcatctaaagatctcattgtttgtctatttcatgaatcccctcatctcatctctgaagggctcattcagtttaatgcagtttagcttttgtggtttagagctctagaaattgctattgtaatttat

SEQ ID NO: 20079 - DNA, 194 bp, Homo sapiens
  misc_feature 18, 24, 165: n = A,T,C or G
gaacgggcacagcatggncagcgnctccacaccaatctcagaagtgtatgagaagtgagaaagatgaagatggattcctgtacatggtctatgcctcccaggagaacgttcgggatgaaattgtcagtgtaaaaccagaaaaaatgcatctcttctagaattgtntaaacccttaccagaaaaaaaaaaaaaaa

SEQ ID NO: 20080 - DNA, 320 bp, Homo sapiens
  misc_feature 26, 199: n = A,T,C or G
gctcagcaaccaattcaataatttgncggaggacattttaggttgatttcaggttttgctactgtaaatgatgctgttgtgaaactctttgtgcttataaccttgttcacattttacattatttgcttagaccagattcctagaaaatggggttactaaagtgaagagaatgactgttggtaaagaattcctgtaccgngaagcatcccggtcgggggcaatcacatttcctaccggcctggctcagcacaagcctgtgttgcctctatgggcctgaattttaaaaagacacaatttgcttttcttttttacctatcaag

SEQ ID NO: 20081 - DNA, 170 bp, Homo sapiens
  misc_feature 25, 73, 107, 157: n = A,T,C or G
ggcccttgctgccaccaacacggangactttgtaccgtgtccccgttcttagtgctcgaatgtcccaaccagnaagctgaagaagccgccctggttgcacatgccgncggccatgactgtgtatgctctggggggggggtcttacttcctcatcacnggagggaataatt

SEQ ID NO: 20082 - DNA, 280 bp, Homo sapiens
  misc_feature 264: n = A,T,C or G
gaaggaaatcccagttaccctcattcagtccattacacattcgatacaggtatcaaaatatcataggcacctcaaagacatgtacaactcttaatttaacatttttgaaagaaaaaaaaaccggccagagcgttaaaacaaataaaataagaaacacagaggccagtgttaggtgaagaactccgctgcttcagaaagagaatagcagcgctcgcttaccgtgggaacacggccagttaacaaaatgggttttggtttttttgntttggtttggttttac

SEQ ID NO: 20083 - DNA, 419 bp, Homo sapiens
  misc_feature 41: n = A,T,C or G
gagaaatcatataatataaaaatcatgactttgggaatgcngaaaggttgctatcaagtgtcatactttctgacacttttgaggatgcatgtgggagagaaaccctattgaggcagtgactgttgaaaaagcttgaattgaggagtcaagagtcactaagcagaatttagaaagagaagtttttaaaaagcaaacagtgtaaaaaaagtcatctcccagaagacactactcgttacatattggatgactcattgaggtgaaaaccttattagtgttgtgatagtagagaagcttttagtcaaaagtcagtttattaaatgtttagaatacctaaacaggaagaaaattctattgttttttataacaaagtggaagattcaagaaaggacaactcactgacacttgagaataatacctac

SEQ ID NO: 20084 - DNA, 257 bp, Homo sapiens
cctggaacatctccgagtgggtgtgggttgtggccctgcgtgtgtgattttgcctatcccagctccggggtaccaccaaccactttttgtctctgtgggtttacctactctggatattttgtttaaatggaatcataccaggctgggcacagtggctcatgcctgtaatcctagcactttgggaggccaaggtgggcagatcacctgaggtcaggagttcgagaccagcctgaccaatatgatgaaaccccgtctct

SEQ ID NO: 20085 - DNA, 103 bp, Homo sapiens
  misc_feature 38, 54, 57: n = A,T,C or G
tatcgagaagaatataattctcatgaggacttaatgantccaaacctgtgccangcntgtgtgcatacccaattaaacactggaaataaaaattgttttggtg

SEQ ID NO: 20086 - DNA, 359 bp, Homo sapiens
  misc_feature 257, 350: n = A,T,C or G
agagcactcactgcttcccatctttgttaaggttagcgaattacccatggacactgttaggtgaggctcattcggcagccctgaaaacaaacctggtcacactgtctttaccctctcccttcagataaagcacttcgattatctattgatctgcccagttttcaagtcatgcgaatactaaaaaggttacatcatctggatctgtaccttggctatataagcatgttttccccctattctatgtttctttttttggngaacattgaaaaacaggagggacttattactgttaattaaaactaaatgaaaaatgcaagtctttaaaacagtgagcttgtaactcttcatgnaattttatc

SEQ ID NO: 20087 - DNA, 120 bp, Homo sapiens
  misc_feature 23, 80: n = A,T,C or G
attgaggcagccagcgcaggggnttctgctgagggggcaggcggagctctgaggaaaaccgcagaataagtttttttctntttgaaagatagagattaatccacctacttaaaaaatata

SEQ ID NO: 20088 - DNA, 327 bp, Homo sapiens
  misc_feature 18, 29: n = A,T,C or G
aattataaaacttaatgnttaaattcagngtactacctttgctctttcctctttcctattgtgaacttgcctcccatttactgtctgtcactttctttgagataaataaaaaagacaataatttttttctagaaagaagcagtttatcgatctcttctaatatttgcctttcagttttctgttttcaaactgccatttcagttggtgtcatttttcgttttgtacttatgcccttctggttgcattttttttttaaagccaagtaattgccattaataagcttttttaaataaaaagaaactaatcttcctttgaaaactttaaaaa

SEQ ID NO: 20089 - DNA, 180 bp, Homo sapiens
  misc_feature 10, 16, 23: n = A,T,C or G
gggttaaggncacggnaaggtgncccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgagatattttatgacctg

SEQ ID NO: 20090 - DNA, 380 bp, Homo sapiens
  misc_feature 23, 362: n = A,T,C or G
attaaaaaacttcatgtaatttnattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagccctatttttttagattgagaaatgtgtagctgcaaaaataatcatgaaccaatctggatgcctcaattatgtcaaccaggtccagatgtgctataatctgtttttacgtatgtaggccccagtcgtcatcaggatgcttgcggcaaaagggaaagctgtgnttatatggaagaaagtaa

SEQ ID NO: 20091 - DNA, 100 bp, Homo sapiens
tacatcactctcagaaaaggtaaagacaagaacgatgggtgggctcgggtcccccgctcgccgatcagaagtaatggactcttatactgggcatggggag

SEQ ID NO: 20092 - DNA, 400 bp, Homo sapiens
  misc_feature 38, 326, 374, 380: n = A,T,C or G
aaaggtcttgaagcacctataattaccccctgaaaagnactgattggccctgcttaggtcacttgcccatctttttataagcttttgtattcagacttactaagactgtgacaagcctaggttacatgtctatccctgaggtgggagaaataagaatgtatgattgatggataaagggagggagacgaaggtaaagagagtttatgtccagaaagtctaagggatgctgtgtaggcaaaaacaagatttcccttcatgtaagtaatagttagcattgatggatgtttagtgggtttctcctggaaactatgcctaagtaaatttgntattaattctaagggagatagacctctattaataagaaagctctttgnatctgnatgatacacttatcataaga

SEQ ID NO: 20093 - DNA, 400 bp, Homo sapiens
  misc_feature 25, 249, 374, 379: n = A,T,C or G
agcattatggtttgagcaagggccnggcttctagagtggggtgtgttgagatcgttttcccactatttttatttaactcaccaaatatattctgtaattgggcatgacccagcaaaatgttccactctgaagttttatcatggaggccaaagtagcatgttcaatgtctgccaagttctcaaaggaaatagtagtgggagggcaggccctgagctggagcttccctggtgactacaaaagcaattgcangaggaccacgtgatgtggctccagagcacatgactcagatgtccattgaaaagctgtatttgctcagggtgatggctaagaaaaaatgtcttatgccctttaagaaaagagtcttgttttgaagngaganaaatccttccattttcataag

SEQ ID NO: 20094 - DNA, 110 bp, Homo sapiens
  misc_feature 101, 103: n = A,T,C or G
gtaggtaattcactatgcgctttatatgccttagggcatccaaataaaaaacaatagggtaaacatccccaaaacccacctttaaaaaaaaaaaacccatncngaatttc

SEQ ID NO: 20095 - DNA, 400 bp, Homo sapiens
  misc_feature 23, 46: n = A,T,C or G
caacaccaaaaggcttcttattngggtgtgagtcttttcagcaacnccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtgggtgttttacccacatgacttattatgcataaagccaaattttccagtttaagtaattgcctacaataaaaaggaaatttttgcctgccattttcagaatcatcttttggagctttctgttgatgttaactgagctactagaggatattcttatttcactaaatgtaaa

SEQ ID NO: 20096 - DNA, 262 bp, Homo sapiens
  misc_feature 26: n = A,T,C or G
agtccaaagaggaaacagctctttgnacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctctgcataagccaaaaaaaaaaaaaaaa

SEQ ID NO: 20097 - DNA, 410 bp, Homo sapiens
  misc_feature 102, 125, 150, 300, 320, 350, 372, 392: n = A,T,C or G
cacacctgcaaactcttttacttgggctgaatatttagtgtaattacatactcagctttgagggctcctgtggcaaattcccggattaaaaggttccctggntgtgaaaatacatgagataaatnatgaaggccactatcatcctccttntgcttgcacaagtttcctgggctggaccgtttcaacaggagaggcttatttgactttatgctagaagatgaggcttctgggataggcccagaagttcctgatgaccgcgacttcgagccctccctaggcccagtgtgccccttccgctgncaatgccatcttcgagtggnccagtgttctgatttgggtctggacaaagngccaaaggatcttccccctganacaactctgctagacctgcnaaacaacaaaataaccga

SEQ ID NO: 20098 - DNA, 400 bp, Homo sapiens
  misc_feature 179, 321, 392: n = A,T,C or G
actttgcccagttccatcagaggcatctctttctgtggcagctgtggccttatgaaatgtgtttcttaaataatgggactttaaagtcaaaattactccttgattcatgagctgcagaatggttattgcagggatgaaagcaaccattaatctctttgtacatcaccatcagaaatctngggtaaccaggggcattgtcaataaacagtaatattttgaaaggaatatttttctgagcagtagggtcttcaaactgtgagcttaaaatattcagtaaaccatgctgtaaacagatgtgctgtcatccaggctttgttgttncatttggaagaatacagtaagtctagatttatcatggatttttaaggccctagaattttcagaatgggaangtgagcat

SEQ ID NO: 20099 - DNA, 450 bp, Homo sapiens
  misc_feature 14, 419: n = A,T,C or G
cactggctgccagnaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctggccccaaaagagctagcagaatccgcaaacttttcaatctctctnaagaagatgatgtccgccagtatgttgtaag

SEQ ID NO: 20100 - DNA, 340 bp, Homo sapiens
  misc_feature 22, 47, 197, 200, 285, 302, 338: n = A,T,C or G
cagtgggtttttattaatatgntgattaagttatttactgggccagncattgtgctaaatagttgctcttttgtgtttcattgccttgatgtttgagtgtaatctagcattttaatacagtgtttattttgcatgatctttaacaaatgtttttaagcaattttaaaaggcaggatgttactgacattatacactgnagncttaacattttaacatttatagggcttatttgcaaaattgtataattaggaattatttcagagacaaatgttttctttttcaggngagtaggttgcccgggnaatatcaattgggaggaccatttcttttatactggntt

SEQ ID NO: 20101 - DNA, 296 bp, Homo sapiens
  misc_feature 18: n = A,T,C or G
agcaaaatagtgggaagnattataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaacaaaaaaaaaaaaaaaaaaa

SEQ ID NO: 20102 - DNA, 400 bp, Homo sapiens
  misc_feature 42, 72, 130, 229, 236, 273, 336, 370: n = A,T,C or G
tctttgtattaccgaagctaggctacaggtgactaccctagntcaaaacaaccactttctcaggcttctcangtgggtagctaagctaccttgtcatatgtgttggacccttgaaaactgggacgagtgnttccattgggggttggccatttatgctgacatgccatcccttccagcaaacgtacgggaatgtgctttcaattgatggactactctatttttttgcaanattttgnaaactttgcttctccaatacaaggggactaagggtgnccatttatggtacctatttgggggctaggaaaattttcaaactagatttataaaatgcactgnaatatgtacacaacttagaaaccaaattacaagnattcaggtccaatactttattaatttcaat

SEQ ID NO: 20103 - DNA, 108 bp, Homo sapiens
gggcaggattctagagctgagcaagcactcacgttcggttatgatagcagaccatgaatggacgaatttcagtcaagctgcctctgaactagagctccctggcgaggg

SEQ ID NO: 20104 - DNA, 400 bp, Homo sapiens
  misc_feature 206, 306, 321: n = A,T,C or G
ggcggttggcaagaacaagcgccttacgaaaggcggcaaaaagggagccaaggaagaaagtggttgatccattttctaagaaagaattggtatgatgtgaaagcacctgctatgttcaatataagaaatattggaaagacgctcgtcaccagggcccaaggaaccaaaattgcatctgatgggctcaagggtcgtgtgtttgaagngagtcttgctgatttgcagaatgatgaagttgcatttagaaaattcaagctgattactgaagatgttcagggtaaaaactgcctgactaacttccatggnatggatcttacccgngacaaaatgtgttccatggtcaaaaaatggcagacaatgattgaagctcacgttgatgtcaagactaccgatgggtact

SEQ ID NO: 20105 - DNA, 480 bp, Homo sapiens
  misc_feature 12, 13, 24, 241: n = A,T,C or G
gggagccctagnnggcctgagcantgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgngtttaatgcacagctacttcacaccttaaacttgctttgatttggtgatgtaaacttttaaacattgcagatcagtgtagaactggtcatagaggaagagctagaaatccagtagcatgatttttaaataacctgtctttgttttttgatgttaaacagtaaatgccagtagtgaccaagaacacagtgattatatacactatactggaggggatttcattttttaattcatcttatga

SEQ ID NO: 20106 - DNA, 360 bp, Homo sapiens
  misc_feature 93, 121, 152, 244, 280, 340: n = A,T,C or G
aaacagctgtcttcatttttctcctctaaagaacttaattcatttgttacataaaatataaggaaatctttatactattttacagtaaccacnatctaaatatttacatatacccaaaatnaacttatgctcatatattaggatgtgagaanatcatctgtttatggacacatgaaacctcctaatgacctgggattgttagaatatttgactttttatatgcaaagtttttcaaccaaggggnttggctaatatttaaacatgtactggcacaatttgngatgaaaatattagcacatttgcaataatggttctccataacagagaatgggaatggaanaccagaatttatttttggat

SEQ ID NO: 20107 - DNA, 500 bp, Homo sapiens
  misc_feature 12: n = A,T,C or G
gtatataaaagnagcagggtaccccacaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtgggtacctcagctatatcactgcccaacatcagaaaacctgacggctatgattactatgcccttttctaaagatcaatactataacattgatgtgcctagtagaacagcaagagc

SEQ ID NO: 20108 - DNA, 209 bp, Homo sapiens
caatcacatgatctgaggaccattcatggcaagctgctaaatagcctagtctggggagtcttccataaagcttgtgcatggtgcaaacaaacaggagtaaactaggtttggatccttcagccctctaaaagcatagggcttagcctgcaggcttacttgggctgcctctgtgagtgtagataggcaaacactatagcagctgctaagag

SEQ ID NO: 20109 - DNA, 310 bp, Homo sapiens
  misc_feature 241, 264: n = A,T,C or G
ggacaccaggtgagggttggttcggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagancaacaggatagagctgttggggnggcacagtggcccaaagagcagcttcagagataattccttggttct

SEQ ID NO: 20110 - DNA, 376 bp, Homo sapiens
  misc_feature 57: n = A,T,C or G
aggaatacatacttattcccatttttaagcatttgcttctgctttccctcacctagnaatgccaggatgtttttcagttatctccccatttgtcaaagttgacctcaagataacatttttcattaaagcatctgagatctaagaacacaattattattctaacaatgattattagctcattcacttattttgataactaatgatcacagctattatgctactttctcgttattttgtgtgcatgcctcatttccctgacttaaacctcactgagagcgcaaaatgcagctttatacttttttactttcaattgcctagcacaatagtgagtacatttgaattgaatatataataaatattgcaaaataaaaatccc

SEQ ID NO: 20111 - DNA, 360 bp, Homo sapiens
  misc_feature 57, 262, 269, 296, 356: n = A,T,C or G
gctgccgaaatgggcaagttcatgaaacctgggaaggtggtgcttgtcctggctggncgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggnactctgnggatatccccttggacaaaactgtcgncaataaggatgtcttcagagatcctgctcttaaacgcaaggcccgacgggaggccaaggncaag

SEQ ID NO: 20112 - DNA, 500 bp, Homo sapiens
  misc_feature 13, 476: n = A,T,C or G
accaaaggaaagnaggaaaagggccaaaagccaaaatgaaactgatggtacttgttttcaccattgggctaactttgctgctaggagttcaagccatgcctgcaaatcgcctctcttgctgcagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagaaagtaaatctgtgntaaacaagtagtaataaaaggtaa

SEQ ID NO: 20113 - DNA, 170 bp, Homo sapiens
  misc_feature 65, 143, 167: n = A,T,C or G
agtgttcaaagcaggcccgagccgcctggataccgcagctaggaataatggaataggaccgcggntctattttgttggttttcggaactgaggccatgattaagagggacggccgggggtattcgtattgcgccgttagaggngaaattcttggaccggcgcaagangga

SEQ ID NO: 20114 - DNA, 170 bp, Homo sapiens
  misc_feature 22: n = A,T,C or G
actccagcctgggtgacagcancaaggatccgtctcaaaaacaaaaaaaattaaaataaaaattattgttttagctgcatgtcttcagctatttagaattcaaagactaatgaattgtttctaagtcaccctaacatcaaggtacttattttataaagaatttcctcctt

SEQ ID NO: 20115 - DNA, 150 bp, Homo sapiens
  misc_feature 13, 21: n = A,T,C or G
aaaatcaaaaagnccctctgnctgtggacaaaataatgaaggacctggaccagggtagagatggcaaagtgggcttccagagcttcttttccctaattgcgggcctcacccattgcatgcaatgactattttgtagtacacatgaagcag

SEQ ID NO: 20116 - DNA, 270 bp, Homo sapiens
  misc_feature 24: n = A,T,C or G
tgctaaatgaacctaatagggacncttcctgaaaacaggccaatgacttagtacagcaaaggtggaggatgagtaatttgatctcatgtcaagggtgtggattcactccaaactctcttagcaggatagagccaaagtcaatgcctagttgaggagagagctcagaggagcctggctaacatttagtcaaaaagagtctctgtcagtgctcgatttagttttattactcaacactgatactttctgagctaggcactgggttaaacacgt

SEQ ID NO: 20117 - DNA, 500 bp, Homo sapiens
  misc_feature 24, 48, 53, 385: n = A,T,C or G
caccaatgttttccaggtgacctntgcatgatgttatgaaatcaggtnttggngaaagggccattcaaagcttaagatacattaatagatttattctgacagtacaaaaaattcattgctatagtttctgagttagaaataaccttgaagaagctaccacttgtcagagttttgaggtagtatcaaagaatatccacaattatccgaaacggcttttaaaattatttttccttttccacctacatatgtctttcttcatatactttacccagaacgtcatattacaaaagaagcagactttccacattggtcttttaggatttttcacagattaaggttaccaaaatagtaagtgccaaactcaaattttaaaaacccatgaggnaacaagccaccttgagtgagacttaggggaaatgataataggaattagatcctccaaaagtattaggaataatcacatatttttaaaatgcttaagataatttttaaaataaaag

SEQ ID NO: 20118 - DNA, 410 bp, Homo sapiens
  misc_feature 2, 18, 134: n = A,T,C or G
ancataaccatctggagngtgtccagtttgttcttcataggaccaatttttatttgcagcttgagtttttatatgaagttgcattattgtggacttggctgtcttgtgatgaatttttttcatatgtattctgngccatactattgttaaaatgaactgttgctattgtgagatggattttaactgacctattaagggtttctttcgaatggcactactttagggacattctagtatttgcttctattgtttggggccttggggataatgtacagatttaaaaacaaatcttgttgctgatttgtccatttctttccctgcactttggtacatctgggatacaggctaactcatctgattaatatgcatttaaaaaaatgccataactattaaacaccttgttacagaca

SEQ ID NO: 20119 - DNA, 120 bp, Homo sapiens
  misc_feature 103, 106: n = A,T,C or G
caaagcacgatgaacaggttgacagtagggcccactgacggaggagagacagccctgaatggcctaacagtatcgcaaagggaaacctgggactgaaaccagnagnagagccttcaaaag

SEQ ID NO: 20120 - DNA, 450 bp, Homo sapiens
  misc_feature 47, 57: n = A,T,C or G
gcgtgggcgtttgaggaagctgggatacagcatttaatgaaaaattnatgcttaagnaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttggcttttcattggtttcatgttgatgtttgggtcacttattgcttccatgtggattctttttggggcatatgttacccaaaatactgatgttt

SEQ ID NO: 20121 - DNA, 400 bp, Homo sapiens
  misc_feature 17, 26, 158, 159, 228, 230, 304, 346: n = A,T,C or G
aaatagttttaattttntaataaaantttctctacgttctatatgcaattgttatatatctatttgaatagctgaaggactaaaatacttttttaagagataacttcaggaaaccattatattttactatctgcatgctgttaactgtggtacactgnngaaatatgttggattacaaacccattcattacatagtataaggaattcacagtatattgactatatagngnctaatgatcttggggcagatactgtcaaacttacaatatctatataggatgtaggtctttttaaattacctagnattcttctatcatgtatattggatgctgaaagaggaactggncagctcctctggacaacaaattcttaggctataatattaggagacatcttctgt

SEQ ID NO: 20122 - DNA, 150 bp, Homo sapiens
  misc_feature 86, 91, 145: n = A,T,C or G
ggattcttggcgttagaattttctgcactatttataagccctgattctgggttttaacaagctgattgtacatctatatttaggtnaaaanaggtaggattatctttctgtacatagcgtacattacaacctaaaaagggacggnaaaat

SEQ ID NO: 20123 - DNA, 510 bp, Homo sapiens
  misc_feature 76, 104: n = A,T,C or G
ttgtcatcagcaacactgaatgccagagtcaatggatcaacatcttcagagcttaaggaaaatttttgtacctagnaatttcatagtaaggcagactgtcaagnaagaacatcaaagtgaagacattttctgtcaggcaaattttcagaaagtctcctttgcacccttactgaggaagtatcttgaggaaattctccagcaaaatgaggatgaaaaccaggaaagaagaagaaatgggatccataaaacagtggaccttacttaggatgtctcattctagagtgacagccaaaagggtatctcaccctagagtgacagctatccagcagactaatttcagatgagagcatactgtctcgggctttctgggaagaatgtgcattcagtgccatagatagtatcattgaagagctgggatgcttgagaagattatttagtcaagaaaaaagaaagacaaatcaacaatatgtcaaaaaattcaggtccaattatagagcaaaataaaatgag

SEQ ID NO: 20124 - DNA, 470 bp, Homo sapiens
  misc_feature 15, 363, 411: n = A,T,C or G
ttggtgaacataggngctaaaatccttaacaaaatactagctaatcaaatccaacaacatatcaaaaagttaatccaccatgatcaagtgggtttcataccagggatgcagggatggtttaatgtatacaagtcagtaaatgtgatgcaccacataaacagaattaaaaatcacatgatcatttcagtagatgcagaaaaagcattaaacaaaatccagcatccctttatgattaaaactctcagcaaaatcagcatacaagggacataccttaatgtaataaaagccatctatgacaaacccacagctaatgtaatactgaatggggaaaagttgaaagcattccctctgagaattggaaanaagacaaggatgcccactctcaccactcctcttcaacatggtactggnagtcttagccagagcaatcagacaagagaagaaaagggcatccaaatcagtaaagaggg

SEQ ID NO: 20125 - DNA, 248 bp, Homo sapiens
  misc_feature 24, 38, 168, 171: n = A,T,C or G
ttacatataataaatcaaaatttnctatataaaactgntttggggagttcgggggggaaatattttgaatattaatttatttttaaagatgcaagaataggactttgggcaatgtatttttgtaaatgcttttcaaaatatctgtctttggtagtgcttctgctgctnccnccaaattgataagatgctattaagaggtttaaataaagagttttaatttttaaaaaaaaaaaaaaaaaaaaaaaaaa

SEQ ID NO: 20126 - DNA, 468 bp, Homo sapiens
  misc_feature 319: n = A,T,C or G
caaaaggattcattaggatagctttttgtgtatgtatatgtatatttatttctaggaatagatctatagttgtacatgaattcctgttaggaatactctgaatgagcttaacccacttgccaaatgtccttgtcccttccatcattttatttttgagatggggtcttgcagtgttgcccaggctggactcaaactctggggcttaatcatccttctgagtagctgggactacataaaggccaaagtataattgcttttgatttttaaaatcttcttgcccatcatttttataaaaataaagctgtttgtccaacacggngaaacctcatctctactaaaaatacaaaaaattagctgggcatggtggcacacgcctgtaatcccagctacttgggagactgaggcagggagaattgcttgaacctgggagatgggggttgcagtgagcctagatcacgccactgccct

SEQ ID NO: 20127 - DNA, 250 bp, Homo sapiens
  misc_feature 44, 46, 77, 96, 125, 137, 144, 171, 203: n = A,T,C or G
tccacctgggctaggcgaagtgaagtgtggctgactgcattatntnagaaaatgctggccaggcgccaggggctctnacctgtaatcccagcactncgggagaccgaggcgggcagatcacgagntcaggacattgngaccatnctggccaacatggtgaaaccccgtctntactaaaaatacaaagattcgctggacgtggnggtgtgcgcttgtaatcctagctacttgggaggctgaggcaggagaa

SEQ ID NO: 20128 - DNA, 450 bp, Homo sapiens
  misc_feature 22, 83, 198, 330: n = A,T,C or G
ggtgcacgcctggggtaagaanccactttggaaagtaggaaaagcccagcttttcctgggacatcttctgttattgttgatgnttttttttaccttgtcattttggtctaaggttgccattgctgctaaaggttaccgatttcaaagtccagataccaagcatgtggatatgtttagctacgtttactcacagccagngaactgacattaaaataactaacaaacagattcttttatgtgatgctggaactcttgacagctataattattattcagaaatgactttttgaaagtaaaagcagcataaagaatttgtcacaggaaggctgnctcagataaattatgggaaaattttgtaagggagcagacttttaaagacttgcacaaatacggatcctgcactgactctggaaaaggcatatatgtactagtggcatggagaatgcacca

SEQ ID NO: 20129 - DNA, 153 bp, Homo sapiens
  misc_feature 29: n = A,T,C or G
ctgctgagggggcaggcggggcttgaggnaaaccgcagataagtttttttctttttgaaagatagagtttaatccacctccttaaaaaatatagccaataggttactaagatattgcttagcgttaagtttttaacgaaattttaatagctta

SEQ ID NO: 20130 - DNA, 421 bp, Homo sapiens
  misc_feature 24, 89, 141, 250, 366: n = A,T,C or G
aaaatctggtcactttttggggtngactttcattacaagtatcatttaataatcatttaattatcagactccatatagtttcttctgtntctacatttagcaacacatatgtacattacagatatattattgaacatctgnattcgatataaatatacacatttaataacacaatgtagccactcaatagagaaaacagactgcaaaactattttaaaatgagtgtacatcatgttaatagttgtcaggntgggggtaagaaggaccaaccatcataatttataacctaaatcagatgaactaaaaggatccaaaaatttccagctctgtgacagtacaaaacaaaattcatcaccagtaaccagngcttgaaggattctactacttggggtatctcagatggctttaaaaaaaaaaaaaa

SEQ ID NO: 20131 - DNA, 258 bp, Homo sapiens
  misc_feature 83: n = A,T,C or G
agtaattacttgtccagacaaaaggtaagctatgaaagcagaggcaggcccaagttgaacaacaattactacagggagacagnaaaaattaatgaaggaaaaactagtaagtacaatgtcaagctgaaaaagtacgtgatgaccttcaaaaacaagtgaaagctctagaaatagatgtggaagaacaagtcagtaggtttatagagctggaacaagaaaaaatactgaactaatggatttaagacagcaaaaccaagc

SEQ ID NO: 20132 - DNA, 500 bp, Homo sapiens
  misc_feature 21, 45, 58, 60, 487: n = A,T,C or G
ctttttccggctggaccatgntgggtgtagaagagaagaagaggnggttcctgctgtncnagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgnggttatggcaaaa

SEQ ID NO: 20133 - DNA, 410 bp, Homo sapiens
  misc_feature 43, 46, 114, 169, 255, 271, 315, 344, 349, 372, 379: n = A,T,C or G
aaaataaactgtttctatatttatgtgtttatttgactaatgnggncctgccatctttaaatgtgataaacatttatcacatttgagtatacctttgagaacaaagtaacattnggttttgttcatcactgcatatttttcaaggcctgacacatgatagtttacctgntacttagctataatgcttattcgattattggttatgtaattataataaatgaaaaactattcatgcagatatcagataactaaggnctaactgacagcaatncaccacatgcctaatgcttgactgatatcttgacctttatattnggggaaaaaaaaaggtaggccacgggggngattnctaaggctgagctaacccctatnctaattnaagggaagagcactagtactgaattcagatt

SEQ ID NO: 20134 - DNA, 500 bp, Homo sapiens
  misc_feature 371: n = A,T,C or G
aactaatgtacctttaattgacgacttctaattccctaattttttctggtagtttaaaatgttcatatctgaaatgaaaaagtagagtgtttcttttggctttgtttatattggatttttgaaattagctgtttcagctaatgctggacattagtcagttttaaagcagtgcctacatctcaagaagaagcaagggggcggaaagtaaagagctactaaatgtcatttttaaaaagcccactaagctgggaaaattaatatggatttcagatacccctgttttcggaacatctgtcttggcataaagcagagtattttactttgaaatatcagtgaaatataatttaagcttgcacatccacacacatgcncagacatatgtaatcaacagatatctgtttcacaaatagggaagataggcagcaataaagtattaaaataatttccatggtgggaaaatcaataactataaaacccccagggtcttctctgattaatga

SEQ ID NO: 20135 - DNA, 333 bp, Homo sapiens
  misc_feature 23, 319: n = A,T,C or G
gactcctatttgatagatggcanctagcccaggggagattactgagctaattataactggaggggtctccgaggaatacagaagatgagaagcattctggggcctggttcttctcaaatcctaaaaccaaatttagcctgttgctgattatttagatgatgaggacacttttagcacagggatagtggcatggatttgagtgaggacaagagccatgaaaataatgactagggcatacccctcattttttaaagatctgatttaagatttattatattatttgaagagaagggtttagttaaattcagtcacagttatnaataaaaaaaaaaa

SEQ ID NO: 20136 - DNA, 390 bp, Homo sapiens
  misc_feature 47, 52, 381: n = A,T,C or G
aatttagtttttaaaatagtaaactgaatatttttgttgtaagcctntcagngtcaatccttcgtttggaattgttttcctgtttttccttactataaatcatttaaaaactgaattcattttcttagatggcataagtctgtctcttgagaaataagtaaaatactcctattttcagtatctgtagcacctgaaatagggctttgtatagccagaaacaagttatgttggaagttagcttttctttgtcaacagttttgggacaataaaaatctgaaagtattaacacttgattttctactggggcccttcaaacttggtgggaagaaattcaaccagatatctatgtgtggaaggaagatggctagttaatcaagattngtggcactt

SEQ ID NO: 20137 - DNA, 480 bp, Homo sapiens
  misc_feature 22, 37: n = A,T,C or G
ttttcaaaataaagcttttgcntagtaataatgaagnatctttggtttttgttttcattaaagaagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttgggcttactttggtaatttatctggtggccccttcctctcctctgccctcccttcttgggcccttaaaaccaaaccctatgccttttgtagctggcatggggcaatttggctttggaaaattcagaaaagggaatttaaggggatatgggg

SEQ ID NO: 20138 - DNA, 270 bp, Homo sapiens
  misc_feature 12, 59, 131, 156: n = A,T,C or G
aactaatgaagnaaatgaataataaattttgacactgaaaaacattttattaataaagnaatattgacatgagtataccagtttatatataaaaatgtttttaaacttgacaatcattacactaaaacagnatttgataatcttattcacagttgntattgtttacagaccatttaattaatatttcctctgtttattcctcctctccctcccattgcatggctcacacctgtaaaagaaaaaagaatcaaattgaatatatcttttaag

SEQ ID NO: 20139 - DNA, 200 bp, Homo sapiens
  misc_feature 57, 81, 90: n = A,T,C or G
atctttctgttaggccccaggtaggggttggcatcatgcttgtaatcccagcacttngggaaggccggaggggggcagatnacttgaggncaggggtttgagaccagcctggccaacatgaggaaagcctgtctctactaaaaatacaaaaattagtccggcatggtggagtgcgcctgtgatcccgctactcaggaggc

SEQ ID NO: 20140 - DNA, 420 bp, Homo sapiens
  misc_feature 96, 184, 282: n = A,T,C or G
caagcatagtaatcttagttcaactttaaatttgcccacagcaaccctctaaatccccttgtgaatttaactgtgagtccaaaggaggaacagctntttggacactaggaaaaaaccttgtagagagagtaaaaaatttaacacccatagtaggcctaaaagcagccaccaattaagaaagcgntcaagctcaacacccactacctaaaaaatcccaaacatataactgaactcctcacacccaattggaccaatctatcaccctatagaagaactaatgtnagtataagtaacatgaaaacattctcctccgcataagcctgcgtcagattaaaacactgaactgacaattaacagcccaatatctacaatcaaccaacaagtcattattaccctcactgccaacccaacacaggcatg

SEQ ID NO: 20141 - DNA, 127 bp, Homo sapiens
  misc_feature 22: n = A,T,C or G
tttttctctgttttgtccaaanagcaaatcatggcatcttaggagaaaagggggcaaggtaagtaaatcaaaggacaaagctgaaggccaagtggaccggaaaaaaaaaaaaaaaaaaaaaaaaaaa

SEQ ID NO: 20142 - DNA, 420 bp, Homo sapiens
  misc_feature 28, 357: n = A,T,C or G
gatcgccgttctggtaaaaagctggagnaggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggntaatgataacaatgcatcgtaaaaccttcagaaggaaaggagaatgttttgtggaccactttg

SEQ ID NO: 20143 - DNA, 450 bp, Homo sapiens
  misc_feature 57, 59, 119, 122, 146, 412: n = A,T,C or G
atttcttgcttttcactgcctatgaacattttctcaataggggttttaccaataggngnctccttcactctctggggattcctatatggctaacatgtagataaacttcactaaattcnggngttaactacacatcctctgttgcngtattacctaaaaacagacgttatttcaaattaaggccttaacatctatacaaatcatcaactcacataccctttcaaaacaaccattgcatttctagaacatcatccaaagattgtacacgtattcacaatggaagtttttgcaaagatattcattactactttgtcaagacctgggaatttggaaacaacctaagtctttattagtaggaaaccggatttttttggtctatgccccataagggataatattgagaccttaaaangattagacagttctctaaatatataataacatcaaaat

SEQ ID NO: 20144 - DNA, 160 bp, Homo sapiens
  misc_feature 11, 68: n = A,T,C or G
gcccggcgaanccacagaaaaccgcccctgctacagaagcaggagttgccgcagccccaggctgaganagggtctggaacagaatctgacagtgatgaatcagtaccagagcttgaagaacaggattccaccccaggcaaccacacaacaagcctagctg

SEQ ID NO: 20145 - DNA, 330 bp, Homo sapiens
  misc_feature 22, 80, 177: n = A,T,C or G
ttctggagatggatgaaggggncatttgtacaacattctgaatgtacttagtaccactgaactgcacacttaaaaatggntataatcgtaaattttctactatgttttgaccacattaaaatgattttgaatacagtatcttctaatcttgcctggggtggttcatataatacaatngattttctatctcttcttcttaattattgctaacatcatttaagctgcttttgtacaaaagtgattattgaccatatcttctcttttcacagtaccttttcatttctcatgagttctatttgattatattccagactctttaaataaattatt

SEQ ID NO: 20146 - DNA, 400 bp, Homo sapiens
  misc_feature 18, 32, 271: n = A,T,C or G
gtcaattttcagccgagnaatggtcagaaagnatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggngtatgtcaaagaataaattagtaaaattagtaaatgaaaaagactcttccgtacatcattatttccatgctaatgtgtgtctgtgatccagaataacttctcccactcatatcttcagttcacctaatg

SEQ ID NO: 20147 - DNA, 400 bp, Homo sapiens
  misc_feature 57, 113, 193, 277, 299, 354, 359: n = A,T,C or G
gcgtgggatctcgaagcgtttctatagacctggtgcggtcatgctttttgcagcagntgttttacaggtttgcagcctggtcctttacccaatcaagttcattgaaactgtgngcttgaaaatttaccatgagttcaactggggttatggcctggcctggggtgcaactatattttccggttggggggtgccnatcctttattgcctgaaccctaagaactatgaagactactactagaaccaatagttctcaaagtaaaaacaaccacccaccatncaacaaaagggattacgtctgnctctttttctaacttactattttttctaaaacactttgtggagcatcaagcagtntgctncagttgatttaatcttttttggcctttttggctgtcaccat

SEQ ID NO: 20148 - DNA, 240 bp, Homo sapiens
  misc_feature 100, 172, 183, 208, 235: n = A,T,C or G
gctatatataaggaacactccctgaaataaagagcattcagaaaaagttgcagataaaaatgataaaacattacactagaaaaaaggcaaaggaaaaagnaaagcagaggtagtgatgttgtcctaacacaaaggcattgaggattgggttgttaaatcagagttccacganccaggacaatntactatatatccaaaccttattagnaatttccaagtgacacagctgtaggangccag

SEQ ID NO: 20149 - DNA, 190 bp, Homo sapiens
  misc_feature 137, 145, 166: n = A,T,C or G
aatattttatggttatgtttttctcgtgtgtcagttttcatagtatccatattttattactgtttattaccttccatgaattttaaaatctgagggaaatgttttgtaaacatttatttttttttaaaggaaaaagntgaaaggnaggcctgtttttcatccacangaaccacaccacatattccacgaa

SEQ ID NO: 20150 - DNA, 330 bp, Homo sapiens
  misc_feature 25, 140, 180, 229, 281: n = A,T,C or G
caaaccttcagaatgaatatagccntggctgatatcttgactgcaacctcataagagtgcctgagccaggaaccatccagctaagctgctgctgaattcctgacatagagaaaccgggagataataaatgttgttttaangccacgaaattttgtggtaatttgttatgcagcagcttgngttgcaaaaattgttattccagagatctaatacagctcctggcaccccnaacccttggaaaagcaaatctgcctctactttgtgaaacagtgtcatccgtngacaactttcagagggaaagaagtcccagaccaaccagtgccttcgggt

SEQ ID NO: 20151 - DNA, 147 bp, Homo sapiens
  misc_feature 10: n = A,T,C or G
aaatggaggnaggggcaatgaaaaagtcataaaacaggcaggtagaggtttctggaaaaataaggtggtgagggaagagtctaactgtaaaagtaaaaaggtagaagatagaaccgttgatatctaaaaaaaaaaaaaaaaaaaaaa

SEQ ID NO: 20152 - DNA, 330 bp, Homo sapiens
  misc_feature 176, 177, 178, 230, 274, 314: n = A,T,C or G
aaaacatccctcaaaagtgctctcaccctgcacctgtaaatagttcttatcagcctttttatcttaacatctttgactaagttcagtatttggaagatggcctggtggtttacatacctcaagacctctcaacaatccagacactgagatgctactcggagtgggattgttcttcnnntaaggatcagatatgacagatattcctatagtagtctagcatgttcgggtgnagataactttgcaagttggcttcacatagtatttggcatttggngtgggctaaaagcaaattctcaggcataaataaaggcagngagaaagttttctcac

SEQ ID NO: 20153 - DNA, 230 bp, Homo sapiens
  misc_feature 6, 16, 27, 43, 49, 80, 143, 186, 188, 194, 196, 212: n = A,T,C or G
ctaggntgttccaganttaatcactgnggagttaacttgaatntttggnctctaaaatgttttagatttttaaaacgaanaatgcttccattattttcccaaactggacaccttgggtcctgggattagtttttagagaaaangtttttccaaattcttcttgggattacttgaagcccattggantntgaaanantttaaggcttaagttntttttcctttaaaagcta

SEQ ID NO: 20154 - DNA, 290 bp, Homo sapiens
  misc_feature 30, 42, 72, 95, 192, 257: n = A,T,C or G
tggtcagcaaaatacccatgctgatgaaangacctatgcccnaagaacaaatacttaacgtggggagtgganccacatgagcctggtcagctctncataagtaattcaagaaaatggggaggcttcaccttaaaaacagtgtgcaaatggcagctagaggttttgataggaagtatgtttgtttcttagtgnttacaaatattaagtactcttgatacaaaatatacttttaaacttcataacctttttataaaagntgttgcagcaaaataatagccctcgggttctat

SEQ ID NO: 20155 - DNA, 180 bp, Homo sapiens
  misc_feature 8, 24, 78, 109: n = A,T,C or G
actgtatntcattatctggactgnagacaaatgctttgtgactattaaatgttgcacatcattcattcactgtatagnaatcatctgactaaagccatttgtctgcgtnttcttcttgaggatgtatctatcaggtaaaaatatttttccaaagagccttgcgtcatgtaaatactgacc

SEQ ID NO: 20156 - DNA, 198 bp, Homo sapiens
  misc_feature 26, 37, 54, 66, 79, 87, 108, 156, 175, 180: n = A,T,C or G
taacataaggtccttagtacgcacgngtctatggagnagcttcaggcagaaccnagcctttttagnatctgagcaaacnttctgggnatgttttttcggaggaaaagnccataaattacaaattttcaaaaatcagattttcaaaagggattattngatttctgaaaactagcanagganctgctttttataaagagc

SEQ ID NO: 20157 - DNA, 128 bp, Homo sapiens
  misc_feature 104: n = A,T,C or G
gaagagcagattagcagaattcaaagaaagctttttcactattaggacacaaagggtgatggaactataacaacaaaggaagtggggaacatgtaaatgagatntcttgggcagaaatcccacagaag

SEQ ID NO: 20158 - DNA, 277 bp, Homo sapiens
  misc_feature 22, 24, 54, 181, 247: n = A,T,C or G
aggactcagctaaacaataagntnttaggagccacattggtttcattatcatanttgaatttccaagaacaacttgatatcattcagctgtccaaaaaataataagagcattcattaaatactagattttcttaaacttaaatgttgtatttcatatttatttatataatacaaatgggantcaaaactgaaatagcctccctttagaatgtcacattttttcttagaaaacattttgggaattggnttaaccttattgggaatggataaattttag

SEQ ID NO: 20159 - DNA, 210 bp, Homo sapiens
  misc_feature 30, 42, 66, 194: n = A,T,C or G
tgattttttgttaaataggcaaatgtggcnattcctcacagnattaaccagtattttttaaatgtnttcattcctacaaattaactttcataaattttatggcatgtcttctatttaaaaggaaaagaataagtattcttgcatctggccttagaaatgtgaagttatattctcaagtttatttttttccaagnggagctaaaatatgtt

SEQ ID NO: 20160 - DNA, 600 bp, Homo sapiens
  misc_feature 3, 5, 18, 37, 46, 47, 48, 97, 100, 109, 112, 275, 327, 353,378, 391, 393, 538, 554, 572, 573, 584, 591: n = A,T,C or G
gantntttggggtaacanaggcccaatttttgcattnatggtccgnnnccctcctgtagctgacagcattcggtttgaggagtctcgctcccgtggnctnagctgtgcncancgctactctctctttctggcctggaggctatccagcgtactccaaagaattcaggtttactcacgtcatccagcagagaatgggaaagtcaaatttcctgaattgctatgtgtcctgggtttcatccatccgacattgaagttgacttactgaaggaatggangagagaattgaaaaagtggagcattcagacttgcctttcagcaaggactggncctttctatctcttgtactacactgnaatcacccccactgaaaaaaagagnggatgcctgccgngngaaccatgtgactttgtcccagcccaagataggttaagtgggatcgagacatgtaagcagcatcatgggaggttttgaaggatgccgcatttggattgggatgaattccaaattctgcttgcttgctttttaaatattgataatnccttatacaccttacnctttatgcacaaaaatgnnagggttataanaaatggnaaacatggg

SEQ ID NO: 20161 - DNA, 340 bp, Homo sapiens
  misc_feature 22, 26, 176, 178, 189, 242, 244, 280, 283, 294: n = A,T,C or G
cacttgtaggactgcagttctnaatnttgggttaaaggttttggctgcttgtaagaatgtgaatttgaatgtattttgaattgtaagagcaaaagaacgtttttgtacaattttttttcatttaattggaatgatcttcaggtttctacaaatagggtaattgtaaatttaaagcntnagcatttattnggggaataatgtatatatcccccattccaaggaaatataagtgaagtggaagntngaaataaaaatctttaaaatttactatattgccagnggnttcacaacagntctcttgtatttatttattcaatttaaatcaaataaaaaatggatt

SEQ ID NO: 20162 - DNA, 420 bp, Homo sapiens
  misc_feature 84, 242, 283, 338, 377, 405: n = A,T,C or G
gaagctgctcttgctctgcgggtttttggttctttagtactcctgaggtagaaaccactgctgttcaagagttccagaaccagnatgaatcaacttaagaataagtaccaaggtcaagatgagaagctgtggaaaaggagccaaacattcctggaaaaacatcttaatagctcccatcctcggtctcagcctgctattcttactgctcactgctgcccgagatgctgaagaagcacttaggngtctgagtgaacaaattgctgatgcctattcttcttttcgnagtgtccgtgccatcccggattggatgggacagataaaagctactcaaggacagngatactgtcaaactagaggtagaccaaagaactggagcnatggatttaagaatggccagaatgcagnctgtggtacaccgct

SEQ ID NO: 20163 - DNA, 390 bp, Homo sapiens
  misc_feature 25, 28, 93, 348, 374: n = A,T,C or G
acaggaaccctctaaatccccttgngantttaactgttagtccaaagaagggacagctctttggacactaggaaaaaaccttgtagagagggnaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctctgcataagcctgcgtcaagattaaaacactgaactgacaattaacagcccaatatctacaatcaaccaacaagncattattaccccccactgtcaacccnacacaggcatgctcat

SEQ ID NO: 20164 - DNA, 520 bp, Homo sapiens
  misc_feature 24: n = A,T,C or G
gggttcaaaaccgtggaacctctngagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccaattcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctaagcggctttaaaaaatgtacagttgcctgaagtactataaatgaagaactgctttagc

SEQ ID NO: 20165 - DNA, 220 bp, Homo sapiens
  misc_feature 28, 53: n = A,T,C or G
cttctttaatgcatctcagtactggcgnttgaccaatgtatataaaaggagcngggtaccccattccaattttgaaagggatttggaggtctaactggacaaatagtggcagcgctttcaacagctaaatataagaactggcctgaatctgtgtattttttcaagagagggggcagcattcagcaggatatttataaacaggaacctgtacagaagtgcc

SEQ ID NO: 20166 - DNA, 15 bp, Homo sapiens
  misc_feature 6, 8, 13, 14, 15: n = A,T,C or G
tccctntntggtnnn

SEQ ID NO: 20167 - DNA, 360 bp, Homo sapiens
  misc_feature 4, 24, 30, 46, 58, 216, 254, 275, 293: n = A,T,C or G
tagntgaataatcaggggacaccngaccgncttggatgatgcactnaagcatggtggntttctgagttcctgttggccaccaagtgtcagcctcagcactcccgggactattgccaagaaggggcaagggatgagtcaagaaggtgagacccttcccggtgggcacgtggcccaggctggggggagatgttggatgtttggtactgtccatgtctngggtgggggcctatttacctcagcatttctcacaaagngtaccatgtagcatgttttgngtatataaaagggagggnttttttaaaaatatattcccagattatccttgtaatgacacgaatctgcaataaaagccatcagtgc

SEQ ID NO: 20168 - DNA, 380 bp, Homo sapiens
  misc_feature 203, 370: n = A,T,C or G
gctgcttccagctccaaagcacctaaggatggaggtaaagcgaagggattcagcaaagacaacagaggaaacttccaagccaaaagtatgactaaagaaatacaagttaaggtatctggtatctgcatgtaaaatcttcagctggtggatggtgacttttgaagaacaaaaggctttgggaacagaaaacaattgttctgggngatttctagaatggtttttgttgagtctctgaacatcctaaatattggtttgttattcttttccagaaagaaaatgaatttgactggttcacctgtgtactgagtattgataaactttgaatttttttaattgccttcaattggggagagaaagctttatattttgnaagaaatata

SEQ ID NO: 20169 - DNA, 160 bp, Homo sapiens
  misc_feature 6, 29: n = A,T,C or G
ataagnaaataagccacgcctggcatggnggctcacacctgtaatcccagcactttgggaggccaaggcaggcagatcacttgagcccaggagtttgagaccagtctgggtgacatagtgaaacactgtctctacaaaaaaaaaaaaaaaaaaaaaaaaa

SEQ ID NO: 20170 - DNA, 150 bp, Homo sapiens
  misc_feature 20, 28: n = A,T,C or G
atggcaaggaggtataaagntcatcgtntatatagtataatatcctcaaaataactggttaataatgttgtaagttttatttccttaagatagtcattacttattccagaaatatttgcataatggcaaaaatagtgtatatgttaaaat

SEQ ID NO: 20171 - DNA, 181 bp, Homo sapiens
  misc_feature 28, 29, 70, 163: n = A,T,C or G
aaaagggccaagcatcaagcacgccccnntgcagctcaaaacgcttagccctagccacacccccacgggnaaacagcagtggattaacctttagcaataaacgaaagtttaactaagctatactaaccccagggtcgggtcaatttcgtgccagccacccgcngggcacacggattaaccc

SEQ ID NO: 20172 - DNA, 270 bp, Homo sapiens
  misc_feature 65, 106, 150, 194: n = A,T,C or G
tcaacagctaaatataaggaactggcctgaatctgtgtattttttcaagaagtaggtggcagccnttcagcagtatatttataaacaggaaacctgtgcagtaagngccctggcagcaaggcctgctctaaattatccagggtatggggnagacgacacaggttaggagacgtggctttgaacgtgctataggnaccttctcaaacacacaccatcaggaattcaatattcacctgccagactggcttatcaagacaaaggcgcccttca

SEQ ID NO: 20173 - DNA, 228 bp, Homo sapiens
  misc_feature 38, 52, 74, 119, 159, 180, 195: n = A,T,C or G
actacactgaattcacccccactgcaaaaagtatgagnatgcctgcccgggngaaccatgttgactttgacacngccccaagcatagttaagtcgggatctgagacatgtaagcagcancatggaggtttgaagatgccgcaatttggattggatgaantccaaattctgcttgcttgcnttttagtattgatangcttatacacttacactttatgcacaaaatgta

SEQ ID NO: 20174 - DNA, 387 bp, Homo sapiens
  misc_feature 5, 9, 13, 17, 18, 27, 31, 53, 74, 95, 96, 97, 101, 135, 253,382, 383, 384, 386, 387: n = A,T,C or G
ggttnttgngggnccanncccaatttnttgntgtggtcgggaaaaccccaaantaattatggttgaaatgtttntggttccttggaaatgctgcnnncctntgtgtttttccatcattagtgcagttggaatgantgtgtataggtcagaggtcttcggtgttcacatttttaaaattaggtaaatgacctcatctttcaagcttgaattcatttttaattttaatttttattttatacaatgtgtagacagnggccctgttctctgcatttagaagtatacacaatataaatctgttaattctgtaagtaatttttataatttatgatgtaactctattcttatccttaaaacatttaaaataaacccttttatgtgcccnnnann

SEQ ID NO: 20175 - DNA, 440 bp, Homo sapiens
  misc_feature 20, 306: n = A,T,C or G
aaacacaatttagctttgcnaacagcagggtaaaggcaaaccataacttataaatttgtaatgtgttcctccttgttggagacattagccagtgtttagttttagaccaacttatacaaacagagtattgatttgtacacattctggagacttgctatatcatggtttgctatggcacagactcagcttagcatggggacattttgaacttcattcaaagttgagtagttactgggaacctttgacattgccttgtaatgaggtacttccaaaaaaagacccctaacaatggcataatagtgaggnctctctgtgcatattacataatatatatgcaggataaatgtgtgcaccaatcaaatctaaaaattttatgtgactgtcaaaatgaatattattttggggtaaagatttttcattttctgatttgggtagaaaat

SEQ ID NO: 20176 - DNA, 189 bp, Homo sapiens
  misc_feature 80, 95: n = A,T,C or G
tgagcatatagtactttggtagccagaaaaaatccaatttttataagcctgctagcacatataatgtacctgaaattggntattcatagcatggnatttttaaacatgagtgattaatttcaaagattgagcatcttttgatttatgagagaaaaaagttgtggggcaaaaaaaaaaaaaaaaaaaaaa

SEQ ID NO: 20177 - DNA, 410 bp, Homo sapiens
  misc_feature 14, 22, 28, 183, 325: n = A,T,C or G
ggaatacacttagnattggatngggaangcaactcgtaatggagtttgagtaaagaaaatgactgatgtactaaacccagtaaaaattggtgaaaatgttaaaggtcagcatgttctaattgggaatctagatatagcttagatttcctattggcttagagtatttgctataacaaatgaagngcaatgacaattatatattcctactcggtcatactggactggcttcgttctcttaatatactcagtaatgactcaagcctctggctattaacataccctagttgccgttttttaatttgccatgagccaaatacttcttggnatacaattgatccatttatttttaatggctgccttttcattttcatcttttcttgctgctacccatctatgtattgtagtctttg

SEQ ID NO: 20178 - DNA, 460 bp, Homo sapiens
  misc_feature 25, 211: n = A,T,C or G
gaaaatgtgggaaagatataaagcntataattgtataaatttggtctggggctatgattaattagagacaagttttgatataaaaaatgggttctctcaggtcaagaagttacctatattcgtatcacttggtgaccacctacacttcatggccagaaaggcttagtgccatttgggcttgggaagacctgagactggtgctcaaaccagnagtctcagcagggcacagtggctcacacctgtaatctcaacactttgggaggctgaggcaggaggattgcatgagaccaggagttcaagactagtcttggcaacatagtggagacccccaaacctagcaaaaaaaagactgctgggcattggtggtgggcaactgcagtcccagctactggggaggctgaggcaaggaggatcacttgagcccagtaaatgaggttggagtgagctgtgattatgccac

SEQ ID NO: 20179 - DNA, 330 bp, Homo sapiens
  misc_feature 41, 67, 183: n = A,T,C or G
caaattattaaatggtaaagggccctactgattcccttcgnggaataaggtgataagcctccaaagnatggcatgtgaaagaattagttgttaccgtggtaaagagttgggtagaagatttcatgtcccatacccccataatcttaggaagtagaagagtccctttctttacagagacttctnagcagtcactactgaagtacataacaactggtgtcagggtccttgtgtcagtggccattgccttttcccctttcctttccaacctgaactcagttacccaattcttttctcaatcccctatagcacagcttaagaaaactattaatg

SEQ ID NO: 20180 - DNA, 277 bp, Homo sapiens
  misc_feature 186: n = A,T,C or G
aaaatatatatttttaatggaaagtttgtagcatttttctaataggtactgccatatttttctgtgtggagtatttttataattttatctgtataagctggaatatcattttatagaaaatgcattatttagtcaattgtttaatgttgggaaaacatatgaaatataaattatctgaatattagnatactctgagaaattgaatgtaccttatttaaaagattttatgggtttataactatttaaatgacattatttaaaggtttccaaattattt

SEQ ID NO: 20181 - DNA, 600 bp, Homo sapiens
  misc_feature 2, 11, 16, 22, 28, 29, 36, 86, 89, 92, 243, 244, 245, 248,265, 319, 324, 462, 466, 480, 492, 522, 533, 562, 599: n = A,T,C or G
anttttgggtnccagncccatnttttcnntatggcnggaaaccatgttggggggaaattaactcatttaaaagaatcttattaggnatntgnactctaaaactaacaggataagacagatatgtaccttattagagcaccagaactaatttgctaagtcttttgtttagtcctgcaagactgatgcttaatacacagtctgttctcctgtgtctaggtcaggaactccagtttgcttttctgnnnggngtcctggtagcagctgntgagtaactttcattggaggttgggaaggaagtgaggaggaaagtgtccttggnttagngttttatttcctataataggatgctgcctaacccagttcatctctatgtcctgttcactgaatattcccgggtaatttgaaagaaaatataatgggatggggctccattaaaaccagctcaaaaaataaaattcttgncagnaaaagatttcttgncaagatgtcttnggattgcactttttgttgaggaaagacagngtaaataggtnaagaatggtgataaaatggaacatttggntgggggaatgggggggggtttagaggggttctggttng

SEQ ID NO: 20182 - DNA, 390 bp, Homo sapiens
  misc_feature 131, 282: n = A,T,C or G
agcaggaaaatatgaagacttagaaagagtagcatgaggaaggaaaagataaaaggtttctaaaacatgacggaggttgagatgaagcttcttcatggagtaaaaaatgtatttaaaagaaaattgagagnaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccganggggattaaaaagaccttgaaatccatgacgcagggagaattgcgtcatttaaagcctagttaacgcatttactaaacgcagacgaaaatggaaagattaatttggga

SEQ ID NO: 20183 - DNA, 105 bp, Homo sapiens
  misc_feature 24, 38, 71, 72, 86: n = A,T,C or G
ttctgtcacatacatattttcgangcaaaacttggctnacgaaacatttttctctctgactgctgcttganngttcttggaggctntgtcttatgcctggggtgc

SEQ ID NO: 20184 - DNA, 213 bp, Homo sapiens
  misc_feature 19, 27, 126: n = A,T,C or G
aaatgggcacagtggggantccacagncttggattgtatttcaaatcaagaagtttcaaggccaggcacagtggctcatgccttgtaatcctagtactttgggaggccgaagctggtgggatcacnttgagttaaggagttcgaggaccagcctggccaacatggcaaaaacactatctgtactaaaaatgtgaaaaaaaaaaaaaaaaaaaa

SEQ ID NO: 20185 - DNA, 440 bp, Homo sapiens
  misc_feature 17, 254, 423: n = A,T,C or G
ggcaaggaaaagctggnaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggntatggcaaaatcaataagaagcgaattgctttgacagataacgctttgattgctcgatctcttggtaaataccggcatcatctgcatggaggatttgattcatgagatctatactgttgggaaaacgcttcaaagaaggcaaataacttcctggggcccttcaaattgncttctccacgaggtgga

SEQ ID NO: 20186 - DNA, 340 bp, Homo sapiens
  misc_feature 8, 17, 224, 229, 333: n = A,T,C or G
tttagagncattgaagnctttgttttgtgggttgctgccctccacccccaaccccctaagcttgagtcataaagcctgaaaaactaatgaggttgctgaaacttaaaatctgattggtaggatgtatggaaaacaatgagagatggcagaaaccgtacacttcgattcaagttggcttctctgttgcagcattgaaccttgctcactttgcatttttattgttncaggnccttggaattaattttttccttcaataggatcaaattagacctagattttaaaaaaactcataaatagataaaccatcaaggctaatattaggatccctaaagncttcatt

SEQ ID NO: 20187 - DNA, 392 bp, Homo sapiens
  misc_feature 7, 250, 287: n = A,T,C or G
gggcagngttttaatttaggatacggcacaacgtggaaaactgcttataacataatattaaggataaacctcagctgggcatagtggctcacgcctataatcccaacacttttgggaggccaaggcaggaggattgcttgagcccaggagtttgaggccagcatgggcaacatagtgagaccctgtctctataaaaaaaattttttaaagaaaaaaaacaggatttcaaattattgctaatatttgtagngattacaaatattagcttctttttataaagcctgggnggaagcatatagatgtatctttagctttatttattcatccatgacttaaagaagattgggtaacacctgactccaccttgagtagcagaacattggactgaaggg

SEQ ID NO: 20188 - DNA, 170 bp, Homo sapiens
  misc_feature 3, 73, 93, 150, 151: n = A,T,C or G
ganaagcaaaagccacaggctaggggggaatatttacagagacaatctgataatggaccaaactatacgaagnaactcttaaaactcaacagnaagaaaaaagaaaaaaacctgattaaaaaattggccaaaaattttaatagacacctnnccaaaaaaaaaaaaaaaaa

SEQ ID NO: 20189 - DNA, 176 bp, Homo sapiens
  misc_feature 5, 95: n = A,T,C or G
gattngataatcttattcacagttgttattgtttacaggaccatttaattaatatttcctctggttattcctcctctccctcccattgcatgggncacacctgtggaaaggaaaaaaggaatcaaattgaatatatcttttaagaattcccggggggaaaaaaaaaaaaaaaaaaa

SEQ ID NO: 20190 - DNA, 357 bp, Homo sapiens
  misc_feature 10, 39, 41, 99, 130, 141, 226, 264, 318: n = A,T,C or G
ttttctttgntgttggttttcagcagcttaatttgatgngnatctagtcattttctttaagtttatcctctttgaagatactgagcttctcaaatcggnaaatttttggctttcactaagtttagaatgntttctaccatnggggctttcttctgaccttacaaaattctagtggcaattatgataaaacttttgagattgtttcacaggcctctaactgttcagnctcctatcaattttttttctctgtttttcagatgaggnttatttttattggatacacgttccaggtcacaagactctttttctccccatctncctttttcttattgaggccaacccagggaactttttatg

SEQ ID NO: 20191 - DNA, 333 bp, Homo sapiens
  misc_feature 83, 151, 272: n = A,T,C or G
ttctactttgagggctggctccatgtttgatgtatctgagcaggttgctccacagggagctctaggagggctggcaaccttanagggggggagcagaggaattctcttatccaacatcaacatcttggtcagatttgaactcttcaatctnttgcactcaaagcttggtaagatagttaagcgcgcataagttaacttccaatttacatactctgcttagaatttggggggaaatttagaaatataattgacaggattattggaaatttgtnataatgaatgaaacattttgtcatataagaatcatatttacttcttatacatttgataaag

SEQ ID NO: 20192 - DNA, 520 bp, Homo sapiens
  misc_feature 19, 28, 65: n = A,T,C or G
acacaagtaattttgacantttccctgnggacaacgatgaaccaccacctgatgacaactcaggnataggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttaccgcttagatgacaatagtgctctttacatgttttctgtttgaacctaaaatagcagttgacatggtggtcctgaagcaaagcctttcaccagtaaagagatgttttctattgttgcaatgaccttgctttgctctgattataatttgaaagactgtaggaaacacttcaatgtagtataagagtctgtaccttgctggaatattcaagaagatgaaagaataacatattgggtacaatagattactatggtacagaaactgggctattccctttcttca

SEQ ID NO: 20193 - DNA, 350 bp, Homo sapiens
  misc_feature 19, 23, 29, 326: n = A,T,C or G
ctggccaccttccacaagnactngggcanagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagngggcacttttttttttccaccctg

SEQ ID NO: 20194 - DNA, 186 bp, Homo sapiens
  misc_feature 25, 35, 103, 154, 155: n = A,T,C or G
caaataaaagctagcatactggaancctaactgcnatgtggatgttttacccacatggacttattatgcataaagccaaatttccagtttaagtaattgcctncaataaaaaaggaaattttgcctgccattttcagaatcatcttttgaagcnntctgttgatgttaactgagctactagagata

SEQ ID NO: 20195 - DNA, 390 bp, Homo sapiens
  misc_feature 13, 26, 50, 113, 191, 194, 200, 213, 246, 302, 324, 340, 354: n = A,T,C or G
aacgttggtcgtngatgagtaggcanactggatccaagggccagccaacntaccatggctcccgtaagttttgccaaaacctcggatgccgtggccttctggccaggcgtctncgaaatcatatggctgtagcattcgtgctatccctgggggttgcaagcttttgtataagtttcgtgtgggctggatcnganggaagnaaggcatacgcangaatttctacagaaactatgatgtcatgaaagnattttgaggagatgaggaaggctgggatcttttcagagggaaaaggaatcttggantataaaggaatttcttcaggtngaattacctaaaaagnttggcactgacttngggttcctgacctatgacacatgaatatgggggcta

SEQ ID NO: 20196 - DNA, 440 bp, Homo sapiens
  misc_feature 9, 17, 271: n = A,T,C or G
ccttacagncgctcgtnagactccagcagccaagtatggtgaagcagatcgagagcaagactgcttttcaggaagccttggacgctgcaggtgataaacttgtagtagttgacttctcagccacgtggtgtgggccttgcaaaaatgatcaagcctttctttcattccctctctgaaaagtattccaacgtgatattccttgaagtagatgtggatgactgtcaggatgttgcttcagagtgtgaagtcaaatgcatgccaacattccagntttttaagaagggacaaaaaggtgggtgaattttctggagccaataaggaaaagcttgaagccaccattaatgaattagtctaatcatgttttctgaaaatataaccagccattggctatttaaaacttgtaatttttttaatttacaaaaatataaaatatggaagac

SEQ ID NO: 20197 - DNA, 460 bp, Homo sapiens
  misc_feature 372, 395: n = A,T,C or G
catagcataagtttaaaccttgtaccttttgcataatgaactaactaggaaaacttctaactaaaagaattacagctagaaaccccgaaaccaaacgagctacctaaaaacaattttatgaatcaactcgtctatgtggcaaaatagtgagaagatttttaggtaggaggtgaaaagccctaacgagcttggtgatagctggttacccaaaaaatgaatttaagttcaattttaaacttgctaaaaaaacaacaaaatcaaaaagtaagtttagattatagccaaaagagggacagctcttctgggaacggaaaaaacctttaataggtgaatatttaacaaaacagcttttaaccattgtaggcctaaaangcagccaccaataaagaaagcgntcaagctcaacataaaaatttcaattaatttccataatttacaccaacttcctaaacttaaaatt

SEQ ID NO: 20198 - DNA, 480 bp, Homo sapiens
  misc_feature 29, 112, 312, 343, 391, 460: n = A,T,C or G
aaaagcagcatctggccttggttgagccnggggacacagaagagaagcccactatctcatttaatctttacaactctcttgcaaggttccctggttgtgaaaatacatgagnataaatcatgaaggccactatcatcctccttctgcttgacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggnccagtgttctgattttgggtctggacaaagngccaaaggatcttccccctgacacaactctgctagacctgcaaaacancaaaataacccgaaatcaaagatggagactttaagaacctgaaggaaccttcacgcattggattcttgncaacaaataaaattagcaag

SEQ ID NO: 20199 - DNA, 180 bp, Homo sapiens
ttgaaagttagagtttaatacacctacttaaaaaatatagccaataggttactaagatattgcttagcgttaagtttttaacgtaattttaatagcttaagattttaagagaaattatgaggccttagaacaccagcttgaggaaggaaaagataaaaggtttctaaaacatgacggggg

SEQ ID NO: 20200 - DNA, 379 bp, Homo sapiens
  misc_feature 70, 146, 206, 269, 285, 330: n = A,T,C or G
tctgccgaagatatgaatacatttctactttattttgaaacatttgccaaactaaatactgtaacactgnataacatttaaaaatgttaaagaactgcttagtattagaagcagatcatttcccaaaattctaagagcagcagcgnatgttgttgcttgtataaagcctagcgataatttttagactaacttccatggtgccccgntgcatttagcactaccattgtaccctgctggataataaacaatcttagacatttatcaactgntgatacaaatgttagnccctaaccactttttatatatgttttaaatttttgaaattcaagngacctgccataacataaaataaacactagactgtgaaaaaaaaaaaaaa

SEQ ID NO: 20201 - DNA, 440 bp, Homo sapiens
  misc_feature 18, 75, 376: n = A,T,C or G
aacatcccggcgaagatnctttcttataaccgtgccaatcgagctgttgcaattctttgtaaccatcagagggcnccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagnggggtgtcccaattgagaagatttacaacaaaacccagcgggagaagtttgcctgggccattga

SEQ ID NO: 20202 - DNA, 117 bp, Homo sapiens
  misc_feature 9, 43: n = A,T,C or G
gcagaattnaagtaatttgtttaggacatcctgttacattatnaaatctgaatttcaattaatggcagggttgttctatttgccatacctgttcccgcggaaaaaaaaaaaaaaaaa

SEQ ID NO: 20203 - DNA, 120 bp, Homo sapiens
  misc_feature 30, 52, 78, 85, 86, 95: n = A,T,C or G
aaacgtaaaaaccctcataccttcctaggnggaatgcaaattagtgcagacnctagcaaaaaacacttttatgggggnataaaanngtttacttncaatgaccttccaaccatgcaatcc

SEQ ID NO: 20204 - DNA, 206 bp, Homo sapiens
  misc_feature 22, 97, 105, 120, 141, 170: n = A,T,C or G
cgcgaccaggcaagggctaagnattgtcaggcttggtcagtagccttgtagttggcaaggaaggccagtaatggggatggggaacccatttgagggnaaaggganaaatgggtataaatnctatgaaagttcaaaagggtnaggcagcaggtaaggcagtcattgagggnttataatggcccccaaaaaaaaaaaaaaaaaaaaaa

SEQ ID NO: 20205 - DNA, 420 bp, Homo sapiens
  misc_feature 24, 42, 46, 234, 336, 361, 373, 390: n = A,T,C or G
ctctcctttccagtcggagacttntgctgcaaacatgctccncagnatcatcggtcaggccaagaagcatccgagcttgatccccctctttgtatttattggaactggagctactggagcaacactgtatctcttgcgtctggcgttgttcaatccagacgtttgttgggacagaaataacccagagccctggaacaaactgggtcccaatgatcaatacaagttctactcagngaatgtggattacagcaagctgaagaaggaacgccagatttctaaatgaaatgtttcactataacgctgctttagaatgaaggcttccagaagccacatccncacaattttccacttaaccaggaanatttctcctctnaatgcatgaaatcatgntgggagatctctattgaatctctattggag

SEQ ID NO: 20206 - DNA, 480 bp, Homo sapiens
  misc_feature 70, 399: n = A,T,C or G
atactatttgagcacaggacacattcttaaacattttgaaaaacattaacccaagatgtagaggctactngctagtcgtcattctagaatctgatattttactctgtatttgaaatgaatgattaatgtcctaggaaattagctttagcagatgtccaggtgccacatcaaaaaagtgcaataattattgacagttttttagattaggcatattattggaaaacaactttataaagagtgaacattgtatactctagtaaaacagcatcactttaaaaatattcatttatgaaatctgttacctatagttgaagtcttgagtagtgaacaagggactctaataccaatactcttaatatctggctattttagatcccttaaagggcataaattattggnaatttaggtattttcactaaagcatggatataatattggccaccaagaaaagtaaatttgaagattaagggacttaccttc

SEQ ID NO: 20207 - DNA, 330 bp, Homo sapiens
  misc_feature 6, 18, 152, 200: n = A,T,C or G
tgcacntcccacaccggngcaacagtttgccagctaaattcaaaaaactcctggggccaggaaaaaattcagcacattctctgcacaggaaacctttgcaccaaagagagttatgactatctcaagactctggctggggatgttcatattgngagaggagacttcgatgagaatctgaattatccagaacagaaagttgngactgttggacagttcaaaattggtctgatccatggacatcaagttattccatggggagatatggccagcttagccctgttgcagaggcaatttgatgtggacattcttatctcgggacacacacacaaa

SEQ ID NO: 20208 - DNA, 470 bp, Homo sapiens
  misc_feature 18, 24, 45, 243, 346, 390, 447, 452: n = A,T,C or G
ataagaaactggcctgantctgtntatttttttcaagtagtaggnggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggngtccttcataatgaagttaaagtgagtatactgtggagaggacttccaaatgtgggtacctcagctatatcactgcccaacatcagaaaacctgacggctatnattactatgccttttctaaagatcaatactataacattggatgngcctagtagaacagcaagagcaattactactcggtctgggcagaccttatccaaagnctggnacaactgtccttagactg

SEQ ID NO: 20209 - DNA, 410 bp, Homo sapiens
  misc_feature 119: n = A,T,C or G
ttgatccattttctaagaaagattgggatgatgtgaaagcacctgctatgttcaatataagaaatattggaaagacgctcgtcaccaggacccaaggaaccaaaattgcatctgatggnctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatgggtacttgcttcgtctgttctgtggtgggtttactaaaaaacgcaacaatcagatacggaagacctcttatgctcagcac

SEQ ID NO: 20210 - DNA, 420 bp, Homo sapiens
  misc_feature 145, 396: n = A,T,C or G
gatgggagatcaccttttgcttccatttaacgttacaacggaagtaaaatctgtcgaaatgcaccatgaagctttgagtgaagctcttcctggggacaatgtgggcttcaatgtcaagaatgtgtctgtcaaggatgttcgtcgnggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagttttgctgagctgaaggaaaagattgatcgccgttctggtaaaaagctgggaagatggcccctaaattcttgaagtctggggatgctgccattgttgatatggntcctggcaagcccatgtgtggtga

SEQ ID NO: 20211 - DNA, 110 bp, Homo sapiens
  misc_feature 15, 44, 53, 67: n = A,T,C or G
cattttcagttcggnacattgaacgaggccaagcggagggtgcncggagcttntaccgcgccttggnatcggggaggggccggaacactgtgcaccaattccagctggtc

SEQ ID NO: 20212 - DNA, 270 bp, Homo sapiens
  misc_feature 16, 26, 64, 80, 249: n = A,T,C or G
tgccggctggcccganccagcgagcncaccctctaaatcaccacgatcaaaagggacaagcatnaagcacgcagcaatgnagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagngttttagatcaccccctcccc

SEQ ID NO: 20213 - DNA, 129 bp, Homo sapiens
atacgtattttaatttctgagtgtaaccactaaacacaatgattaatttatgtttttaaatcttaactagtttataataaatagaagacaagatagtagaggacaatagagtatgggaggaacaaatag

SEQ ID NO: 20214 - DNA, 340 bp, Homo sapiens
  misc_feature 39, 225, 334: n = A,T,C or G
gcataccagaatgctttggtgagcaaattactcttgagnaaatgcattgtttatatagatattacaatgtcatgctgttctcaacccaatcaactatataaactggagtagaaattcctgaacttttttttaactcccggggaagcagtttactattagcaattagtataatgattactatcaaatcttgccaaagagagatcaagaaaaacatgggtgcaaagnaaacatgactcctttgattttattaatgggatgataggattgaaaataagccagaaggtgcagaaagctgagattatagtaaagcaggcaaatatggcacttgccatgnttatct

SEQ ID NO: 20215 - DNA, 360 bp, Homo sapiens
  misc_feature 148, 186: n = A,T,C or G
ctaaaaggcaacaaatgcactccagtgttatatttgaattatgggccctacagttcttatgcaccgattatgactccgcatttgcaaatatcagcaaggatgattctgatttaatctattcaacctatggggaagactctgatcttcnaagtgatttcagcatccatgagtttttggccacgtgcnaagattatccgtatgtcatggcagatagtttactggatgttttaacaaaaggagggcattccaggaccctacaagagatggagatgtcattgcctgaagatgaaggccatactaggacacttgacacagcaaaagaaatggagcagattacagaagtagagccaccagggcgtt

SEQ ID NO: 20216 - DNA, 460 bp, Homo sapiens
  misc_feature 120, 301: n = A,T,C or G
tcagcctcttcaacatttatatacaggttaataagcctcttgcaagttaccttgttctctcacctgaggtatttttttcctccccaccttgcccctgttcctcccttcctcttctccctntgcaagaggaaatatttaacatatttgggtccaacttcaataatgtaataattaatacattaaaaagcatttaacttcctttctagaaaaatgcacaggctaaggcatagacaaaacaaagagaaatgctgagaaatttgccactggagacaagcaatctgaataaatatttgccaaaagntctttttatgtcatatagtgtcaggatttgaaggagctatttttttttaatggggcaactagcacctcatcttcggaggcacagccaggagaatgaaggagaagtgaaaggttataaatccatttgtaagctttatcacatatattttaaattcaagaa

SEQ ID NO: 20217 - DNA, 280 bp, Homo sapiens
  misc_feature 53, 153, 240: n = A,T,C or G
gtgcctctgcatggcctcaagggtcgtgtgtttgaagtgagttttgctgattngcagaatgatgaagttgcatttagaaaattcaagctgattactgaagatgttcagggtaaaaactgcctgactaacttccatggcatggatcttacccgngacaaaatgtgttccatggtcaaaaaatggcagacaatgattgaagctcacgttgatgtcaagactaccgatgggtacttgcttcgnctgttctgtgttgggtttactaaaaaacgcaccaatcaga

SEQ ID NO: 20218 - DNA, 160 bp, Homo sapiens
  misc_feature 17, 24: n = A,T,C or G
atgtctgtattactagngtaggcntttacagtcctctaatgttgattaatatgtgaaaagaaattgtaccaattttactaaattattcagtttaaaatggatgattttttgttatgtggatttcatttcaataaaaaaaaactcttatctaagaaaaaaa

SEQ ID NO: 20219 - DNA, 480 bp, Homo sapiens
  misc_feature 66, 67, 76, 177, 325, 333: n = A,T,C or G
aaagtaattcattttttaatactttactttgaaagaacaatgggtttaaaatgagaagccttcggnngggcgcagnggctcaacgcctgtaatcccagcactttgggaggccaaggtgggtagatagcttgagggcaggagttcgagaccagcatgggcaacatggggaaacctcgnctctactaaaaatacaaaacttagccaggcatggtggcacacacctgtaatcccagctactcgggagactgaggcaggagaatggtttgaacctgggtggcggaggttgcagggtgccaagatcgcatcactgcactccagcctgggngacagagngagactatgtctcaaaaaaaatatataaaatgaaagggttcgagttttattctcagctcccctttcttaataactgcatatatttatagccttctaagcctagaataaggacctcatgggaaattcatgtaaaatagagactagaaa

SEQ ID NO: 20220 - DNA, 400 bp, Homo sapiens
  misc_feature 25, 27, 224, 228, 274, 355: n = A,T,C or G
cgctgtgaggagcatgaagcatttntncagattccatgatgtcaggacatccacacaatgtttccaaaaccaactcagaaacggatgaaagggacacaggatgttagtcaaaaacaatttttttgtttttttgggtttcctattttttttccacttgaatcctttttcttttgtccattcttggaatccattcatttttttccagctgattctcttggggttgntcgngctgggacaagcctctccgtagcagaaaagttgtgaggggtgaggngggtctgttagggcggggcatcatgggaactcaaatatataagcaactccctctgacctctcgctttctgcatcccaaagncaaaggggctaaatatactgccatcaatggactggctgcaaaacc

SEQ ID NO: 20221 - DNA, 123 bp, Homo sapiens
  misc_feature 14: n = A,T,C or G
gcgtgcccatgggnaccacgggtgacggggaatcagggttcgattccggagagggagcctgagaaacggctaccacatccaaggaaggcagcaggcgcgccccaaaaaaaaaaaaaaaaaaaa

SEQ ID NO: 20222 - DNA, 360 bp, Homo sapiens
tcttatttatatagtaaacattatggctggaatagctgtgttaatatcagataacaaactgcaaaatacacaaatgattggcccaaagatacattttaaaaaaatcaaacaaatccaaacattggtaattaaataacatgctctaaaataattcatgactcaaagaagaaatcccagaagaaatcaaatattttgaaatgaatgataataaaaaaaatcaagacttttgagatgtatctaaatgaagacttgagagaaatgctatgacttcaatattttaaatacttagaaaatattaaatatttctataaccagagaaaaataaacactcaataagaaaaaaaaaaaaaaaaaaaaaaa

SEQ ID NO: 20223 - DNA, 350 bp, Homo sapiens
  misc_feature 14, 139, 330: n = A,T,C or G
gtacttttctgcanattaaaagtatatggagtcataaaatggcaagtgttttaggattagcctaaaattggacattgtcattgatttcaaagaaggtatgaactagcagtcttacagcctaattcttctttggactggnccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaagggggcagctcanggggagctcttctggtgctc

SEQ ID NO: 20224 - DNA, 350 bp, Homo sapiens
  misc_feature 281: n = A,T,C or G
ttcccttaacgagctttttcccatttccatgatttaaggcaatggtttttccagtatgtgacattttccttcctgtttttcaggtatatcaaagagtttacatattccaattcacatttttacatctgagacgggttttttaaggtcataattatgaaagaaatatgtatattggagcttggggaaataaaaatggccttttcttaaattattattattgggaatacaacctcttcattaaataacaatgtagcatgaaaaatttatgattgaaatgtagntttcattccatattaagatacagtttctgagaagaatcattgaatggactagaatatgtcaaaaattga

SEQ ID NO: 20225 - DNA, 350 bp, Homo sapiens
cccagcaagggacaccttttgaagatggtactttttaaactagtaatagaattttctgaagaatatccaaataaaccaccaactgttaggtttttatccaaaatgtttcatcccaaatgtgtatgctgatggtagcatatgtttagatatccttcagaatcgatggagtccaacatatgatggatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtc

SEQ ID NO: 20226 - DNA, 350 bp, Homo sapiens
  misc_feature 24: n = A,T,C or G
tagcctcctatgttttgcattccntgaagcttaaataagaattgaagcaaatccctaagatttatttttttccaccttatttatcttctaaaacttgaggaatgcatgtgttcttagtgattcacatccacgggacaaaaactcaaggaagaaataagagctgacgccacacaagtcttggctgcttttgttactatacattttctctgagactccagcagagttggggctggaacttggcactggggactcatgtttggaatcggagacataggcaacagctccaaagggtatttcattgtgtcacctgcttctagatcatagatataaatacttattcaggagttcac

SEQ ID NO: 20227 - DNA, 495 bp, Homo sapiens
  misc_feature 83, 195, 249, 267, 308, 381, 397, 398, 416, 449: n = A,T,C or G
agccgccctgttaccctagtttgttagtgcatttgagcacacattttaattttcctctaattaaaatgtgcagtattttcagngtcaaatatatttaactatttagagaatgatttccacctttatgttttaatatcctaggcatctgctgtaataatattttagaaaatgtttggaatttaagaaataacttgngttactaatttgtataacccatatctgtgcaatggaatataaatatcacaaagntgtttaactagactgcgngttgggttttcccgtataataaaaccaaagaataggttggntcttcaaaccttaagagatccacataaaagaagaactattttttaaaaattcacttctatatatacaatgagnaaaatcacagattttnnctttaaataaaaataagncattttaataactaaaccagattctttggggtnctattaagggacatttaagccataaaaaaaaaaaaaaaaaaaaaaa

SEQ ID NO: 20228 - DNA, 190 bp, Homo sapiens
  misc_feature 33, 54, 105: n = A,T,C or G
agccgttcgttttattccagcagccaagaaggngaagcagatcgagtagcaagnattgcttttcagggaagccttgggaggctgcaggtgataaacttgtagtangtttgacttctcagccacgtgggggtggggccttgcaaaaatgatcaagccctttcttttcattccctctctgaaaagtattcca

SEQ ID NO: 20229 - DNA, 101 bp, Homo sapiens
  misc_feature 12, 44, 46, 60, 64, 82: n = A,T,C or G
aactaattctgngagagttgagctcattttctagttggaagaangngatatttgttgggntggnaggttaacctaatgcccntacctaattagattatgga

SEQ ID NO: 20230 - DNA, 140 bp, Homo sapiens
  misc_feature 72, 102, 131: n = A,T,C or G
cgttctaggaggaggaggactccctcatcttctagtacacaggcggtcaaggaagcagatcgagacggcggncacattctaagtctaggagtcggccgacgntgccaaaagcccaaggcggggggaagatnttattccag

SEQ ID NO: 20231 - DNA, 240 bp, Homo sapiens
  misc_feature 57, 108, 128, 144, 188, 192, 213, 231: n = A,T,C or G
ctacaactttattcccttataaagttgtagccttcatgatgacataattcccaaagncagctagaattccgagaatcaaagaagtaaactgaaatctaattacagagnaacaaatgcaacaggccagntatatttccaggacgnttttggtttgcccagttccctaatttttcatacttctctttagnctgntcattttttttgcttaaaaantgaatgggaattttggangcgacattt

SEQ ID NO: 20232 - DNA, 160 bp, Homo sapiens
  misc_feature 13, 20, 44, 116, 133: n = A,T,C or G
atacatttgcagnaaagatncccttgagctaattcacatattgntaccttaccaatttattttttttatgatcaataaccaataaaaaatctttttttgaaggccaggaaccagcngactttaatggcctgtnaatcccatcactttgggaggctacagt

SEQ ID NO: 20233 - DNA, 340 bp, Homo sapiens
  misc_feature 79, 114, 138, 182: n = A,T,C or G
aggtaacctcttgacccagacgaaattagaaatgttttctcatggcaaaaaatctctcactttgcattcaaaagctgtnatagttgaggactttatgatttatatgattgctgnttttagcaaaccaatctatatgtnctagggaataatatatacatacatcttatagttgatatttctgntggcaataaaccacttcttaccctactcgagaatgcagggaattgcttttcttattttgcttcctttggctctttttaatgtggagtttaccatgtgatcaaccttttctaaacaaattctgaatttttaattttgcaatgacatacatttgcttatg

SEQ ID NO: 20234 - DNA, 116 bp, Homo sapiens
  misc_feature 22, 40, 67, 81, 84, 101, 103: n = A,T,C or G
aaaacattgtggtattcttatnacataattggcttcttgnggacttagctttaactacactacaggntatgatctccatgnagnccatataaacctgcagngngattttccagaag

SEQ ID NO: 20235 - DNA, 234 bp, Homo sapiens
  misc_feature 16, 19, 42, 64, 81, 123, 186, 192, 205: n = A,T,C or G
gacgaagatgttgtgnacntttgtttgaaatgacagcaaagnatttagaatattacatacattnagttgataaagctgctnagggtttgaaaggatcgaatccagttttgaaaggatattctnctatgggtaaaatgctcttaaacattgcatgctacagaggaaatattttgtgaaaagaagagncaatcngtgtggcaaactncactgatctctttttttttaagatattgc

SEQ ID NO: 20236 - DNA, 100 bp, Homo sapiens
  misc_feature 26, 27, 45, 46: n = A,T,C or G
tgtagtatcactctccaaaccaatcnncccttacaaagcccttgnngcaggctatgcttttctgagggggacccaggccaagacactaaaatgacgcacc

SEQ ID NO: 20237 - DNA, 140 bp, Homo sapiens
  misc_feature 14, 53, 54, 71, 73, 74, 85, 91, 99, 115: n = A,T,C or G
gaatatattggccngaaattagcaatgaggaaaaactcagaattcattttggnngaaagtagaaaaagggnannataaagcacgnggcggngacttaangggggaatattaatgngcatacttaaaatatgactgatgga

SEQ ID NO: 20238 - DNA, 120 bp, Homo sapiens
  misc_feature 5, 10, 25, 44, 51, 58, 94, 95, 100: n = A,T,C or G
gaagnaaatntggcctaacaaatanaaaaaggaaaattttggcnctggccnatttttncagaaatcaatctttttgaaaggcttttcctgttgnntgttnaactggaggctactaaggag

SEQ ID NO: 20239 - DNA, 124 bp, Homo sapiens
  misc_feature 34: n = A,T,C or G
tggtcggaggctagaaggccgagtggactctgcngaccgccagcaacacgttcgtgaagccccattttcagttcgggacatcgaaccgaggccaaagcgggaagggttgcgccgagcctcatac

SEQ ID NO: 20240 - DNA, 100 bp, Homo sapiens
  misc_feature 61: n = A,T,C or G
ggcaaatttttttaagcaaaattttcactgtaaaggggaaacctggaaagaaaacgggttngaaaaagaaagatggcttaaaaaggggataagcatatcc

SEQ ID NO: 20241 - DNA, 290 bp, Homo sapiens
  misc_feature 5, 17, 24, 31, 47, 70, 127, 128, 141, 156, 230, 235, 236,284: n = A,T,C or G
aatantaaggttgtttntactccntattaantatatatacatatatnacactttacacacatacacttgnttcctcatgcaatttggttctcagcagaagaaaaaactaacaaagttataagtaaanngaatatttacagnagcactatttttggnggcaaaagtactttaatatccttaaatgctcatataatggaaaggaactttaacttctttacaaagaaatgtgncagcnntttatctactattaaagggatccctaatatctttataccctaaagggntatatg

SEQ ID NO: 20242 - DNA, 340 bp, Homo sapiens
  misc_feature 61, 93, 103, 165, 223, 263, 275, 290, 318: n = A,T,C or G
ttcttgaagtctggtggatgctgccattgttgatatggttcctggcaagcccatgtgtgtngagagcttctcagactatccaccttttggtcngctttgctgntcgggatatgagacagacagttgcggtgggtgtcatcaaagcagtggacaagaaggctgccnggagcttggcaaggtcaccaagtctgcccaggaaagctcaagaaggctaaatgaatanttatccctaatacctgccacccccactcttaatcagtggngggaagaacggnctcagaactgtttgnttcaattggccatttaagtttaagtagnaaaagactgggtaatgataaca

SEQ ID NO: 20243 - DNA, 100 bp, Homo sapiens
  misc_feature 21, 30: n = A,T,C or G
acattttttgattgggatgcncaacagggnaggggaataaaatatttgcaaaaatccaaaaaaatcttcaaatctgaaatactcctggtgtaagcatttt

SEQ ID NO: 20244 - DNA, 300 bp, Homo sapiens
  misc_feature 25, 48, 50, 117, 233: n = A,T,C or G
tcatatgtatactttttttctacgntatctcatctccttgttttcagngngcttcaataatgcagggtaatattaaagatggaaattaagcaattatttatgaatttgtgcaatgtnagattttcttatcaatcaagttcttggaatttgattctaagttgcattatttataacagtctcgaaaaattattttacttgcctaaacaaatattacttttttttcctttcaaganaattttataaaatcatttggacctacctaattggctaaatgaaataacatatgggggggctgttatt

SEQ ID NO: 20245 - DNA, 125 bp, Homo sapiens
  misc_feature 94, 99: n = A,T,C or G
accaagcattaatatagcaaggactaacccctatacccttctgcataatgaattaactaggaaataactttgcaagggagagccaaagctaagnacccncgaacccagacgagctaccctaagag

SEQ ID NO: 20246 - DNA, 281 bp, Homo sapiens
  misc_feature 57, 149, 155, 232: n = A,T,C or G
acatctaataagtatataatcctgtgtaaaatatgaggcttgataatattaggttgncacgatgaagcatgctagaagctgtaacagaatacatagagaataatgaggagtttatgatggaaccttaatatataatgttgccagcgatnttaggncaatatttgttactgttatctatctgctgatatggaattcttttaattcaaacgctgaaaacgaatcagcatttagncttgccaggcacacccaataatcagtcatgtgtaaatatgcacaaggtt

SEQ ID NO: 20247 - DNA, 350 bp, Homo sapiens
  misc_feature 186, 198, 254, 276, 295, 340: n = A,T,C or G
gggcggaaatgagtttagtttcggtttttctgaacttcctgaaggagtccttgatgtgcagcttggaattccttcgacttctctccagccgagcttcccagaacatcacatatcactgcaaaaatagcatttcatacatggatcaggccaggggaaatgtaaagaaggccctgaagctgatggcgncaaaatgaaggngaattcaaggctgaaggaaatagcaaatatcacctacacagttctggaggatgggntgcacgaaacacactggggaanggagcaaaacaggctttgnatatcgaacacgcaaggctggggagactaccctattgaggatatngcaccctatg

SEQ ID NO: 20248 - DNA, 103 bp, Homo sapiens
acattctactgtctaggaccttgtctcaatggatcctagtactttatcgcccctctgaatccgccgatcaccctctgaggaccaaccttgctcataaacaaaa

SEQ ID NO: 20249 - DNA, 100 bp, Homo sapiens
  misc_feature 26, 48, 57, 60, 76, 96: n = A,T,C or G
ggaactagaagatattaaaaacattngacattgggaagaaatattganactgatatnganttttatatagggattnatttaagaattgaaattttngagt

SEQ ID NO: 20250 - DNA, 270 bp, Homo sapiens
  misc_feature 224, 269: n = A,T,C or G
gagataacagaggaaattctgcattctcgcttcctggagggtgtcccgcaatgttgccagtgtctgtctgcagattggctacccaactgttgcatcagtaccccattctatcatcaacgggtacaaacgagtcctggccttgtctgtggggacggattacaccttcccacttgctgaaaaggtcaaggccttcttggctgatccatctgcctttgtggctgctncccctgtggctgctgcccccacaagctgctcctggtgctgctgcng

SEQ ID NO: 20251 - DNA, 240 bp, Homo sapiens
  misc_feature 25, 55, 102, 215: n = A,T,C or G
cagaacgagctacctaatacagccnaaaaggagcacacccgtctatgtagcaaantagtgggaagatttataggtagaggcgacaaacctaccgagcctggngatagctggttgtccaagatagaatcttagttcaactttaaatttgcccacagaaccctctaaatcccccttgtaaatttaactgttagtccaaagaggaacagctctttggncactaggaaaaaaccttgtaggaga

SEQ ID NO: 20252 - DNA, 200 bp, Homo sapiens
  misc_feature 9, 41, 120, 146: n = A,T,C or G
cccatcctnacgccagttagaatggcatatcattaaaaagncaggaaacaacaggtgctggagaggatgtggagaaatagggatgcttttacactgttggggggagtaaaaatcagttcnaccattggaagacagtgtgacaattnctcaaggatctggaactagaaataccatttgacccagcaatcccattactgggt

SEQ ID NO: 20253 - DNA, 400 bp, Homo sapiens
  misc_feature 21, 24, 32, 61, 69, 87, 208, 256, 329: n = A,T,C or G
tgttaaccactttgattgctnctnatgttggngtggtttgattctctggtcactatgtttnactaaagntcgactcagacaatgctntaatctgttactctcattcgacaatacatcttgactgtttcttcaacttgaggaaggtaaaccaaaagccactctttaatgggtgcaaatatctgttgtaacctatgtaggaagatacagnggctgggtttgaggacaggggagtgggaaaactgagtagggaagcggnaagacatgcatctggctttaggagtgtttgaagtgcctaaagatcaggggaatttcccaaatttgaatcttgntgcccaagccaccgacctggcctacctgggcttttttggacagatgtacatgattttagaaattgttatga

SEQ ID NO: 20254 - DNA, 300 bp, Homo sapiens
  misc_feature 221: n = A,T,C or G
aaactgacccagactttgatcattgtgcagtctgatagagagctataagcagaatgatgtcgtccgaattctcccctgcaagcatgttttccacaaatcctgcggggatccctggcttagtgaacattgtacctgtcctatgtgcaaacttaatatattgaaggccctgggaattgtgccgaatttgccatgtactgataacgtagcattcgatatggaanaggctcaccagaacccaagctgttaaccgaagatcaagccctcgggacctcgccggggacaactcccttggccttgagc

SEQ ID NO: 20255 - DNA, 200 bp, Homo sapiens
  misc_feature 26, 51, 72, 127, 171, 182: n = A,T,C or G
cctctgaaggttaaatctgagttctnattaaaagaaatttgctttcattgngattatttcttaattgctatncttcagaatcaatttgtgttttatgccctttcccccagtatttgtagagcaagtnttgtgttaaaaagccccagtgtgacagggacatgatgtagtagngtcttactggntttttaataaatcctttt

SEQ ID NO: 20256 - DNA, 202 bp, Homo sapiens
  misc_feature 25, 34, 56, 160: n = A,T,C or G
gctttagtagagtactagtaaccancctggacanttcaatgcaaacagtaaatctnaagacagtaggaaaacattagatttttctgttaggcatagagggaaaaaattaggtgttttcttacactatattcattttgtttcataaattcacactttagcnactttctacaaaattcccatggccatttttattcttcttttt

SEQ ID NO: 20257 - DNA, 400 bp, Homo sapiens
  misc_feature 2, 33, 34, 296, 339, 390: n = A,T,C or G
cncctggaaccataatattgtagatcactgggnnggaaggcaccgcaagcttatttttcatacttttatatgtactcagacttgatcgattaatgaagtggttattttggcctttgcttgatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccgggaagcttctgttcaatcccagcgncccttaccagaaaaagcctgtgcatgaaaaaaaaagaaggttnggaattttatattactttttaggtggaactaaggattaaacatatttctgnattccttccc

SEQ ID NO: 20258 - DNA, 124 bp, Homo sapiens
  misc_feature 84: n = A,T,C or G
gtcatactaggtattatggttctttagattaatactgattatatagagcacggaaaggataaaggaattgaacattttctttgnatacttttttacactaattttattgttatacataaaatgg

SEQ ID NO: 20259 - DNA, 360 bp, Homo sapiens
  misc_feature 6: n = A,T,C or G
aaaagntgatgaatttgtgactcacaatctgtcttttgatgaaatcaacaaagcctttgaactgatgcattctggaaagagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctattaatcaaggacaaggataattcagtcatgaacctgttttctggatgctcctccacataaataattgctagtttattaagggatatttttaacataataaaagtaat

SEQ ID NO: 20260 - DNA, 120 bp, Homo sapiens
  misc_feature 23, 25, 89: n = A,T,C or G
aggggagccaggagaggagaaangncggggccgagctggccctccaaggcagcacccaaagggcaatgcacagaagaccccgggggggngagcgcttggcttctcaaaacggccgaaggt

SEQ ID NO: 20261 - DNA, 140 bp, Homo sapiens
  misc_feature 30, 107, 126: n = A,T,C or G
tcggcagcgaaaggactggaaaaagacaanagctgtcttgaatctttggcaaaggaagtcacccagaaatggaataggcaaaaggatgtagcctttcccccaggggnactggccagaagggaaatnagaaaaagccatgc

SEQ ID NO: 20262 - DNA, 118 bp, Homo sapiens
  misc_feature 23, 26, 34, 48, 59, 96: n = A,T,C or G
atttttgttataacgccgaaganatnacaatgtnagcctcaatttctngacaccatagngagtaatgtaaagcttcgtcttgatcgcatcaaagcntgaaaagagatacttatatgga

SEQ ID NO: 20263 - DNA, 120 bp, Homo sapiens
  misc_feature 28, 60, 96: n = A,T,C or G
gccttaagccgggctaaaagggtttatngggggttgattttactattcttttctcatttntgaacatattggaaaattttctatattaaaacattnttttttaagaaacaaatgtgcagg

SEQ ID NO: 20264 - DNA, 100 bp, Homo sapiens
  misc_feature 29, 51: n = A,T,C or G
gccttaaagctggctaaagggtttatggntgtttgattttactattctttnctcattttgaacatattggaaaaggttctatattaaaacatttttttaa

SEQ ID NO: 20265 - DNA, 110 bp, Homo sapiens
  misc_feature 54, 57, 86: n = A,T,C or G
ggcatcattacattatccataggtaggcagggggggaaggatatatcttcctgntgnaccccagggcttccatctctcaaaaattncttttcaaaggaaaaatgctggct

SEQ ID NO: 20266 - DNA, 100 bp, Homo sapiens
  misc_feature 31, 36, 37, 62, 78, 82: n = A,T,C or G
tgcccaccaaataattttttaaaagattaanagggnnctcacaggagcacaaaaatacatanaaaaaatggctgcctntttngaaagattacatgggggg

SEQ ID NO: 20267 - DNA, 300 bp, Homo sapiens
  misc_feature 30, 107, 138, 164, 169, 245, 285: n = A,T,C or G
aaatgatatgaccaaaattttaagtagganaggcaccccaaacacttctgctttcactttaaagtgtctgggcccgcaatacttgtagggaacaagcatggatcttngttactgtgatatttttaaatatccacagtnctcacttttttccaaatgatcctagnaattngcctagaaatatctttctcttaccctgggatttatccaatttttcccagcatgttttatacgggaaaaatggagtnggaaaacccttagaatgcaggatgaaaagaggaatttggnataattatggggggg

SEQ ID NO: 20268 - DNA, 130 bp, Homo sapiens
  misc_feature 3: n = A,T,C or G
agnagcagtgatggaaaaaggaatttggcataatttttaaaggaatttaactggagcgcacatatcaaagaatatggaaatcatggagaaagaagaaaaggtctctcaattctcattagaaaggggtgga

SEQ ID NO: 20269 - DNA, 463 bp, Homo sapiens
  misc_feature 26, 54, 332, 350, 366, 386, 390, 417, 418: n = A,T,C or G
taaatgaagagatgctaagaatttgntttggggtcaacaggaaagcatatgcangccgaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcacttttttccaaatgatcctagtaattgcctagaaatatctttctcttacctgttatttatcaattttttcccagtatttttatacggaaaaaattgtattgaaaacacttagtattgcagntgataagaggattttggnataattatgggggggngattattttttaatactggnatgngccaaagctttactactgggggaaagnnaactgttttaataaaaagattacatttccacaaaaaaaaaaaaaa

SEQ ID NO: 20270 - DNA, 118 bp, Homo sapiens
  misc_feature 18, 34, 58, 87: n = A,T,C or G
tattacaagcaggattanttccctctttttttgngacacaagtacaatcctaaaaggnatattgggaaaacatgggaatattaaaantttacacttttactagctaaaacataatcac

SEQ ID NO: 20271 - DNA, 140 bp, Homo sapiens
  misc_feature 23, 24, 39, 59, 89: n = A,T,C or G
ttgatgctatattactgcgatcnnaaacgtcttgcaggnaatgtttatgatattgttanaacgttgtaatttcttaatcggaaattatnaacatttcccatttcctttttgtaggaggaaaacttttcttaccataattt

SEQ ID NO: 20272 - DNA, 100 bp, Homo sapiens
  misc_feature 35, 57, 98: n = A,T,C or G
ttcgacgcaaagttgtcattcgtgaaagaaccctngaggaagggaacctcagaacgncccctacagccatgctctgaaggcttggaatggaaccgctnct

SEQ ID NO: 20273 - DNA, 130 bp, Homo sapiens
  misc_feature 22, 125: n = A,T,C or G
acactggtggacagagactagngctgatacgaaacacgtgtggtttggagagtccatggaacggggaattcagttatagctaccggaaacctgaacgccctgaagatgtccgcgatgtgcagctngcatt

SEQ ID NO: 20274 - DNA, 100 bp, Homo sapiens
  misc_feature 36, 37, 70, 83, 86: n = A,T,C or G
ttccagcgtactccaaagaatcaggtttactcacgnnatccagcagagaatggaaagtaaaattccctgnaattgctatgtgnctngttttcatcccatc

SEQ ID NO: 20275 - DNA, 381 bp, Homo sapiens
  misc_feature 10, 31, 116, 157, 163, 164, 193, 249, 268, 311, 332, 351: n = A,T,C or G
cgtcctccgnagccatgtttgacaaacccgnttggctgagatcgagaaattcgataagtcgaaactgaagaagaacagagacgcaagagaaaaatccactgccttccaaaaaaacnattgaacaggagaagcaagcaggcgaatcgtaatgaggcgngccccnnaaatatgcactgtacattccacaagcatngccttcttattttacttcttttagctgtttaactttgtaagatgcaaagaggttgnttcaagtttaaatgactgngctgcccctttcacatcaaagaactactgacaacgaaggccgngccttgccctttcccatctgnctatctatctggctggcanggaaggaaagaacttgcatgttggtgaagg

SEQ ID NO: 20276 - DNA, 400 bp, Homo sapiens
  misc_feature 11, 23, 44, 112, 113, 127, 147, 286, 292, 361: n = A,T,C or G
aaaatattcangaaaggcttagntccccaagcctccccctccantaaaagacagttacatgatgtttggcaatcagttccaatgtgatgatcttatcatcccgccctttggnnaggcagggcatcgnacggcttcatcctatgcagnttgatcacaagaaaggaactgagaaaacttaatatgtctatccttattaatttcttggaccttttagatatttttaaataaggagccctggggagataaaaacgagaggagaactagaagatcttaagctgctttttgnacacgngcatcatcttataaaatgaatacccgaccccaccaagcaaggagagaccttgagagtcatgatggaggnccagaaacgtcaaccggcttggaacagctgagagattca

SEQ ID NO: 20277 - DNA, 119 bp, Homo sapiens
  misc_feature 75, 90: n = A,T,C or G
agcatgggtggaccaccaggaaagtaatcttaagccatctagtatgtcacaattgaaacaaactggggagttggnttgctattgtaaaanaaaatatactgttttaaaaaaaaaaaaaa

SEQ ID NO: 20278 - DNA, 110 bp, Homo sapiens
  misc_feature 24, 91: n = A,T,C or G
ccgagccatactcctgaagaagcngttcagaatgatgatcaagcctattggactgaagaagaagacactcgccaatttaaaatgacacagnaacttttggacttttcagc

SEQ ID NO: 20279 - DNA, 101 bp, Homo sapiens
  misc_feature 68: n = A,T,C or G
tttcaccatgtggacaaataatggaaaattcgagtctttccagataaaggatattcatttgttccggnagggatggttttttaaaaaaacatttttcttgg

SEQ ID NO: 20280 - DNA, 300 bp, Homo sapiens
  misc_feature 28, 83, 127, 153, 158, 285: n = A,T,C or G
ggggaaacctaaactgcaatgtgggttngttttaacccacatgacttatgaatgcataaaaagccaaaatttccagtttaagnaattgcctacaataaaaaagaaattttgcctgccattttcagantcatcttttggaagctttctgttggnggggnactggagctactagaggatattcttattttcactaaatgtaaaatttggaggaaatatatatgtccaatattttagggaaagcttttcttttttaatttccaggaaaaaataaaaagaggatggagncttctgtaattcatt

SEQ ID NO: 20281 - DNA, 350 bp, Homo sapiens
  misc_feature 73, 240, 248, 278, 325, 342: n = A,T,C or G
agattatggaaggagggcctcggttataggcaaaaaaataggtaaaaaaggctggacaataaacacccaaaanttcaatttttttaaaaaaaatcctgggtgggtcccaaaatgtggtaataaatttttaaaaggtaaattttcctaaaagccaggtttatttataaatgggggttggcctgctttaaaaagggtataaatttaaaactttctttttctcttctacattggacacacagnaaatgggncaatgtaaaggccaaaaccatcttctgggnttatggccaatctattctcaaaggtaaaaggaaaattgtttcagagncacaggtccctttattncacataag

SEQ ID NO: 20282 - DNA, 300 bp, Homo sapiens
  misc_feature 32, 248, 252: n = A,T,C or G
tctcttatccaacatcaacattcttggtcagnatttgaactcttcaatctcttgcactcaaagcttgttaagaatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgngggntaatctgggttatttttgttccacaagttaaataaatcataaaacttg

SEQ ID NO: 20283 - DNA, 320 bp, Homo sapiens
  misc_feature 81, 147, 216, 241: n = A,T,C or G
taaatctggaagaatctaccttccatagtagtacgtacggctcctgttctctagaaaagtcaatggaggttgatagcggtnttgcatatgaactcaaatcttacactgaatcaccaacaaaccctcagttttcaccaagatgttganaaggagtgatgatttaaagtatttactcagtacccaagattgcaaggaaaaattagcatagaatggagngtaccaaattaacaatcaggagagnggattctctcctgttatcctggaccagtttttatgaaaggattcctgaaatgaaatccatatattccatgtagactgga

SEQ ID NO: 20284 - DNA, 150 bp, Homo sapiens
  misc_feature 35, 105: n = A,T,C or G
ccacttgagtaccgggagaaaggggcagtcccttnacctgtgaagtggatgcccttaaaggaaccaatgtgtccctggaacgccagaatgcgtgaaagggaaganaacttgccgtttaagctgctaactaccaagacactattggccgcc

SEQ ID NO: 20285 - DNA, 200 bp, Homo sapiens
  misc_feature 14, 190: n = A,T,C or G
ttaagcaccaagtnatatgacaggtactgtgcaaagactcaagaacccccctcctagtgatcttatggaaaggccacattatttatttattgataagaacttaattgtttagcaaaatacatgggaaagcaatacgtaggaatgaatactatttagacacagacagaagatgagccatctttttatttgncttaaaaact

SEQ ID NO: 20286 - DNA, 100 bp, Homo sapiens
  misc_feature 41, 63, 87: n = A,T,C or G
gttgaatctatgaaataagggcagttgaagtagaaattttnaccagtccactttgaccttctncttccctaaccactggctcttgancacctttggaatt

SEQ ID NO: 20287 - DNA, 116 bp, Homo sapiens
  misc_feature 48: n = A,T,C or G
gtcttaagttttaagggaacttggctccttgaacctccctgaaagaanctctaccatttaattaagaaaagcagttgcctgttcggaaagcatctttgagaggaaacaggaaaagt

SEQ ID NO: 20288 - DNA, 355 bp, Homo sapiens
  misc_feature 21, 107, 134, 171, 172, 184, 237, 239, 260, 295, 298, 333: n = A,T,C or G
gagtctagtgtcccctgggcnagagctctattgaagcacttatcttccagtttacttacatacaaataatttatattttacagattccttaatggaagaagctttgnttctaattataaaatgtgtaatttctnatttgaaaaaatttttattgggaaaaacctagatganncagaagactatnaaaaaaaataaaaacactcaatcctacctctaaaggataaccaccattatagngnatacaggcagccctccatatnccttgggctcagcatctgaggagtcaaccaactgnggnctggaaatattcaggaaaaaaaagttaaaacagtntaaaaaaaaaaaaaaaaaaaaa

SEQ ID NO: 20289 - DNA, 490 bp, Homo sapiens
  misc_feature 18, 35, 39, 346: n = A,T,C or G
tatcaggtacgatctganaaaaaagactggaaggntggngaacctctgaaaatgagtaaatgtgatcatccagcggggagggattcactatgaaatgtggcttagaatgtccacctactttcagtgacaagagagaacaaatatcagaaaaatccaacagaagccacagatattggttttgggaatcgatgtggaaaacccaaaggaccaagagatccaccttcagaatggacatgattcagggagctagaagacacttttaagttatactgggaaaattcaggtgccacttgaaagccagatttataggtattccatctttttaatatgggggactaacagcagngtaggattgttaccttaataatttttttggctgggaccatctacctgccttatactacacttaggaaaaagtattacatatgggggtatttttggaaacttaaaggattatttgccttaatgtctcttaaccctgttacacgct

SEQ ID NO: 20290 - DNA, 119 bp, Homo sapiens
  misc_feature 100: n = A,T,C or G
aaaaggagacatgaacgactgtagtcttctgaaaatacgaagaatcattagagactattatgaacaagcataaactaataaattggaaaacctgggaagnaaatgaataaatgaaggaa

SEQ ID NO: 20291 - DNA, 237 bp, Homo sapiens
  misc_feature 157, 198, 214, 217: n = A,T,C or G
cggttccaaagggaaaaagtatcatggaaatattatgcaaattcccagatttgaagacaaaaatactctaattctaaccagagcaagcttttttattttttatacaggggaatattttattcaaggtaaaattctaaataaaatataattgggtttntatcttttctacagcaaatttataattttaagattcctttncttgtttatcagcagntgntattacatccttggggcaca

SEQ ID NO: 20292 - DNA, 281 bp, Homo sapiens
  misc_feature 44, 169, 179, 190, 218, 225: n = A,T,C or G
attatactgctgctatagcccttccttgataagattttagaggnttgtgtttgggatgcagaactacgggaacttcgagctgaatgttttataaaagaaggagaccctaggaaagctataagtgacttaaaagctgcggcaaagttgaagaatgataatactgaagcgntttataaaanaagcacactgnactaccaactaggagaccacgaactgtncctcagngaaggtcggggatgtcttaaacttgaccaggatcataaaaggggggggcacactat

SEQ ID NO: 20293 - DNA, 190 bp, Homo sapiens
  misc_feature 16, 31, 63, 82, 160: n = A,T,C or G
caggttgcacattctnaatcactttccagtntcacaagaagagatttttacttatataatagncctagagtttgcagctggnaaaaccagaggctacatccagtattactgctaagagacattcttcatccaccaatgttgtacatggggggaaaatggngtactgtatactttaacatgccccatactt

SEQ ID NO: 20294 - DNA, 144 bp, Homo sapiens
  misc_feature 37, 49, 65, 89: n = A,T,C or G
aaggcttgcgacaacgtgcaaagtatctctgctcctnagtgagagaaangatcattgaaatgggngggggggttgggagtagaggaaanaaagggcttctgagctcttttggaatccaagattacttttaggtcaccaacaccc

SEQ ID NO: 20295 - DNA, 100 bp, Homo sapiens
ggcaggaaaaatcccttgaacctgggaggcagaaggttgcaggtgagccggcaatcgaaccactgcactccagcctgggggacagagcgagactccgtcg

SEQ ID NO: 20296 - DNA, 300 bp, Homo sapiens
  misc_feature 18, 22, 23, 35, 41, 43, 51, 79, 80, 226, 241, 254, 290, 299: n = A,T,C or G
gggtcctgagccggtacntctnnctttctggcctnggaggntntccagcgnactccaaagaattcaggtttactcacgnnatcccagcagaggaatggaaagtcaaatttcctgaattgctatgtgtctgggtttcatccatccgacattgaaggtgactgactgaagaatggagagagaattgaaaaagtggagcattcagacttgtctttcagcaaggactggnctttctatctcttgnactacactgaatncacccccactgaaaaagatgagtatgcctgccgggngaaccatgng

SEQ ID NO: 20297 - DNA, 400 bp, Homo sapiens
  misc_feature 12, 41, 62, 71, 92, 154, 155, 159, 212, 242, 257, 279: n = A,T,C or G
gactgggtaaanatactggacacatttaaactatttctatnaagatgctttacttttcaagnacggggggncattttcacagtctccagggngacaaaatgccaatagatatgtgagttaatttttttaaatatctccgtgagttgtaaatagnngggnatttgatctgccctatccttctttgattctttaacatgttctctctcttttgnttgcaaaatatgtttgaaagcattggaagngctttccttatcagnaactggagttctcctgcttgcnctagagaagggaaagagagaatcaggattcttatatggcaatctggggaagcagcaatatgccactgtacaaaactgaagaaaagttcctaattggactttgggaagggagatgaaaggac

SEQ ID NO: 20298 - DNA, 400 bp, Homo sapiens
  misc_feature 37, 42, 92, 97, 140, 142, 206, 254, 346, 381: n = A,T,C or G
gacatgcttatacacttacactttatgcacaaaatgnagggntataataatgttaacatggacatgatcttctttataattctactttgagngctgnctccatgtttgatgtatctgagcaggttgctccacaggtagcncnaggagggctggcaacttagagggggggagcagagaattctcttatccaacatcaacatcttggncagatttgaactcttcaatctcttgcactcaaagcttgttaagatagntaagcgtgcataaggtaacttccaatttacatactctgcttagaatttgggggaaaatttagaaatataattgacaggattattggaaattngtataatggaatgaaacattttggcatataagatncatatttacttcttataca

SEQ ID NO: 20299 - DNA, 116 bp, Homo sapiens
  misc_feature 24, 75: n = A,T,C or G
cacatccaccaggttaaagaaatntgattggtaaattaactctggaactactagcattttagctctaatagtttnaaatgatttgccatttgcttatatagctttcatctgtcaaa

SEQ ID NO: 20300 - DNA, 140 bp, Homo sapiens
  misc_feature 19, 24, 94, 102: n = A,T,C or G
ggatcaactatttaaaagnactgnaaatattagggaaagaaggaaacttgggaaggacagaaaagaaaaaattataatctaagccgataccggnttcacagnacatggcaattggttcttcctattttatactatttctt

SEQ ID NO: 20301 - DNA, 102 bp, Homo sapiens
  misc_feature 18: n = A,T,C or G
gggccgaggatggcaacngattcttcagaaaccagtcttccaccggatatgtatgaatgtctacgtgttggctaacggaagcaacttcttaattaatatctg

SEQ ID NO: 20302 - DNA, 220 bp, Homo sapiens
  misc_feature 51, 83, 88, 90, 123, 126, 134, 209: n = A,T,C or G
acacatgcacacaggaatgttcctattttaacattaccaagggagaaaggngggacaaattaccccagccggaccaacctgancctgngncccattgtaaggagaaggatgttgacgactggnggntctatttnacggattcagggaatgggaacaacgagggcatgggtcatgttggggagaatccagaggggcccactgggccaganatcattccaat

SEQ ID NO: 20303 - DNA, 100 bp, Homo sapiens
  misc_feature 41, 80: n = A,T,C or G
aactgaaattttgtgttctttgactaacatctctctacttncttcacccacccgccccaggccctggaaaccatcttttnactctctctctatgagttct

SEQ ID NO: 20304 - DNA, 131 bp, Homo sapiens
gaagttgaaaatggtgaacattgtgattttacaatcctaagaaaatatgttgataagaacacacatgcaggacttgaaagatgttactaataatgtccactatgtttactacagaagcagaaaaacttgca

SEQ ID NO: 20305 - DNA, 120 bp, Homo sapiens
  misc_feature 15, 21, 54: n = A,T,C or G
gagatcctgagacantgagtnggatggacccaaaagcttcactttcttcgacgntatgagcttttattttacccaggggatggatctggtgaaatgcatgatgtaaagaatcatcgcacc

SEQ ID NO: 20306 - DNA, 144 bp, Homo sapiens
  misc_feature 54, 75: n = A,T,C or G
cgaaatggaaaaaaatcatgactaattaagaatttttttctaggaaggcaaggncgggtttaaatttaaaaaatnaggcaatatgattaacaaaataaaggaaaacctctgttaaagtatttccattaacagaataaaggaata

SEQ ID NO: 20307 - DNA, 163 bp, Homo sapiens
  misc_feature 8, 10, 16, 64, 100, 122, 151, 156: n = A,T,C or G
aaaagccnangggcgngagaaaccggccatgatgactcatgcatgactcagttctctgcggggnggggataaaaggccatgaccaaaggctcgcagattnttgagaagagttttgggaaagnattactcttgtcttctgctgctcctgggnaaagngatttgg

SEQ ID NO: 20308 - DNA, 140 bp, Homo sapiens
  misc_feature 17, 36, 45, 66, 75, 124: n = A,T,C or G
gtgacgatagatagcanatgctttttttttaaaggngagggatcngtaaggtcagaatatttaaangttatctgnacacagctaagagggggtagaagggaaatgaagaatctaattagtgggnctgactataaagccca

SEQ ID NO: 20309 - DNA, 142 bp, Homo sapiens
  misc_feature 52, 64, 114: n = A,T,C or G
ccatcgactgagtgggaggcagggaagacacagtggtggagctaattggtgncatccctgtgtnatgggagagttatagccaagcccaagtgttgctttgggggatgagtaatnatgcttggaggagaactctgatcttact

SEQ ID NO: 20310 - DNA, 100 bp, Homo sapiens
  misc_feature 26, 37, 45, 73, 84: n = A,T,C or G
agaaaacccccacttatgcttaagcnccttaaaaccncaacaggnaaaatcaacaaaactgcggcgccaggancactaacgagnccacaagctttaaaaa

SEQ ID NO: 20311 - DNA, 240 bp, Homo sapiens
  misc_feature 9, 33, 60, 107, 134, 172, 189, 203, 216: n = A,T,C or G
gggcataangcaagctaaagtggagttatactngtggagtaggtcttccaaatgtggggnacctcagctatatcactgcccaacatcaggaaaacctgacggctatnattactatgccttttctaaaggatcantactataacattgatgtgcctggggggacaggcaagangcgaattactactcgtnctgggcggaccttnatccaaagtctgnggcaactggtccctaggactggat

SEQ ID NO: 20312 - DNA, 100 bp, Homo sapiens
  misc_feature 20, 33: n = A,T,C or G
ttgaggctcggagcccgccncctaacatcgtcnttctttttcttggccttggtaggttatcccagcgaacttccaaaagaattcaaggttaacttcacgg

SEQ ID NO: 20313 - DNA, 270 bp, Homo sapiens
  misc_feature 84, 107, 123, 156, 161, 170, 196, 207, 211, 246, 254, 269: n = A,T,C or G
ggacccagaaggataaaataatatatccacaaatctatactgatataaataaatggggaaggaatccgacaaatctctcatgcnggaaaatttcaaataatctatgnagattagatctcaagnaaggtagaatgtaacttcccacttgttaaatangggcngagcttagngacttccttgcagagtttgaaggggnagggggaaatngggnaaccaattccctatcaatgggcttttaaaaattgnaggatagngcttcaatgaaaccnt

SEQ ID NO: 20314 - DNA, 100 bp, Homo sapiens
  misc_feature 31, 44, 79, 96: n = A,T,C or G
gaaatggacaacttactccaaaatcctcatntaaattatctttnccccagcaaagttcctaactgaaaaatgaacgggnggaaatttttccttctntatg

SEQ ID NO: 20315 - DNA, 220 bp, Homo sapiens
  misc_feature 12, 52, 148, 176, 180, 197, 199, 206: n = A,T,C or G
gcgctcactggnctacactggttgcccgaatttacttgtattcctaactgtnttgtatatgctgcattgagacttacggcaagaaggcatttttttttaaaggaaacaaactctcaaatcatgaagggatataaaagctgcatatggngggcaaagctctgaattcaggtcccagntgcnggcaccaaaggaggggngnggaaacnccgcaccctacccc

SEQ ID NO: 20316 - DNA, 110 bp, Homo sapiens
  misc_feature 28, 60, 83, 99: n = A,T,C or G
agcttatgattttcactgcatagagtgngagctaaaaaagcggttctccataagcaggcnagtatggtaataatagaaatggncggttaccacgcaggnctgggcagtag

SEQ ID NO: 20317 - DNA, 100 bp, Homo sapiens
  misc_feature 60: n = A,T,C or G
atcgggcaggccaagaaagcatccgagccttgacccccctctttgtattttattggaacnggggctactggagcaacacttgtatttcttgcgggctggg

SEQ ID NO: 20318 - DNA, 140 bp, Homo sapiens
  misc_feature 26, 89, 126: n = A,T,C or G
ggcttcccctacgcaaaaggacccangggcggatacgccagcaggtctctgcccagccgcttgtggaaaatcggcctcggaagaggaangaaattcccggggttatattcaaggcgggcttctttncagaatccatcgga

SEQ ID NO: 20319 - DNA, 152 bp, Homo sapiens
  misc_feature 144: n = A,T,C or G
cccgagcaatacggaaatgatttctttggtaatgctttccccggaaaaatatgtggctctgcccttgggagtaacatctgcaacacaaaacgagttctacatgtcctaatcacctgttcattgtggcctgtgcaggagcctggngccaccgt

SEQ ID NO: 20320 - DNA, 169 bp, Homo sapiens
  misc_feature 22, 24, 40, 44, 128, 140: n = A,T,C or G
tgctgcttaccactgtagaggncnactggtaatgatttgngtanatgtctattatctcaaaagtgtttgtgcccctgcaaggagaggctttttcctgcattcatctattttacagcatctatcacaangctttccacatngcaaggacttcagaaatatttaaggtgaa

SEQ ID NO: 20321 - DNA, 230 bp, Homo sapiens
  misc_feature 26, 46, 56, 94, 133, 138, 149, 188, 205, 208: n = A,T,C or G
cattactctgaagggtcgcacagttntcgtgaagggccccagaggnaccctgcggngggacttcaatcacatcaatgtagaactcagccttctnggaaaggaaaaaaaagaggctccgggttgacaaatgggnggggnaacagaaaagnaactggctaccgttcgggactatttgtaggcatgtacangaacatgatcaaggggnggnacacctgggcttccgttacaag

SEQ ID NO: 20322 - DNA, 239 bp, Homo sapiens
  misc_feature 21, 110, 112, 137, 144, 214, 230: n = A,T,C or G
aaacgcctgaggcagagcccncaaattcctacttcatggatgtgaaatgcccaggatgctattaaaaataccacggtctttagccattgcacaaacggaagtttttgggngntggctgctccactgtgctctgccangcctacnggaggaaaagcaagggcttacaggaggggagttccttcaggaggggagcagcactaaaagcactctgagncaagatgagggggganacaatctca

SEQ ID NO: 20323 - DNA, 100 bp, Homo sapiens
  misc_feature 44, 70, 88: n = A,T,C or G
gcaaaaaggctgccactttttctctttttcgcctgtaggcccgnaactcaccgggggggcgggtgctccncacttcatccactagggnaccgcctaccat

SEQ ID NO: 20324 - DNA, 118 bp, Homo sapiens
  misc_feature 21: n = A,T,C or G
taaagcgggcccaagaggagnataaagccaaagaatttccttggcagcctgaagcgccagtaagcggctggtggggaaccgagacttcgcccccgagggggaagcaggggaacccagc

SEQ ID NO: 20325 - DNA, 420 bp, Homo sapiens
  misc_feature 43, 45, 53, 97, 125, 144, 153, 191, 233, 351, 367, 374, 397,406: n = A,T,C or G
attgttcagtttagctacggcaattcctgaacttcctgaagangnccttggangtgcaggctggcattccttcgacttctctccagccgagcttccnagaacatcacatatcactgcaaaaaatngcatttgcatacatggggnagggccagngggaaatggaaaagaagggccctgaagctgatgggggncaaaatgaaggagaatttcaaggctgaagggaaatagcaaanttcacctacacagtcctggaggatgggtgcaccgaaacacactggggaatggaggaaaaacagtcttttgaatatcggaacacgcaagggtggggaggactacctattggaagatatngcaccctatgacattnggggggncctggatcaaagaatttgggggngggacgggnggccctgtttgctt

SEQ ID NO: 20326 - DNA, 440 bp, Homo sapiens
  misc_feature 21, 35, 149, 150, 164, 178, 201, 319, 393, 414: n = A,T,C or G
gaaggaagcacgacaaggganaaagtaattacatnctcagtgacctgggatcaatattttaaaaacctagcacatttaattgaaatctgggagggagaagaaaaacaatgaggaagaaaaaatatatttaaaaatttaatggctgaaannggcccaaatttggngggggccttatagntaaactattgacagacaaaaggnaaaatctagaaaacagcaaagaaaacaacacattagatacagggagaggattctgtttaccactgacgaatcatcagaaacaggggaggtcaggaagcgaatagagaatctttaaaangctgaagggaaaaaacatgtcagcccagaatttcagattcagcagaatagccttcaagaaagaatatgggaccnggggtaggggctcactcctgnaatcccaacactttgggaggttgatg

SEQ ID NO: 20327 - DNA, 300 bp, Homo sapiens
  misc_feature 88, 105, 133, 134, 140, 145, 157, 188, 213, 244, 276, 296: n = A,T,C or G
tgattatgagacagcctcaataaggtagcccttttaggtaagaactataatttaatgcacgtttgattcctttggagccaatgcaacntattacaagttctcagngatgttctggctgagaattggacccaanncaactnggggntatcagagaggngaggccagagcaggacaagccaaacgaatgntggagccttcttggaattcttaagnacaaaccttcagaaatgccacagatatgagnactttttcgtcagggtttggggatttggaagnaaacctggaatttacccagngctc

SEQ ID NO: 20328 - DNA, 100 bp, Homo sapiens
  misc_feature 17, 37, 80: n = A,T,C or G
caagcagaaatactctnatccaacatcaacattcttngggcaggatttgaactcttcaatctcttgcactcaaggctggnaaaagatagttaagcgtgca

SEQ ID NO: 20329 - DNA, 254 bp, Homo sapiens
  misc_feature 62, 122, 131, 160, 166, 208, 224: n = A,T,C or G
ctggactacggaaaaatgtaaagcttttctgtggaaaaaataccgtaagcaaagtcaagaanttatgacaagcttggagaaatacctgcaacactggcagaccaagggctaatttctttganttgcaaagnagctcttaaacatcattgagaaaggtggngacctnactaaaaatgaaatccagatacaaaagggcaattcacagaanaacaaacacataatgnctgtaaagcatgtgaaatacgctcagactc

SEQ ID NO: 20330 - DNA, 180 bp, Homo sapiens
  misc_feature 34, 72, 127, 151: n = A,T,C or G
gaccggcagggaggaaaccatgaagagccttggncctttctttgccattccttggcccgcctttagcggaangaaacctttggtgttaatggaatcacatggaaaagcatggaatcctttatgaacnttaaatcccccttcaataaacagntagtaaatggcaaaaaacccttcataatc

SEQ ID NO: 20331 - DNA, 110 bp, Homo sapiens
  misc_feature 23, 42: n = A,T,C or G
catagaaagagaaaatatgtganacattactcttcattacanacaaagttaacacagaaaagttttattaaggaaaatactctggaggacaacgcaaaagctttatcact

SEQ ID NO: 20332 - DNA, 100 bp, Homo sapiens
  misc_feature 17, 28, 58: n = A,T,C or G
gtattatataaatattntataaggggangggaactaaaaaatacaagaatgggataanacctactcccaaaagatatataagggaggaaaaaaaagatac

SEQ ID NO: 20333 - DNA, 160 bp, Homo sapiens
  misc_feature 73, 94, 134, 139: n = A,T,C or G
aggattagtgacctaagattatttttgctgtcccgttttttgtaaatcaaaatgaaaattataaaagaagganttctgacagtaggaattttgnacatattgattatatgggggtccaaataaaaaatataaantgatnaaagactggaaataaaaataa

SEQ ID NO: 20334 - DNA, 110 bp, Homo sapiens
  misc_feature 56, 65: n = A,T,C or G
accccaggaattgctttgtcaaacaactgaggtcaattggggaggctgcaggaaanccaaaaganaaaatgtgctggttctttggttggttccccttggatggaaaatac

SEQ ID NO: 20335 - DNA, 100 bp, Homo sapiens
  misc_feature 23, 75, 88: n = A,T,C or G
cccccagctttggtcaatttcgngccagccacccgcggccacacgattaacccaggccattagaagccgggtaangaggttttagaanaccccccttccc

SEQ ID NO: 20336 - DNA, 130 bp, Homo sapiens
  misc_feature 44, 82, 107: n = A,T,C or G
taattctgagaaggcacgcatagaaatatcttaagaaacacagnaggaaagttactcagaactaaactttaagagcttaagngactactttcttggaaaatgacatnctgagctcaaaaggaatgggtaa

SEQ ID NO: 20337 - DNA, 146 bp, Homo sapiens
  misc_feature 12, 41, 62, 100, 115, 134: n = A,T,C or G
acgagttcgagnccgggaaccttccaaggctctttctgggngctggaagaagaacctcgggncctcaaggctcagctcaggggagcggaaaaattacgtnagctaaggaaatagnaagttgggggggggggggnaagctatcataa

SEQ ID NO: 20338 - DNA, 440 bp, Homo sapiens
  misc_feature 204, 235, 246, 277, 290, 427, 439: n = A,T,C or G
aggctacccctagagagagggcgccctggtgcgagaggaccatagcgagagaaatgatcttttactgaaatttgccctttataaagaaaacccagtggaatttctagagcaaggcccaaaaaactaagggacagctaagaaggtattatggggtgacttcaaaggcctaaaactgtgttttttatggggcactaaacgacttgnttaaaagacgggaattttgactcgcggctgnatcatacaagnaccaaatactaattttgccctatgtatccgnaaatgtcatttgngattttgacttatttatttaatgccctttcttatgccatgggggtttcaaaggttactcatttctatggggtgcaaataactctaaaacttattatataaacttttcatattatagggcagaacacaatggctaaanatctgggggcang

SEQ ID NO: 20339 - DNA, 107 bp, Homo sapiens
  misc_feature 93: n = A,T,C or G
ggcgctgatacgcaggaaccccattagaagacttgacacatggtttgatctctacagtgctataatatcacaggcctagaaagttacataagnaagcatgctaatct

SEQ ID NO: 20340 - DNA, 120 bp, Homo sapiens
  misc_feature 28: n = A,T,C or G
ggggccgagcacgcccaagatgtggagnaaagcctttactgctttccattggagaaaaaagagggctggggaataaatcatgctaaaaataatcctatttttttaataggaaggctgggg

SEQ ID NO: 20341 - DNA, 310 bp, Homo sapiens
  misc_feature 6, 37, 47, 51, 57, 116, 153, 202, 206, 245: n = A,T,C or G
ataagnaactcacatttgcataaagtggtaaaatatnaactctgtgnaaanagtganaattaaagaaggcatattgtaatccttagaaacaactgctaaaaaataacaaaaaaggnacagctaaaaagccagttgggcaattgaatgggagangaattgatcagtttaactcattaaaaaaggaaaggaaggccgggggcgnaggntcacgcctgtaattcccagcactttggggaggccgaggngggggggatcatgaggcaggagatcgagaccatcctggctaacaaggggaaaccccggctctact

SEQ ID NO: 20342 - DNA, 191 bp, Homo sapiens
  misc_feature 34, 44, 94, 121: n = A,T,C or G
cctgcctgaactaaaaatacaaaatttacctgtntatggtggcngtgcccttgcaatcccagctacttgggaggctgagcagggagaatcgctngaacccaggaggcggaggttgcatgtnagctgagatcgtgcctctgcactccagcctggtgacagagcgagactccatctcaaaaaaaaaaaaaaaa

SEQ ID NO: 20343 - DNA, 490 bp, Homo sapiens
  misc_feature 63, 72, 146, 184, 186, 201, 239, 249, 270, 338, 350, 412,423, 455, 457: n = A,T,C or G
ccctcgtagccaatgtaaagaccttccaaaaagtggaggcccaacaagaataacaaatggagncatcttcgngggccattcaaagaagttcagcggaataaaatggaaggtcgtaattttgtttataaaagggagctgcgggaggnctgcacttagcccttgtctactatgattttttccagangnggcctaaagaagttnccagaaactttgacttgaaatgttgcagatcaactatnagcacaaagnagagataacttccaaaagagngctggttttaaaaataataattaggaaatgtttatttagcacttttcaaacttttcacttttataaangacaagggcttngaaatgcagaagttatgtacaggtggatatacaggattgacaaggaggaaaaaaatatggtntcatgcagttnaaaaattactaacttaaggggttctatgggcntntaaaaaattccttcttggagggggcatcaaata

SEQ ID NO: 20344 - DNA, 210 bp, Homo sapiens
  misc_feature 38, 43, 77, 82, 119, 140, 151, 153, 202: n = A,T,C or G
aatgatgcttaaaatcataccgtgagggctttgggagngaggnggaacatgggattagcctatctcatctagaaaanagatntaaaaccaaggggggggctcaatccagggctcttccntacctttctccccctcttaantcatttggccngnctttagttcatgctgggtaagggaataaaacgagcaatcacaaaacaangcctggaa

SEQ ID NO: 20345 - DNA, 120 bp, Homo sapiens
gtaaaaaaggtcttaatatctacacattaaaatgggagaaacgtgtgggaagggggaacttaatcaaaccatggcagataaacggttataagaacagaagctttggaaagatgttttgtt

SEQ ID NO: 20346 - DNA, 145 bp, Homo sapiens
  misc_feature 56, 69: n = A,T,C or G
aggaggccagatactgtggctcatgcttataagcccagcactttaggcggccaagnaaggcaggattgnttggtaatttgagaccagcctaagcaacatggggaaaccctaatttctactttttttaaaaaaaaaaaaaaaaaaa

SEQ ID NO: 20347 - DNA, 120 bp, Homo sapiens
  misc_feature 11, 17, 26, 30, 58, 111: n = A,T,C or G
aacatttaagntaaaangaactagangaanccaagaagcaaacaaaaccccaagcctngcaggaaagaaaaaaaaatacccaagaacaagaagctgagctggaagggaggnaagggcctt

SEQ ID NO: 20348 - DNA, 400 bp, Homo sapiens
  misc_feature 1, 29, 56, 111, 285, 292, 297, 304, 337, 349: n = A,T,C or G
ngggcctgagcaagcatacaataccgctnagtattttaaatgaagtgattctaagnatttggttttgggatcaataggaaagcatatgcaggccaaccaagaagcaaatgntttgaaatgatatggaccaaaattttaagtaggaaagtcacccaaacacttctgctttcacttaagtggctggcccgcaatactgtaggaacaggcatgatcttgttactgtgatattttaaaatatccacaggactcactttttccaaatgatcctagaaattgcctagaaanatctgtnctctnacctgtnattaatcaatttttcccaggatttttatacggnaaaaattgtatngaaaacacttagtatgcaggtgaaagaggaattggggataattatgggggg

SEQ ID NO: 20349 - DNA, 400 bp, Homo sapiens
  misc_feature 250, 292, 317, 333, 366, 373: n = A,T,C or G
tttctaagtagtcaatgcaagaggaaggggagaaatcaaatttgggcagctttgtcaagctggaatattatatggggatgattatggttaataattaaaaatattgtaaatatttatttagtacagtcattcaccatgtaacattttggtcagtgatggatggcctaccatggaagtttcataagattataatagagctgaaaaaaattcctattgtcagctctactgatatcacagcccatcataaagntggagcataacatattactcatatgtttatggggatgcaggncaaacaaactcactgcatggccggngatataaaagggtagnacatacaggtatgtacagtacataatactggangacaagnattactgataataagggtactggtaag

SEQ ID NO: 20350 - DNA, 340 bp, Homo sapiens
  misc_feature 11, 71, 118, 130, 134, 137, 241: n = A,T,C or G
taaaagaagcntatttcctatgaatgaacgacatcaaatatatactactctttaaaaatttgttttcactngaactgtatgattgctatctgcagatgttctagttaagctaaaaagnaaaaactttttnaacnagnggcttttatataaaatgtgctcctgaagctacacaattttgaaagagaaccatttcttgctacaaaaactttcaaaggaatttatttaaaaaaatacaatctgngaagattttagttgggggcgactattgctcacaccatcttttcattttatgctattaattgatatggggggaaaatgcaagattcttgggtaaaagctt

SEQ ID NO: 20351 - DNA, 530 bp, Homo sapiens
  misc_feature 99, 118, 170, 277, 296, 350, 361, 404, 454, 496: n = A,T,C or G
cggcacaatagttgaagtatggaaagacagcgcatatcctgaggaactcagtagagtcacagcatctggcttccctgtaatccctttctgctccttggnacttagatttgattagctntggacaagattggaggaaatactataaagtggaacctcttgattttggcggnactcagaaacagaaaacaacttttcattggtggagaagcttgtctatggggagaatatgtggatgcaactaacctcactccaagattatggcctcggaaagtgctgntggggagagactctggagntccaaagatgtcagagatatggatgacgcctatgacagactgacaaggcacccntgcaggatggncgaacgtggaatagctgcacgacctctttatgctggatattgnaaccatgagaacatgtaaaaaatggaggggaaaaggccacagcaatctgnactacaaatcaactttatttttgaaatcatgtaaaaaaaganattagactggtttttggataaaatattttttatt

SEQ ID NO: 20352 - DNA, 200 bp, Homo sapiens
  misc_feature 21, 77, 192, 199: n = A,T,C or G
tgtcaaggcaaaacctgcctnaagtggtattatgtgttactttaaaggcaaatttgtgatctaaaagtacaagaagngatttttggagctaggattataaaatacataataaagatgtgagaagataaaatgcttttgttttggttttaatggggggattattttaatcctttcatttgaaaaaatcagtgnctcaaang

SEQ ID NO: 20353 - DNA, 361 bp, Homo sapiens
  misc_feature 5, 79, 101, 112, 139, 201, 240, 318, 336, 344: n = A,T,C or G
agaanatgccaagggggcctcccagagcttctttttcctaaattggcgggcctcacccattgctgcaatggactatttngaggacacattgaaggcagaangggaaagaagnaggcaggaatggagcaggtcgctcctnccctgataagagtggccccaaggggcgctttaagggatctgcccacagcttcccccatagangattcatgagcaggtcagggcacttagcaatgtaaaaanaaatctaactctcatttgacaagcggagaaggaaaggtaaataccagaaaagcttttgaattttggattggttgcatncccttgccctcaataaanaaaggtcnttttttaggtccaaaaa

SEQ ID NO: 20354 - DNA, 325 bp, Homo sapiens
  misc_feature 14, 20, 30, 38, 57, 153, 203: n = A,T,C or G
tgatgaatgaaagntaaagngagtatactngtgggagnaggacttccaaatgtgggnacctcagctatatcactgcccaacatcagaaaacctgacggctatgattactatgccttttctaaagatcaatactataacattgatgtgcctagnagaacagcaagagcaattactactcgttctgggcagaccttatccaaagnctggtacaactgtccttagactgatgagcaaaggaggagtcaactaatgaagaaatgaataataaattttgacactgaaaaacattttattaataaagaatattgacatgagcccaaaaaaa

SEQ ID NO: 20355 - DNA, 480 bp, Homo sapiens
  misc_feature 79, 86, 105, 176, 180, 238, 257, 312, 335, 392, 399, 405,427, 473, 480: n = A,T,C or G
ttttttccatctgggtgcaactaaactgactctgttattgatcccttctcctgccctttcccaggtaatttaaattggncatgggnagatttttttcatagattngaaaaacttttagggggggaccaagtatgaagtataaatctggggaagaggttttatttacattttagggngggnaagaaagccccttggtacaaatttttaatttccaaaataatctatattaaatgagggnttctgatctgactttgggnttagctaccttttatatttaaaaaataaaaaaggaaaatacggtcttacaagctnaaagcttgatttgatctttggtnaaagccaaaaggacttaaatgaggacttagatgcataaaattgcaggtcatggatgnatataancatgcncatgatatttagtacggataangcttctgaggagtttactctaaatcattgggtaaacattgggctgntggtacn

SEQ ID NO: 20356 - DNA, 528 bp, Homo sapiens
  misc_feature 24, 118, 286: n = A,T,C or G
gaacttgaagaccagttttttganttaacccagtcagacaaaagcaaagcttcagaaactgtgggattatgtaaagcagccaaacctacagtgtattggcatttctgagagagaacanctttaaactaagtaaattggaaaacatatttcaggtcataattcaggaaaatttctccaatcttgaaagaaaggttgacatgcagatacaagaaattcagagtacacctgcaagatactacataagacaattatcccaaaggcacatagtcatcagactatccaaggngaaagtgaaaggaaaaatcttaaaagcagctagagaaaagggccaaattaactataaaggaaatcctatcagattaacagtggacttctcagcagaaaccttacaagtcagaagagactgggagcctattttgagcctcctgaaagaaatgccaagcaagaatttcatatcccatcaaactgagcttataaatgaaggagaaataaaatctttcccaggcaaaaaaaaaaaaaaaaaaaaaa

SEQ ID NO: 20357 - DNA, 200 bp, Homo sapiens
  misc_feature 12, 63: n = A,T,C or G
tcttccagaagntaaaggttgggggggcgttcttcgtaaagataagggatcagttcatcaagnaagaatacaacagtcctaaatgtgtaacttttataaaacagtatacccaacaattgcagaatattgttttaagtagacatgaactgctcaacaatatagaccaaatgctggaccataaaataagtcacactaaattc

SEQ ID NO: 20358 - DNA, 110 bp, Homo sapiens
  misc_feature 3, 30, 37, 39, 64, 66, 83: n = A,T,C or G
ggnaatctggctgcttctttgtataattgnccagaananaataaacactgcttcccgcagaatntntaaaaaaaaaggtccgnagaagcaaaaactgttccaggaaggat

SEQ ID NO: 20359 - DNA, 100 bp, Homo sapiens
  misc_feature 42, 52, 85, 87: n = A,T,C or G
cagtaaatttctaaagtgatgaaagaaaaccttggaactggngggggaaagncaacaattcccaaatggcccttggccccatttntnaaagatggcccct

SEQ ID NO: 20360 - DNA, 184 bp, Homo sapiens
  misc_feature 114, 137, 153, 166: n = A,T,C or G
aatccatcttaaagtttgatttgatataatcttattgaaattaccttatcatgtcttagagcccggcttttatgtttaaaactaatttcttaaaataaagccttcagtaaatgntcattaccaacttgataaaggcnactcataagagctggnttggggctatagnatatgctttttttttttt

SEQ ID NO: 20361 - DNA, 357 bp, Homo sapiens
  misc_feature 9, 17, 39, 99, 121, 129, 143, 148, 182, 251, 275, 287, 316: n = A,T,C or G
ccctaacantaacagcntttaaacaaaactaggctggtncccggaaacccctgggaaataagaaattgtttaccttttaataccaagaaaggttggggnaaagcaccaaaaatctgcatgngggtgttnttcccaggcaggancttcnaaggggttcggggcgggtaaagaacctaaaaggncttatgagattgtccaaaacaaaggaacatgtcagccggggccctatggtgggtccatgggggctaaangtgttcggggacaggatcaagcgngctttccttatngaggggcagaaaatcgttgtgaaagtgtngaagggcacaaagcacagtagtcccggaaggcttaaaaaaa

SEQ ID NO: 20362 - DNA, 110 bp, Homo sapiens
  misc_feature 43, 86: n = A,T,C or G
aatagtgaaattaaaaatgttttcactagaaatgcctttttgnaccttcctgtaggaaaatcttttcaacaaaaaaagctggaagncataataagttacagattagcaaa

SEQ ID NO: 20363 - DNA, 582 bp, Homo sapiens
  misc_feature 15, 97, 177, 291, 414, 489, 525: n = A,T,C or G
ttccagcaacttttntgatgtagcagcctctagatatacaagaagggatatggtgagaccttgaacttcagctttctgtaattccactggtatatgntataacttcacaggctaacttttctctatacataaaaggggggtaattgtatccactgtcaacttgtgaggaccgaaganaatcaaatgggaaatggggagtgtgtggttaacactttggccactgcctggtaatggcgattcagtcactgctaacacagaattagaaatgacacgtgttatgtattttctggncacctgagaatagtcagaaccattagcattgaaagccatgagggccttgggtcaagagtagcttatgatgacatttattttataggtaaagaaggggggcagaatagatagaatggtacaggnaagggacacacattattttctttattaaagaggctttcttgcttgaaacatttttgaaaatgcactggcaggggngggggctcacacctattatcctagcacttttgggangctgagggggagcttggcacctagcaggacatatctcttaaaaaaaaaaaaaaaaaa

SEQ ID NO: 20364 - DNA, 386 bp, Homo sapiens
  misc_feature 10, 20, 122, 212, 267, 333, 344, 356: n = A,T,C or G
aagcaaatgnttggaaatgntatgaccaaaattttaagtaggaaaggcacccaaacacttctgctttcacttaagtgtctggcccgcaatactggtaggaacaagcatgatcttgttactgngatattttaaatatccacaggactcactttttccaaatgatcctagtaattgcctagaaatatctttctcttacctgttatttatcaatnttttcccagtatttttatacggaaaaaattgtattgaaaacacttagtatgcagntgataagaggaatttggtataattatggggggggattattttttatactgtatgtgccaaagcttnactactggggnaagacaactgtnttaataaaagattacattccaaaaaaaaaa

SEQ ID NO: 20365 - DNA, 350 bp, Homo sapiens
  misc_feature 39, 53, 133: n = A,T,C or G
aacagatttcgtcttgttttgcttttgtctttgagtttnacacctaatctgtngttctttcttctactgtcattcattgcctctcttaccatagtaatggttatttatactattattcacaataatggctatncataggcacaccgcccttttataggttaacatctgtttaatgcttaagaagatacaggagtcattctttatgaaaactcttaccacactaggatataaggcacctttcttagtttgataaagggaatcatcatcaacaacaaaaaacctcagcattattctaaatgggaatattttgaaagtttcccattgagtttgggaaaaaggcaaagatgtct

SEQ ID NO: 20366 - DNA, 670 bp, Homo sapiens
  misc_feature 13, 26, 44, 60, 153, 177, 198, 410, 549, 583, 592, 646: n = A,T,C or G
gtccagaaatgangccaaggaaaggngtgaagttcgatgaaagngagaaaactaaggagnagtcgtgaagcagttgagaaagaaatttgagcctctgctgaattggatgaaagaataaagcccttaaggacaagattgaaaaggctgtggggnctcagcgcctgacagaatctccgngtgctttggtggccagccagnacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaagatgataaaacagttttggatcttgctgtggttttgtttgaaacagcaacnttcggtcagggatcttttaccagacactaaagcatatggagatagaatagaaagaatgcttcgcctcagtttgaacattgaccctgatgcaaaggtggaagaagagcctgaagaagaacctgaagagacagccgagacncaccagaagacacagagcaagacgaagatgaagnaatggatgngggaccgatgaagaagaagaacagcaaggatctacgctggaaaagaagaatggnaaatatactctcacatttgggtcc

SEQ ID NO: 20367 - DNA, 500 bp, Homo sapiens
  misc_feature 19, 26, 44, 86, 88, 90, 191, 203, 236, 265, 276, 304, 309,375, 424, 430, 435, 437, 439, 481: n = A,T,C or G
ggttcttaaacctggcggngggtggnatggagcttcctcatggnggaaaaaatggatttaaaagaaaattgggggaaagggcctcngngncccgaattaatacccacagaagggccatgcttttaggataaaaaagaaggggacttaaacagcctaaaggttaggtttaaaaggtggagggggaataaaanaatttggaggcngaccttttaaaaaggggattaaaccgggggggntaaaagaccttggaatccatgacgcgggnggattgcgcanttaaagcctagttacgcatttcctaacncagcnaaatggaagattattgggggggaggggaacattggagagaagagttgagggaaactggagcagagncggagcgagaaagatgggagttgggattggagaaaaaccactttagagnaaaggnaattnancngaaaggggggcgagaaaggcagctgacaaagctaggcaaagncaacttgggaatggggtgg

SEQ ID NO: 20368 - DNA, 430 bp, Homo sapiens
  misc_feature 12, 19, 58, 89, 92, 182, 296, 353, 374, 384: n = A,T,C or G
cggagggcttgnttcagtngaaataacattgcctttatacacatttgcttctcaaggngggcaggagttgggaagcgaccgttgtgaanggntaaagaattttctggcagagggaaagggattttttttctccctccctgccgaggaaaaaacaggtctaacgaggagttacttttgtaggntttaactcatattcaaatactcccagccgagaagctgccatcgatcctcccatggacccctgatcctgggttggaggacttttcacagctctctctccctccctcaaaccctgngcaatgaggttgcagaagagagtcttcccgagaaggcagaacggggactcatgaagnggcagctaagccctgtccagnggccacccgncagccaaggccaggagaccaaaaaaaaaaaaaaaaaaaaaaaaaaa

SEQ ID NO: 20369 - DNA, 100 bp, Homo sapiens
  misc_feature 27, 36, 52: n = A,T,C or G
cccgtggcggccatacctggtttacangggttctangatcaaagcctcattntgccatttttggaatgcttaaacagcttctaattttccctatattaac

SEQ ID NO: 20370 - DNA, 443 bp, Homo sapiens
  misc_feature 38, 171, 224, 302, 316, 318, 341, 348, 354, 407: n = A,T,C or G
ccttcacaaaacctgttgtggacaaatgaaaaactagnccaactgggcagaaagaaattcttgtcaaggaggagagctcacaaatagattagaaaatccagaaacagacctaggtttcagcaggaaaggatagtgttaggacaaatgatacaggacagctggctgacaagnaaaaaaaatttctgtcaccatataacaaaattaattctaaatggattacaagnttttacataaaaactaaagtaataaatgtactagaagataattttttttttgaagtatggcactaaaggcagaaactntaaagggaaaatgngngatggaattagctaaaaaaaagnaacagcntaagcnaaagtacatgacaaactgggtaaaaacagttttcaacatatctctaatgtacnccgagcttttacacgttaataggaaaaaaaaaaaaa

SEQ ID NO: 20371 - DNA, 540 bp, Homo sapiens
  misc_feature 22, 68, 119, 191, 205, 230, 257, 260, 288, 318, 367, 516,522: n = A,T,C or G
agcacctgaaagatgctttttncaaaggtaaaaagtaacactgaaacgttaatcggctggctttctgnatgacgctgatcttgaaaacatggctcaatataggagaaatgaacatggangtcgcagggaagattaagcgagagagaatagatataccaaagaagggagtagctggacttaggctagactgngatgctaataccgnaaacctagcaagagagagctctgtngacggaccggacagtgtatcagcacanagnggagcttctgttcagcccctagtgtctnctgtaaggcccctaacatcaggagatggtnaggtaacaagccctgcaacaccatcccctgatgcaagcacttctctggnagactcttttgctcatttacaactcaggggagacaacacagctgaaaggagtcataggggagaaggagaagaagatcataaatcaccatcttcaggcaggtaccagcaccagacacctcattgaagaaactgaatcagatgccagtagngatagngaggatgtatctgcaggt

SEQ ID NO: 20372 - DNA, 423 bp, Homo sapiens
  misc_feature 15, 86, 111, 121, 290, 332, 334, 361, 405: n = A,T,C or G
aaagcttctgcattnttgaatttaagaaaaataaggaatacatgtttaaaatatgaatattaatctgacatatttctgctagaggnggattatattaataatttaccaggntattttgagntagtattttttggaggggggcctcttggaatttaacatttactaatatataagcatcttgaaaaccagaattgtatttacaaggatgaactctatagtcaaataaatattaagttagcaattagtaagggttagagacaagattaaaaaactcagtagggagtcgcagnagttgagggggatgtggccccccagaagccccacctggggangngcacacccttgtataatccctttccgntgaggatgggctggacctcatgacttgcttctaatttagagatncaaaaaaaaaaaaaaaaa

SEQ ID NO: 20373 - DNA, 253 bp, Homo sapiens
  misc_feature 10, 63, 85, 114, 115, 121, 138, 153, 171, 208, 209: n = A,T,C or G
cacagcacgncagaatcatgaggtcaggagaatcgagaaccatcctggctaacacggtggaanccccggtctctactaaaaatgnaaaaaattagttgggcatgggggcacgcnncctgtngtcccagctactttggnaggctgagggggggngaattgcttgaacctggnaggtggaggttgcaggggagctgagatcgtgccactnncttccagctggggcaacagagcaagactccatcgcaaaaaaaaa

SEQ ID NO: 20374 - DNA, 506 bp, Homo sapiens
  misc_feature 10, 42, 63, 111, 200, 246, 334, 339, 381, 456, 479: n = A,T,C or G
cactgactancgaacagacctgagttttatttaaaaacacantttagctttgcaaacagaagnagtaaaggaaaccataacttataaatttgtaatgtgttcctccttggnggagacattagccagtgtttagttttagaccaacttatacaaacagagtattgatttgtacacattctggagacttgctatatcatggnttgctatggcacagactcaacttagcatggggacattttggaactncattcaaaggtgaggagttactggaacctttgacattgccttgtaatgaggtacttccaaaaaagacccctaacaatggcataatagngaggnctctctgtgcatatacataatatatatgcaggataaatgtgngcaccaatcaaatctaaaattttatgtgactgtcaaatgaatattatttggggtaagatttttcatttctgattnggatagaaaatgctattaatctngattaaaatagttttaaaaatcgaaaa

SEQ ID NO: 20375 - DNA, 341 bp, Homo sapiens
  misc_feature 9, 39, 55, 73, 147, 148, 256: n = A,T,C or G
ggctgggtncttccagtttggctcagaattcttcagggnaagcccagataagaanaaacagctctctatactnaatccttactttgctgagaagatacaggcctgccacttcgctcccacctgctcttcatgaggagtcctttattnntgcatgtttcctgttctttgggacctttaggagctaacctccacagatgctgatagtctgtagagtcaggaataccatgtaacatgttgaagtagactaaagattagntctttggcaatagcccagtctggacttactatgtacttttgaaaataaaactgcttatttgtaaaaaaaaaaaaaaaaaaaaaaa

SEQ ID NO: 20376 - DNA, 358 bp, Homo sapiens
  misc_feature 20, 38, 39, 46, 50, 85, 110, 144: n = A,T,C or G
aaaccatgttttggtggatncaaaatggtaattaaatnnaaaaatnaggnaagcaaacaatatctgggaaaatttcagtttattnggggaaactaaataaaatacctctnaaaataactcatgggtcaaagaaagaagccatangggggaatgagaaaaatattttggaactgaaatgaaaaattgacaacggaacatattccaaatttgtgatacgggacctaaagcagtatttagaagggaatgtatagcattaagtatatatattgggaaaaggggaaagggttaaaattaattacctaagctttccccttgaaaaactagaaagagagcagcatagaaggttaaacccaaaggt

SEQ ID NO: 20377 - DNA, 321 bp, Homo sapiens
  misc_feature 87, 105, 217, 277: n = A,T,C or G
gctcaataacttagacttgtttgacaaagctacctatgataaactctgtaaggaagttcccaactataaacttataaccccagctgnggcctctgagagactgangattcgaggctccctggccaggcagccctttcaggagctccttagtaaaggacttatcaaactgggttcaaagcacagagctcaagtaatttacaccagaaataccaagggnggagatgctccagctgctggtgaagatgcatgaataggtccaaccagctgtacatttggnaaaataaaactttattaaatcaaaaaaaaaaaaaaaaaaaaaaa

SEQ ID NO: 20378 - DNA, 274 bp, Homo sapiens
  misc_feature 19, 45, 56, 62, 215, 234, 246, 255, 261, 263: n = A,T,C or G
aaaaactggaaacagcagnttttctagtatggtgcattcaaaatnccatggttaangtaagnagagaggaaatgagataagaaaattattcctaaaattgttaaaaaaacaaaaattactcagtgtaagtagattgtagcagaaataagtcttgctaaataagtaacatttatttatgttgggccattaggagagaataataaaaaagctgacgntaatgaatatttcattggnttcattcctatngtaaaaagnataggntnttatctaaggg

SEQ ID NO: 20379 - DNA, 132 bp, Homo sapiens
  misc_feature 14, 25, 27: n = A,T,C or G
tgggatgagccagnggcaaaaagcncncagaaagcccactatctcatttaatctttacaactctcttgcaaggttccctggcggggaaaacacatgagaaaaaatcatgaaggccacctatcatcctccttc

SEQ ID NO: 20380 - DNA, 220 bp, Homo sapiens
  misc_feature 5: n = A,T,C or G
gcggnaacacagaagggggtggtggtcataatccaaatgaattaacacaggaagagaaaaccaaatgccgtatgttctcacttatatgtgggaggaaaacattgagcacccatggacataaacctgggaacagtaaacactgtgaactagcagagtggggaaggaggaaaggggatagggtcaaaaaactacctattggatactatgcttactacctggg

SEQ ID NO: 20381 - DNA, 276 bp, Homo sapiens
  misc_feature 52, 70, 86, 265: n = A,T,C or G
catgggccagccaggactgagtagtaggatattttaaagaacatgcaagagnaaagtgaaccctgtcatnataatggggccactgngcaaggttcctctgaaagctcctcatcttgcagaatttatttcaataccaaggtatgggttgaaccaggtggggagcgcttaactctattgagggccccattactaatggacttttaactggattggatggggtttaactggccagggtgtgggatttgacctcttgagggctccattnggccctggggc

SEQ ID NO: 20382 - DNA, 321 bp, Homo sapiens
  misc_feature 90, 253, 281: n = A,T,C or G
ggtctggacgttttttgagcgttgcttcgcaggctaagtagtcccgaatgttccccagaggccggcctaagggacgacaagtaagaatgnaggacgcttggaaaagttcggccaaagaaaagaacaaaggacccagtgaacaaaatccgggggcaaggccaaaaaagaaggaaggggtccaaaaggcaaagttcgggaaaagctcaataaaccttagtcttggtttgacaaagctacctatgataaaactctngtaagggagggtccccaactataaaacnttataaccccaggctgggggctcctgagaaactgaaggat

SEQ ID NO: 20383 - DNA, 260 bp, Homo sapiens
  misc_feature 31, 135, 150, 208, 229, 241: n = A,T,C or G
gaaagggcaaaaccttttacttggttgcatnggaaatcagccaagttttataatccttaaatctaaatgttcctcaaagcttggattaaatacatatggatgttactctcttgcaccaaattatcttgatacatncaaaggggggctggntaaaaaataggggggaggatattgaggccaagaatattgcaaaatacatgaagcttcntgcacttaaagaaggattttnagaataagaatntgcatacttacctagggaa

SEQ ID NO: 20384 - DNA, 167 bp, Homo sapiens
  misc_feature 42: n = A,T,C or G
acttacctttgaacagctctatatgacaaaaataaatgcctngctggctttttttaaggaaaaaaaaatttttttaatttacagtagcaacaaaactataagatacttagaaataaatctagacactcaagactggtaaagaaaatcataaaactttattgaaaaac

SEQ ID NO: 20385 - DNA, 210 bp, Homo sapiens
  misc_feature 30, 38, 60: n = A,T,C or G
ggaatagcagctcacagcccaaagcacttnctcaagangctcttggttagatttcagcanagtatcaagtccaaaggatggctaaattcaactcatgggtacagggacctgagagctggggacagcttggccacaggcagccatgaaaggagcggggagccctcaaagctctccgcgaagattatttgcagggttctgctggaaacacag

SEQ ID NO: 20386 - DNA, 214 bp, Homo sapiens
  misc_feature 9, 52, 54, 92, 120: n = A,T,C or G
gcgagtttngtcaaggtgcacagaatgtgagaggcccccagaaaaccgaagnangccactctggagaaaaagcttgccataaaggagctaancccacctgaaaattcctacccacggacnccctttctcacttcagactcacatccccactcaaaatgagaaaattagaaaagggaggatgggggaggagcaccccgagaaaaaaaaaaaaaaa

SEQ ID NO: 20387 - DNA, 282 bp, Homo sapiens
  misc_feature 25, 52, 167, 168, 206, 250: n = A,T,C or G
ggggctatagctaaagaaatgtatncccctgaaaaaattacagcccccttgnaacaaaaatcatttgtaacattggatatgaagccattattagtatttaaaataatcgaggtcatttgatcataaatgaaggagcttgcaaaatagacttggtctttggacccttnnagggggaacttgacgggatgggttggtgtttttcaagnctgattttaggcagttttaatgtatcggggtaccaatgatatgnaaaaaaaagcaccttttctactataaaaaaaa

SEQ ID NO: 20388 - DNA, 179 bp, Homo sapiens
  misc_feature 4, 11, 96, 115: n = A,T,C or G
gggnacaaagnatattgcttagcggttaagtttttaacgtaatttaaatagcttaagaattttaagagaaaatatgaagacttagaagagtagcangaggaaggaaaagataaanggtttctaaaacatgacgggagttggggaggaggcttcttcatggagtaaaaaatgtatttaaa

SEQ ID NO: 20389 - DNA, 229 bp, Homo sapiens
  misc_feature 193, 219: n = A,T,C or G
gtacatacagccaaaataccccaccgactgggttacactgccccggggaaattctcaatgaggaatggcaggcccttaacctgggacttcaagcctgaagaccagccccattttgacatcaaggaatgagttctggatgttccccctgcaggaagaggtttctttgggaccgtgaggcaggaagacactaggngctggaaactcctgcaaaactgctgnctggaggccc

SEQ ID NO: 20390 - DNA, 300 bp, Homo sapiens
  misc_feature 26, 81, 149, 263, 287: n = A,T,C or G
tgcactcaacactggcaccacccagnatatataaagtatatattattaggggctagagagacagactccagtacaataacnggagacttcagcttcccacatgcagcattgaacagaggggccagacagaaaatcaacaaagaaacatnggggcttaatctgaactatagattccatcctatagaccaaatggacctaaaagatatttatagaacagttattcccaatgactgcaaaatacacattcttctctgcacatagancattctcaaggatagaccatatgntaggccccagaac

SEQ ID NO: 20391 - DNA, 131 bp, Homo sapiens
  misc_feature 33, 55, 65, 105: n = A,T,C or G
acggaggttaggaagatcgggaactatcctggntaacacggggaaaccccgtctntactaaaaanacaaaaaataagccgggcgggggggcaggggcctggaagncccagctactcgggaaggcttgaggc

SEQ ID NO: 20392 - DNA, 197 bp, Homo sapiens
  misc_feature 77, 95, 125, 134, 139: n = A,T,C or G
catactttatgatgaaacactgctctctctctgacatcaggaacaaggcaagaaatttctgctctcaccactccagnaaacaacgggctgaaggnccagagcaacttcactaagccaagaaaaancagatgcangcagnttggaaagaagtaaaactggctttattcataaaatgaggggatcggggggggtaagga

SEQ ID NO: 20393 - DNA, 214 bp, Homo sapiens
  misc_feature 125, 137, 162, 172: n = A,T,C or G
gggatgggcccaaaagaattttctatcatacatcaatgtatgtaaggcagggggctaagggacttgtgcctgtaatcccagcatgatcccagcaggggggagggtgaggcagggcagatcacttngaggccaagagnttaaaatcagcctggccaacatggngaaccccatnggctactaaaaatacaaaaaaaattaggtgggggggggcggg

SEQ ID NO: 20394 - DNA, 156 bp, Homo sapiens
gctgagccacaacccccacggaaaaacagcagtggattaacctttagcatataaacgaaagtttaaactatagctatattaaccccaggggtggggcaatttcgggccagccacccgggggcacacggattttacccaagtcaatagaagccggcg

SEQ ID NO: 20395 - DNA, 232 bp, Homo sapiens
  misc_feature 81, 82, 119, 184, 225: n = A,T,C or G
gaaatggagaaattgtttgggaggagtgcttcagaaggaaaggccccacaacaaacgccctgcgaagtaaaaggagcatgnntctaaccccaacgcaaggaaagccaagaaacctgganaaaaggttaggaggaatggcgaactagaaaaaaccaggtgagagaaagaacataaaggaacctgnagggagctgaaaaaaacagcaggaggaaggggggaaagcgnacataag

SEQ ID NO: 20396 - DNA, 210 bp, Homo sapiens
  misc_feature 4, 36, 56, 71, 77, 85: n = A,T,C or G
ctgnacctgagccggtgctagaggatacaactcctntgctttcacatctctgagcnatatccctcattagngaaggngggttttngctttatagtttggctggggagcacttaattcttcccattttaaaaggtaatgttgcctggggcttaacccacctgccctttgggaagggtggggaacaaagccatctggggcggtaaggggaaa

SEQ ID NO: 20397 - DNA, 120 bp, Homo sapiens
  misc_feature 9, 22, 45, 81, 82: n = A,T,C or G
ccaacactnggggggaaggtgnaaaacccggaaggggaatagcanaaactttttggaggactgtataggacagagaaggcnnatggggcctggggcggagcagatatttttggttgacag

SEQ ID NO: 20398 - DNA, 305 bp, Homo sapiens
  misc_feature 5, 49, 128, 198, 216, 253, 255, 275: n = A,T,C or G
gggtnaacctatattagtcctctagacaacaattagctttttataatcnaaattggaattttatatgaatttaattgcctatactgctaacatcattgggaaacaggcatttatagggtaatggaatnaaaaagggaatttcttacaactattcatactcaatgggggaaaacctggaaaggtttttctctaagaccnggaaaaaggcaaggatgncctctctcaccacatctattcaatataggattggaangncctagcaaaagcaatccagnaaggaaaaggaaaactatcttatatcatgc

SEQ ID NO: 20399 - DNA, 125 bp, Homo sapiens
  misc_feature 110: n = A,T,C or G
aatgatttcgaccttaatgtttaaatatcctaggcatctgctggaaaaaatatttaagaaaaatgtttggaatttaaaaaaaaactggagtaactaatttgtataacccnatatctgggcaatgg

SEQ ID NO: 20400 - DNA, 430 bp, Homo sapiens
  misc_feature 36, 48, 65, 73, 225, 319, 325, 358: n = A,T,C or G
aaaaacccgtaagtacttaggaaagtctactctttntgataggttacnaggtgtttgaagaaaanccctcttnattaccgagggagaagtactttggcagtcatcttgatttgggaaaaatgaaaacaaagagctttacagagaattaaagggagaatttttatgaaagaaattaaacctgctaaagaaccttctaattgccacccttgaggcattcaaaaaganggcaatttgggaacttgaagactttttttgtcaggataagggatgcgcatcaaaagggactgaaaaaaaaagaagttatgtgggcaagggaggnggggcntcacacctgtagatcccagcactttgggaaggntgacgcaggtggatcatctgaggtcaggagtttgaggaccagcttggccaaacatgatggagaccgcattct

SEQ ID NO: 20401 - DNA, 355 bp, Homo sapiens
  misc_feature 12, 19, 48, 53, 299: n = A,T,C or G
gtgaggggttanaagctcnaggaaaagacccccaaatgcataaaattnctggnacaataaataatccttacttcccctaaaaaataccaggactaaatgccataacaaatatggaaagaaaattatgctaaaatgagtaacaaggaagaaacctgtacttctccaagcacaagtgttagccaagttggacaaaccattggcaagggagggagcccaaacaaagggggcaatgggagttaaaaactgagaaaaatccacaacagaacaccggtacccccacactggggggcatataaggnaagggctaaaaagaaagggaaggaactcggcaaacacaagcctcgcctgtttacca

SEQ ID NO: 20402 - DNA, 112 bp, Homo sapiens
  misc_feature 15, 42: n = A,T,C or G
ggagtttactagttncaagaaccccagtgctatagcatatgnaaggcacacaagttaccttccctctcattttgagaggatacacacacatgcacaggcacacatacagaag

SEQ ID NO: 20403 - DNA, 320 bp, Homo sapiens
  misc_feature 11, 25, 172, 174, 220, 235, 294: n = A,T,C or G
tcaacaagaangccgccctgtgcgngggggtgacaggctccaaacaggcatgcgaggttgcctttggaaagccccagggcactgtggccagggttcacatttggccaagttatcatgtccatccgcaccaagctgcagaacaaggagcatgtgattgaggccctgcgcaggncnaagttcaagtttcctggccgccagaagatccacatctcaaagaagnggggcttcaccaagntcaatgctgatgaaatttgaagacatgggggctgaaaagcggctcatcccaagatggcntgggggggcaaagtacatccccagtc

SEQ ID NO: 20404 - DNA, 420 bp, Homo sapiens
  misc_feature 222, 341, 344, 390, 402, 403: n = A,T,C or G
taatagtttttttgggcatattttcacatactgaacttggctaaacgctgtaacttgccaatttatgtctttgcctgtgttcctttaaaaaagcttttaaaatataagaattataagattcttaaaaaataaaattctagatagtagtcctttggtataaatggacttaccttctcccatattggatggatgttgatattggcatatgaatacgttaaatgnggatacaatcatagctttcattattacctaataatcttttaaaattttatttttttactaagactcttgggtttctaaggcaatcaggggggggtcaacctgcaaataagaataatttnggnttttttctaaaatataggggataatttttttaaattattgggaatnggaatagaggcnnccaaaaacaagggttag

SEQ ID NO: 20405 - DNA, 200 bp, Homo sapiens
  misc_feature 22, 24, 30: n = A,T,C or G
gtgtaattacacaaacaggatntntttggnttactacacacctaggctccaaacctgcaccttggtttactgaactgaatattgtaggcaattataacacaatggtaagtatttatgtgtctgaacatatttaagaagaggtacagtagaagaatttaaaaggtacagtaaaaatacattttataaaaaaaaaaaaaaaa

SEQ ID NO: 20406 - DNA, 320 bp, Homo sapiens
  misc_feature 58, 75: n = A,T,C or G
aagccctgatttgaactcatacaaaatttttttcaggtgtggtggctcacgcctcccnatcccagcactttgagnaggctgaggtgatcacttgaggtcaggagtttgagaccagcctggccaacatggggaaacctcatctctactaaaaatagaaaaattagccagcagggtggtgcactgacttgatcccacctactcgggaggctgaggcacaagaatcgtttgaacctgggaggcagaggttgcagtgagccaagactgtgccatggcattccagcctgggtgacaaagcaagactttgtctcaaataaaaaaaa

SEQ ID NO: 20407 - DNA, 338 bp, Homo sapiens
  misc_feature 7, 21, 89, 133, 180, 247, 285, 298, 300: n = A,T,C or G
ttactgnataatgatcagttntgtagggcttccctttgttataagaccctataggttatgattgatcaaatttacgttttactaatggnaagggtgagggtcatagggcaggttttgggttttctagtactgntgaaaactgcaagtattggctatttgtatacttagccataacttggngaaaaaaaacctgagcagggggtatggattaatgcgttggaaagaaagctgcttgtgtttgctttgntaattgcctcaggatatttcttttaaaataagctggtntaagaggaacagnangggaaatctgctacctagtctatacacagggggaacct

SEQ ID NO: 20408 - DNA, 298 bp, Homo sapiens
  misc_feature 151, 241: n = A,T,C or G
tggcgcctgaatgccaaactccccaggagtcagaaggcttgcttgctctgtgcagaatttttaattttcttttttggccctaggctggttgggacctctacagcttcattctttcaccattaaatagtggcctttttcagtattttccctnttcccctttataaattatgctaaagcgacaaagcacatttttggggatcatagaaggttggggttccaagaaaggcatctgtgtgatggntccattgatgtgggatttccctacttgctgtattctcagtttctaataaaaagaacc

SEQ ID NO: 20409 - DNA, 288 bp, Homo sapiens
  misc_feature 19, 24, 155: n = A,T,C or G
ggatcatgtagtcaagggnagccnaaataaaaggaagccaagaactagaagcctagctctctcatgcttaacacatgtgtaacaacacttcaaagtgagactgaggaagcttaaatgtgagatctacttaggggataatgaggaaatgagagtantgagaaactgagcagtcagaaactatctttgaaggaaagaatttgtagctaagatattcttcaaatgacagataatttctctaaatgtatgtaatgataaattggaagttttagaaaaaaaaaaaaaaaaaaa

SEQ ID NO: 20410 - DNA, 120 bp, Homo sapiens
  misc_feature 103: n = A,T,C or G
tgggtgggagaaacggctagaaacatcccaaggaaaggcagcgagccgcgcaaaaattaacccactcccgaacccggggtaggtaggtggccggctttataanataaaaaaaaaaaaaaa

SEQ ID NO: 20411 - DNA, 210 bp, Homo sapiens
  misc_feature 53, 68, 95, 101: n = A,T,C or G
ggaaaccatggaagagcctgatccttcttgccatcctggcccgccttagcggngagtaacttttgcgntatgaatcacatgaaagcatggaatcnttatgnaacttaatcccttcattaacagggggaattgcaaaataccttcatatcccccttaggcggggggtggaagagctaaaagcccaagaggggatccggagaccgcttctaa

SEQ ID NO: 20412 - DNA, 430 bp, Homo sapiens
  misc_feature 120, 150, 177, 321, 324, 339, 383, 425: n = A,T,C or G
ggcaaggggtgagaactactggatattataatcaatgcctgtgtgacaggatcaattgtaccccaaagctcagcataatgcaatatactcaggtaataattctgcacatgtacaccctgnatctaaaataaaagttgaaattatttatangaaaaaaaagaaactaaggtcagttgngggggcttacacctgtgattccagcactttgggaggccaaaggggggaggacagcttgagcttaggagttcaagaccaacctgggcaacatggggaaaccccatctctactaaaaatacaaaaattagctgggggggggcctgnggnccccagctactcagnagcctaaggggggggggatcacttggagccccaggggatggagnttgcaggggagcaagattgcgccactgtactccggcctgggngacgg

SEQ ID NO: 20413 - DNA, 338 bp, Homo sapiens
  misc_feature 40, 145, 165, 167, 226, 250, 296, 325: n = A,T,C or G
gaggcagattttttggggataaaattcaacataacctccntggataaaaactctcaaacaattaggtttagaagaaaggaacacacttcatcttaataaaggccatatatgacaaatccacagctaatattgtaccaaacagggnaatgttggaagttttttctntnaaaactggaacaagataaggatgctgaccctcactactctcattccacatagtactggnaggtctagccagagcaattaggcnacaggaaagaaataaaagacatcccaaatttggaaggaataaggtnaaattagacccatggtttggcaggatganattcccttcttaa

SEQ ID NO: 20414 - DNA, 152 bp, Homo sapiens
  misc_feature 13, 31, 59, 70: n = A,T,C or G
aaacccatgtggnagtaaaggcaatcatttnttgcagtatccagaaagaacacagcccntagcaattagnacaaggaggctgatgccacccactttgggaggccaaggtgggggaggatcacatggaaggccaaggagtttggagaccagcc

SEQ ID NO: 20415 - DNA, 374 bp, Homo sapiens
  misc_feature 150, 334, 360: n = A,T,C or G
ggaaaaaaacatacactctagaccccggggttcgcaactctttttggggctagcaataatgatatttaaagcaataattttttgtatgtcatactccacaatttacatgtatatgtacagccatcaaacacataaacatcaagatatttngaaggactctaattgtctttccttgacaaggggagtttgcaattgtggaaatagcaaataacaatcttggattctaacataaactgcagctgtctgtatgtgttttaactattacagtgcatgttagggagaaattccctggatttcttttaggttttggattcaaacaattatgccactcgangcaacaaacattattaaatgcacaanaaaaaaaaaaaaaa

SEQ ID NO: 20416 - DNA, 400 bp, Homo sapiens
  misc_feature 151, 228, 273, 397: n = A,T,C or G
aaagcattgagttctctcagggccttgcatagacataaaaggactcactggagagatactctataaatgtgtgaaatgtagggaagtattctttaatgttatttcatttcagatagaaataattctcattggagataaaccctatgaatgngaaacacatagtaaagccttaattttaagcctcagtttctttcaaatacagttatcccctaatatttgcaggagcgnggttctaccaccccctgggcatacataaatcgacacatgccaagncctttttttaaaaatgacatatttggacaaaattacccggatgtgatggcacatgcctgtaatcccagctactcgggaggctgaggcaggataatcacttgaatcccgggaggcgggaggttgnggt

SEQ ID NO: 20417 - DNA, 382 bp, Homo sapiens
  misc_feature 12, 25, 104, 147, 148, 174, 175, 176, 195, 338, 345: n = A,T,C or G
gcccaagagaanaaccccggaggcntaatttggaccttactcatccagtagaagatggaatttttgattctggaaattttgagcaatttctacgggaggaaggntaaagtcaatggcaaaaactggaaatctcgggaaatgttgttnncattgaacgcttcaagaataaaaggnnnggtgtttctgagaaacagntctctaaaaagggatttgaaataccttaccaaggaaataccttaagaagaacaatcttcgggattggcttcgaggggggtgcatcctgacaaggagacctacgaacttcggtacttccagattaggcaagatgaagatgaatncagagcngggggactaggcaaaggctcccccttacagggctttg

SEQ ID NO: 20418 - DNA, 160 bp, Homo sapiens
cccggggcaaaccgcagaaaaagatgttttctcttggaaagaatagagattaatacaactacttaaaaaaaaaagccaaaaggtaactaagaaatggctaagggtaaagttttaaacgaaatttaaatagctaaagaatttaaagagaaaatatgaagcc

SEQ ID NO: 20419 - DNA, 416 bp, Homo sapiens
  misc_feature 175, 192, 301, 304, 342: n = A,T,C or G
gaacatttttaactattgcaggagtttcatcccattctactgcttgattgaccatcaactgcatcctatcgaggatttatttaagaatgaagaacataattttctgctgaagctgtacccttacccttttcagcaaagaataggggggaggaggaaactgtactttatctcggcntcctcttgaatgatagngcaaggttctccaggtgggatgttgtctctgcccgggaggaactcctccctttgatgaattggggtgggcagccactcatctcacactgtgagtccagcggcgcagggnggnaccaaggaaaagaggatattctaggctttgggggctgntagctggggtcaggcttcacccactggtaagaaccaccatctgctctaaacatgaagacttatttgcgggctgg

SEQ ID NO: 20420 - DNA, 920 bp, Homo sapiens
  misc_feature 147, 180, 638, 683, 696: n = A,T,C or G
tccaattaaaaggaacagaacccggcaaattggatacagagtcaagacccatcagtgtgctgtaatcaggaaaaccatctcacgtgcagagacacacataggctcaaaataaaaggatggaggaagatctaccaagcaaatggaaancaataaaaaggcaggggttgcaatcctaggctntgataaaacagactttaaaccaacaaagatcaaaagagacaaagaaggccattacataatggtaaagggatcaattcaacaagaagagctaactatcctaaatatatatgcacccaatacaggagcacccagatgcataaagcaagtcctgagagacctacaaagagacttagactcccacacattaataatgggagactttaacaccccactgtcaacattagacagagcaacgagacacaaagtcaacaaggataccctggaattgaactcagctctgcaccaagcagacctaatagacatctacagaactctccaccccaaatcaacagaatatacattttttttcagcaccacaccacacctattccaaaattggaccacatacttgggagtaaagctctcctcagcaaatgtaaaacaggaaattattaacaaactatctctcagaccacagngcaatcaaactagaactcagggttaagaatctcattcaaaaccgntcaactacatggnaactgaacaacctgctcctggatgactactgggtacataacggaatggagggaggaattaagaagtttttggaacccatggggaaaaaggcccggctaccagatctttggacgcattcaagcgggggggggggggaattttggcctaatgccccagggaagcgggagattaaatggccccttcctccattaaagactggaagcggggtaaaaaaaaaaaaaaaa

SEQ ID NO: 20421 - DNA, 529 bp, Homo sapiens
  misc_feature 25, 337, 462: n = A,T,C or G
cgagcccaatgatgaagaagagccngtgaatgcagaggcattacctatcctggccgtgctgtgatgtgcatagaggtcacagtcatttccctgaggagttgcagagggcggagtaaaattgtttgccatttgtatatccattggtggtggtccaggtgtctagaaaaaaaccaagaagggtcatataagtaaaagcatatgtattcagtttgattactcattagttttaaaaaagtttaaataatgtatcaaagcaatccaaactgtcttttatatatctaagttttaaaatttcatgacatgcaattttttaacagtttataattataatatgggntacatatatgataacaggaggaacagaataaaatttggggttttacctctcacaatttgctgactttggcaaagctctggcaaaaggaaacagaaccatttaaatagggcaaacgcactttttgngacaagaagggaatgcactaaattttttaggcagaaattccccttccttttttgatcattggctggt

SEQ ID NO: 20422 - DNA, 156 bp, Homo sapiens
  misc_feature 1, 151: n = A,T,C or G
ncaaagaattatccatacacagggaaaataggagtcaatggaaactggccctgagggatcccaaatcttagagttattagacaaagattttaaatcagcttttatgaagggtttaaaggactaatagtataacatggaaaattaaatcaanggaag

SEQ ID NO: 20423 - DNA, 251 bp, Homo sapiens
  misc_feature 23, 126, 237: n = A,T,C or G
atacgtgttaggaaggctgcatncctctgggagcctggactctaagctggagctcttggaagagctcttcggtttctgagcataatgctcccatctcctgatttctctgaacagaaaacaaaagangagatgagggaaattgctattttatttgtattcatgaacttggctgtaatcagttatgccgtataggatgtcagacaataccactggttaaaataaagcctatttttcaanttcaaaaaaaaaaa

SEQ ID NO: 20424 - DNA, 329 bp, Homo sapiens
  misc_feature 59, 185, 246, 272, 291: n = A,T,C or G
aaaccccttctgctttcacttaagtgtttttttccgcaaatactgtaggaaacaagccngatcttgttactgtgatattttaaatatccacagtactcactttttccaaatgatcctagtaattgcctagaaatatctttctcttacctgttatttatcaatttttcccagtatttttatacggnaaaaattgtattgaaaacacttagtatgcagttgataagaggaatttggtataattatggngggggattattttttatactgtatgngccaaagctttactactgngggaaagacaactgttttaataaaagatttacattcca

SEQ ID NO: 20425 - DNA, 560 bp, Homo sapiens
  misc_feature 9, 21, 50, 57, 58, 431, 481, 512: n = A,T,C or G
aacccctgnctaagtattagnatgtctgtttttagccattttctgtgagncaaaacnnttttgttcttccttatgtctttcttcagaggtacatctttaataagttctgggaagggaagtgaaaaacaatgcttgacctctgatacaatgtactgttttgattatgatcagcactttaataaaatttatcatcaagaaagtctttggagtgagcccctgaaaagcttgggaaagtgattgatatggtgtcacttttcttaaattaccttcccatgttgctttagatgaccagggaggctaacttcactcttgtgctctctaaattggaactgtcctgaagtttaagaaaatgaaatgatcagactcagcagttcaagattgtgttgggttgatagcagccacttagacctcagttcactatgggtttctgngtacctttattgggggggcaccaagaatgcaatgaaaggcctgattttgnggaacatttctgcccacaccccttctttggnacataccttttgagaatatgtaaaagggctttcattggtaaaaaagct

SEQ ID NO: 20426 - DNA, 499 bp, Homo sapiens
  misc_feature 172, 207, 282, 309, 316, 329, 399, 427, 460: n = A,T,C or G
gttaatttccctcagtgtttttttggggataccaacctaagaaaagccccaggtaatagggagaaataaacatacggtggtttcagtggttttggtcatgtgtccacaggagaaactaaccattcagttgtcttaattttagttcgttctaccctgtgaggagtttgtttcnattagttgttgactttccaaaatgttgcaggaagnaatagttgtcactctgttggtctcatggtcaatatcaatcagactttcatgatctctactaattattagtagagncccgtactatgtctgtaactactaagnttaaagnaaaagcacatagncacttcatctctttttttcttagcctacgctcactccccaacccatcccaacattggacatgctatctgngggcaaatagcagttctcagaatctagncaaggtgccatcatcccccttggccttggccgntcataggagggatgcatatggttggttctttacaggact

SEQ ID NO: 20427 - DNA, 447 bp, Homo sapiens
  misc_feature 111: n = A,T,C or G
caaacctgcattatttaatcccgtaggttgtaatttctaactctagtaaatatctttttttaaataatcctatcctagcctgttctcaaatatggcttaaatatacaaggnatatatattttttaataaattatttatctatacttttttgaaacaggttaatactctgtgcatcacatgtttaacattttcattcaagatgtggaaaaaatccctctgctgaacctagtctatacaccaatattatgtcattcaaggtaccgacaacctgtttcaggagagagacgttcatttttccctaatgaaatgcaagcattctgttagacctattatattgcctgttaatttgactgtaatgaatagggggtaggaacaaaagggtcaagtgtgttataaaacatttgatggtaaaaggaggcaataaaagggcaatggttttcaaaaaaa

SEQ ID NO: 20428 - DNA, 263 bp, Homo sapiens
ggggatgatggccccttgtctggctggacagttgtcggacatcgggttaaagaaagaaactctgaatttgagaagtgttcagtgaagaagggaagcaccttttaggagagagaaaaagaagggatcccttggaaaatgagataattctaatttgaaggaagaggaaaaattagccagtgacataagtatttaccatttaagtcaaataatttccttctctaccatctcgtttctggctttatggaaaaataaaaaattaaagg

SEQ ID NO: 20429 - DNA, 370 bp, Homo sapiens
  misc_feature 23, 24: n = A,T,C or G
tgtgtatgtaggtcaggtgctcnncggaaaagtctgagctgtgtagtacgtcaggcagatgtcagtttagatgcgatagtttaagccacaagagtaggagaggtcatctaaagagtacagcaggcctaagggcatctatatttaaggagaaatacagaagaagtctcctgagaaggaataatggggcgggtggggagggagaaggcagtgtcccaaaaaccaacaaaggttttaccaaaggtaataccatcatttctgagcagcagttccttaacttgtgaatgtggcaaatgttctcctttacaaattgttctgaaggtaaaatgagatcatgtaaacgaaaatcctttgtaaattacagatgtgtgtt

SEQ ID NO: 20430 - DNA, 210 bp, Homo sapiens
  misc_feature 59, 84, 87, 141, 178, 180: n = A,T,C or G
ttacagtgagctcctgtaccatacatcatttttcctacctgaggcattcctgtgctggngattttatctatcgactatattggnggntcttaaccccattgtctaaatgaatagctggcttttttttccccaagtatgggnaaatgtttctggggatttaaagaaaaaaaaaggcctnanggggaaaaaattaacctttggccccttggg

SEQ ID NO: 20431 - DNA, 439 bp, Homo sapiens
  misc_feature 4: n = A,T,C or G
cagnttattccagtatcacccacgtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgcaaaacccttctttagcccttcacacatcgcactgaagaatatgatgctgaaggatatggaagacacatgatgatgatgatgatgatgatgatgatgatgatgatgatgatgatgaggacaactctcttttccaacaggagagccaagaagccattttttttccatttgatctggttccaa

SEQ ID NO: 20432 - DNA, 480 bp, Homo sapiens
  misc_feature 20, 30, 39, 182, 247, 354, 362, 364, 446: n = A,T,C or G
acaagcatttgttttttggntggcaatcgnatctcagcncccagtcttccaccggatatgtatgaatgtctacgtgttggctaacgaagcacctcttaattaatatctgtatcctggaacaatattttatggttatgtttttctgtgtgtcagttttcatagtatccatattttattactgnttattacttccatgaattttaaaatctgagggaaatgttttgtaaacatttattttttttaaagnaaaagaggaaaggcaggcctatttcatcacaagaacacacacatatacacgaatagacatcaaactcaatgcttatttgtaaatttagggttttttatttctactgncaaatgangngcaaaaccttttactgggtgcatgggaaatcagccaagttttataatccttaaatcttaatggtcctcaaagctggataaanacatatggatgttactctcttgcgcaaaattatc

SEQ ID NO: 20433 - DNA, 136 bp, Homo sapiens
  misc_feature 34, 68, 89: n = A,T,C or G
tgtggtcgcgaagcccggcttgaggcaaggcagnaatcgctttttacccggggggtggaggttgcaancggtcaagcattgtgccgttncctccagcctggacaatgagagcttttttttcaaaaaaaaaaaaaaa

SEQ ID NO: 20434 - DNA, 678 bp, Homo sapiens
  misc_feature 509, 553, 576, 631: n = A,T,C or G
gaggagtctcgctccgaggccccagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtaggggtataataatggtaacatggacatgancttctttataattctgctttgagggctggctccatggttgatgnatctgagcaggttgctcccaggnagctctaggagggtgcaacttagagtggggagcagagaatctcttatccaacatnacatcttgggcagaattgaactctttaatctcttgcactcaaagctg

SEQ ID NO: 20435 - DNA, 520 bp, Homo sapiens
  misc_feature 20, 115, 413, 416, 432, 516: n = A,T,C or G
gcagttgagcatgggcagcnttttttgtatgttgaattagggctcgaccccttgcgcaacacgtcaccagtcggaaactggggctgatgaagagactagcagctcgctgctttgntggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaaggggccgccctcccgctgagaaactgtcaccaaatccccccaaactgacaaagcagatgaacgctatcatcgatactgtgataaactacaaagatagttcagggcgacagctnagngaagtcttcattcagntaccttcaagggaagaattaccagaatactatgaataaattaggaagccaggggatttcaaaaaaaataaaggaaaggattcgnaatc

SEQ ID NO: 20436 - DNA, 673 bp, Homo sapiens
  misc_feature 3, 19, 465, 502, 525, 559, 563, 642: n = A,T,C or G
ctntctgccaagaatccgnctaaactggagtgatgttagcagacccagcttagaagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaanatctttctcttacctgtatttatcaatttttcccagnatttttataccggaaaaaattgnattgaaaacacttagtatgcaggtgataagaggnattnggataattatgggggggggattattttttatactggatgggccaaagctttactactgggggaagacaactggtttaanaaagattacattctacagaaaaaaaaaaaaa

SEQ ID NO: 20437 - DNA, 563 bp, Homo sapiens
  misc_feature 366, 462, 538: n = A,T,C or G
aatgcttagtatgatgaatagccctgtttgttagcatgtctgtctatcccattacatttgaccacttggagggctaaaaccttagtctcttttgtattcacagcagctgtcacagtccctggcacatagaagacatgacaataaatacacaggagccttgacagaagtaagaatcaatagttggtcagtttgtcaaaaagttagttaaaagatagaggagtataaagatgatgtatacataccttcattattttattcaaataggccgggtgcagtggctcatgcctgtaatcccagcactttgggaggtcaaagtgggcagatcacttgaggccaggagttcgagaccagtctagccaacatggngaaacccagtctctactaaaaatacgaaaattagctgagtgttatgacgcatgcctgtggtcccagctactgacgtggctgaagcaggagaatcgnttgaacctgggaggtgtaggctgcagtgtgctgagattgcaccactgcaccccagcctggcaagagagcagagctnagtctcaaaaaaaaaaaaaaaaaaa

SEQ ID NO: 20438 - DNA, 104 bp, Homo sapiens
taagcagagccatttgtgactagattgttcagtaagtataaatttatgatgggagtgcggggctcatgcctggcagagccagcacttggggctaggctttgcca

SEQ ID NO: 20439 - DNA, 369 bp, Homo sapiens
tttttcaagtgtaagtttacccaggcagcttcacttacacccttcccttgtaatcagatgtgaaaattacaccctcccttttggatacatgataattacacatttcaacatgcaaagaattgtctctgtttcagttgttggaatgaaaaagctgagacatttcagtaaaatatattattatattaaaggatcatttccataattgttttcgggatttgtaatcaaaaccatgatcaaggtagtcttagttttaaaaagaatacacatggaaataaggagaggataaaattaattgccgagttccacttgaatgaccattcttttattttatgaaaatacagttaagtacattatattctttctttaaaa

SEQ ID NO: 20440 - DNA, 339 bp, Homo sapiens
  misc_feature 34, 35, 71, 73, 124, 179, 182, 227, 266, 274, 323: n = A,T,C or G
gaccttgaaatccatgacgcagggggaatggcgnnatttaaagcctagttaccgcttttcctaaccccagncnaaaatggaaggataattggggagggggagggagaaacaatttcgggaaaanaaagagtttgagggggaaacctggaagaaagaagtccgggaaggccgaaaaaagnatnggagaggatggggaattttggaagataaaaccaaccttttggaanaaaaagaaaattttaaacctggaaggggggagggggaanaaaaaggnaaggcttgggaacaaaaagcttagggcaaatggccaaccttggaaaaanttgggggtggacccgg

SEQ ID NO: 20441 - DNA, 570 bp, Homo sapiens
  misc_feature 331, 354, 363, 421, 429, 452, 484, 520: n = A,T,C or G
gacctaacacagtgtgactaacatgttcagctttttgcctgacttaaaagatatataacaactttttataatcttatttgtaaaaatactataatttcatgccagaaacatcaaggctatgttgaatgcaattgaatttcatagctaaacaatttaggagggcattttatttaaatacctttgcatccttttaatgatggattcacatggctaaaaggacagtggaagatagaagctaaaggccctggctaggagaggctgtggaatgcggccatggagggcccctctgaggacaccagagggagatttgggattaatgattgtggaaggngattaatgatttgcttatttggngcttagggnttaatttttaaaggtaggacatctaaatgtttaaactgtctttgtgatgctgagaggnactccagngaagaggcaaaatgagggactgnggcctttcactcaacatggaggcatctttttncttcttctaggaccctaaattctttcattagactgnccttttccaggatcaatttctaaaaaggttaggctagaaaggtatttggt

SEQ ID NO: 20442 - DNA, 380 bp, Homo sapiens
  misc_feature 100, 183, 268: n = A,T,C or G
agcagctgggctcacccttcctctgaacagttgaccaaacctttcacctgatgagcaacctggctggggatgttatcacagctgcagtgactgcagcttntcaaagaccagttagagggtgtgcagcaagcactttctcaggctgcccccatcccagaagaggacacagacactgaagaaggngatgacttttgaactacttgaccagtcagagctggatcaaattgagagtgaattgggacttacacaagaccaggaagcagaagcncagcaaaataagaagtcttcaggtttccttttcaaatctgctggggaggccattaatctaggaatcagcttgcaccagagcacaaaaaacaccaaaaaaatttcaagtaaaa

SEQ ID NO: 20443 - DNA, 657 bp, Homo sapiens
  misc_feature 38, 153, 158, 271, 398, 409, 443, 518, 542, 549, 577: n = A,T,C or G
tatcctgaaccatccaggccaaataagcgccggctatncccctgtattggattgccacacggctcacattgcatgcaagtttgctgagcttgaaggaaaagattgatcgccgttctggtaaaaagctggaagatggccctaaattcttgaagnctggngatgctgccattgttgatatggttcctggcaagcccatgtgtgttgagagcttctcagactatccacctttgggtcgctttgctgttcgtgatatgagacagacagttgcggngggtgtcatcaaagcagtggacaagaaggctgctggagctggcaaggtcaccaagtctgcccagaaagctcagaaggctaaatgaatattatccctaatacctgccaccccactcttaatcagtggnggaagaacggnctcagaactgtttgtttcaattggccatttaagnttagtagtaaaagactgggtaatgataacaatgcatcgtaaaaccttcagaaggaaaggagaatgtttttggggncactttgggtttctttttttgcgngggcagntttaaggtattaggttttaaaaatcagnactttttaatggaacaacttgaccaaaaaattggcacagaatttgagacccttaaaaaagttaataaaaaaaaaaaaaaa

SEQ ID NO: 20444 - DNA, 455 bp, Homo sapiens
  misc_feature 31, 171: n = A,T,C or G
aaccctttcaattgtaaaacatttttttttngcggttttcaagtaattatccctaccgacacacacacacacaacatgttaaaaataacatctcaaaccaatatataaatttaggatttggaaacatccagaaagtaaaatttaaaagttctgttaattttacattttggnaagatttgttttgtaaatttagtccttaacataatgcaaatttaatctgcaagatagaatacatagatagataaatcgatatttgacatacaatttcaaatgaaattgttttatgcccctttgaggaaacatgtcaggtgattttatttaaggagctacacccaggctccctcattcctaggaaggaaaaagaccagaaactcacaaggtctgctaaaggccaaagactatttaggccaaaagggaataatcaaccaaaagattgccagaagcaaaaaaaaaaa

SEQ ID NO: 20445 - DNA, 359 bp, Homo sapiens
  misc_feature 24, 45, 85, 88, 223, 336: n = A,T,C or G
tagggactgttttagtcccttccnctgctataacaaaataccagnaaactggggtttttaaacaacagaaattcgggctgggcgnggnggctcatacctgtaatcccaagactttgggaggccgaggggggtggataacttgaggtcaggagttcgagaccagcctggccaacatggggaaaccctgtctctactaaaaatacaaaaattacccggccatggnggcacatgcgtgtagtcccagctacttgagaggctgaggcaggagaatcgcttgaacctgggaggtggaggttgcagtgggatgagattgtgccactgtactccagcctgggngacagaatgagactctatcccgg

SEQ ID NO: 20446 - DNA, 696 bp, Homo sapiens
  misc_feature 229, 379, 485, 501, 559, 608, 625: n = A,T,C or G
aaatgactctccgggggggacttaaaatgcctgtttactcatgttttcgtatttttcttgtctctaatacttttgtctttgtctgccttgtgtgttcttttctgaatttcatttcagcaatttatgctgctaaatagaatcccgcatgtctgcattcatttacattcaacttattgtaaattttgagattttatttagaaatgaattgtctaattaatttatgtagagnccttttttccaaagagctcaaaacactacatccacattattgacttttgggaaaccaaccaaattacttaagaaatggaaaagtagtcacagagaaatttagtaatttgcaaaagccacaacagtaggggaagaattaaaatcataaagnctcatcattctgtggctaaaataatgctctttacaatatgctggctacaaaatgggcttactcttgaattttgctttgggtcatattttgggtcttcatatctagnatggtttggtcctgcngaattttacagactcagctaaccataggtatttaggaggcacttggtttcattatcanaatggaatttccaagaccacctggaatcattcagctggccaaaaaaaanagagcctcattaaaacngggtttcttaaactaaagggggggttcaaatttattttttaaaaacaaaagggaaacaaaccggaaaagcc

SEQ ID NO: 20447 - DNA, 345 bp, Homo sapiens
  misc_feature 97, 293, 337: n = A,T,C or G
accctattccctgatcattgctccccttttttctggcgtattcaaagcatctcagcgcacatgtcaatgaacttcctataatctttactgcttgctngcaatgaatttctggaagcagcatctttaaggcgatcattgtagaatgttgcccattttcccctgatcacaggcacatcaggcattgtaggtctgacttgagaccagcatcaattacatcatagatatgaaaggcagtaagtcttaagagcagattttccaccatcataccatacctctacaaaacaaaaaaaaancaaaaaaaaaaaaaaaaaaccttgggggccgcctggccccaggnggatttta

SEQ ID NO: 20448 - DNA, 303 bp, Homo sapiens
  misc_feature 25, 40, 59, 169, 177, 200, 244, 258: n = A,T,C or G
acgacatcacttccattgagtgcangtttgctatagaggnggatttaggctacaatatntgtttaacctccctaagtaactttcaagggatctgccctgaaagcggataatgcatggtctagcagatttatattatatgcagataataattaactggggataaaagaanggcaaggngagacacaaagtagcaaactgantacttctccaatagcaaccccaagctacctcctcaccctgcatnttggagggaggcangaaatttcttttgaaataaagagctggagctgaattctgcattat

SEQ ID NO: 20449 - DNA, 657 bp, Homo sapiens
  misc_feature 43, 149, 386, 393, 537, 623: n = A,T,C or G
ttatctgaaaggacttttttttaaatctgtggcaaacattatnctaaatggtaaaatattaaaagctttttttccttatagtaggaacaagacaaatatgcctgccatcttcctttctcttcagtattggactgagagtcctagctggngcaatagaggaagacaaaaataaaagtgtggtggacagaatggcccgccaataatgtccacactctagaacctgtgaatatgttaccttacatggcagaagagattttgcagatgtaattaagttacagatgttaagataggtggtaggttaatttaatatgcatataggagaaataaatctttccttctacttcatatcttacacaaaactcaattcaagatggattgataagggnataaggncattatacaaaaggcaactatattttatataccagcaagaaaaacaaatttaactaaaaatttttaaaataccatttacaaaatattatcatttttactagcatctaaaatattatataaaatggtatttccattaaaactatnaaacattattgagaaaaattaaggaggcctaaataaatgactttgcccttgcatataccagggtaatattctaaaaatcaattttntacatcccagcaacaccaaaaaaaaaaaaaaaaa

SEQ ID NO: 20450 - DNA, 223 bp, Homo sapiens
  misc_feature 13, 30, 50: n = A,T,C or G
gccccggcattgnggcagccagcgttttgnttctgctgagggggcaggcnccgctggaggaaaaccgcagaaaaaggtttttttttttggaaggaaaagaagattaaggcaacttactaaaaaaatatagccaaagggtaactaagtaatggctaagggtaaagttttaaaggaaattttaatagctaaagatttaaagagaaaataggaggccttaaaaaag

SEQ ID NO: 20451 - DNA, 264 bp, Homo sapiens
  misc_feature 117: n = A,T,C or G
cagcattttgggtaggccaaggcggctcggatcacctgaggaaaggaagagtctgagaccatcctagccaacatggctgaagccccgttgctactaaaaatacgaaaattagctggncgtggtggctgggcacctgtaatctcagctacttgagaggctgaaatcgaagaatcacttgaacctgggaggcagatgttgcagtgagccaagattgtgccactgccctccaggctggagattccatcgcaaaaaaaaaaaaaaaaa

SEQ ID NO: 20452 - DNA, 312 bp, Homo sapiens
  misc_feature 122, 127: n = A,T,C or G
tttaggggaaaaattgcttagcctctagggtatttctaaactttgaacagtaaaagcataattgctagaaaatactttcagggtcatcattaagctttaggggggctttgttactgccctgntaagnagttcatgttgggtagcatggacagtacagcaaacccattatgattcctttacagggtgataaatatgaaatagtccagaaagaataagatattaagtaacctttgcctgaaggttctgtgaactccttaagcgtttgaatatatacttctccccaccccgaataagcgattcttcttaaaaaaa

SEQ ID NO: 20453 - DNA, 797 bp, Homo sapiens
  misc_feature 39, 41, 396, 502, 619, 622, 674, 762: n = A,T,C or G
cccctttttccggctggtaccatttttttgggtagaagnanaaggaagaagggcgctcctgctgtgcaagaaaacccttaagaaaaaagcgaaggaatttcgcagagctgaagaatcaagcgcctgagaaagaagtttgcccaaaagatgcttcgaaaggcaaggaggaagcttatctatgaaaaagcaaagcactatcacaaggaatataggcaggatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgngaagctcaacaaggcttcgattaacatgctgaggattgtagagccatatattgcatgggggtaccccaatctgaagtcagtaaatgaactaatctacaagcggggntatggcaaaatcaataagaagcgaattgctttgacagataacgctttgattgctcgaactcttgggaaatacgggatcatctgcatggaggatttgattcatgagatctatactggnggnaaacgcttcaaagaggcaaataacttcctggggcccttcaaattgtcttctncacgagggggatgaagaaaaagacacccattttggaaaagggggagaagctgcaacagggggggccagaacaacaggctattaaaagnaagactaaggggctaccatgaatatttttctaagc

SEQ ID NO: 20454 - DNA, 587 bp, Homo sapiens
  misc_feature 39, 97: n = A,T,C or G
agtttcattctgtttttttcagtttcccactttaggcanccgtaggattaatagcaatgacgaattcaaagtagatgaggaaaatcaggcacagagnaagtaaaggtagggatagacccaaatttacacaacaaggataatgacatctccagcttttaagttgatcatcaaaggctgggctggatttgtcttgctggatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaaaaccccacaaaccccattactaaacccacactcaacagaaacaaagcatacatcattattctcgcacggactacaaccacgaccaatgatatgaaaaaccatcggtggatttcaactaccagaacaccaaaaaa

SEQ ID NO: 20455 - DNA, 375 bp, Homo sapiens
  misc_feature 12: n = A,T,C or G
gtaatcatcagnactggttagccaggcattccagaatagtggttcttttcagaaacctttttaaaagggttggttaactacctcagtagcagaggattgaactataccctgtctgtactgtacatagaaaatctttgcttttgtcgtattttgtggctgaaaaagcagccttgcttcttcagatattgtagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgaaa

SEQ ID NO: 20456 - DNA, 525 bp, Homo sapiens
  misc_feature 410: n = A,T,C or G
tcaaattactaaaaggaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaaagaacatgaatgtaatatagatgaggngaaaaatggttatttcaaaaattttataccttttatgaattctcttggacttgtaacatctaatggacttccagaggttgaaatctttctaaacgatacgaaaaaaaaaaaaaaa

SEQ ID NO: 20457 - DNA, 179 bp, Homo sapiens
  misc_feature 24: n = A,T,C or G
tacaaaattagctgaacatggggnccatacatgtaatcccagctactcaggaggctgaggcgggagaatcgcttgaacccgggagggggaaagttgtggtgagccaagaattgtgccattgacctccagcctgggcagcaagatggacactttgtctccgggaaaaaaaaaaaaaaaaa

SEQ ID NO: 20458 - DNA, 397 bp, Homo sapiens
  misc_feature 3, 92, 142, 239: n = A,T,C or G
ttntgcaagaatcctttttgggggtagattgtcggttttcagttctcaagagacaaggtttttcatacttaagaagatgtttggctgggcgngggggctcaccgcctgtaatcccagcactttgggtaggccaaggcagctnggatcgcttgagctcaggagttcaagaccagcctaggcaacatggcaaaaccccatctctacaaaaaaatacaaaaaaattagccagatgtgggggngcacacctgcagtcctaggtacttgaggggctgaggcaggaggatggctagaaccttggagattgaggctgcagtgagctgagatggtgtcacttgccctccagcctgggtctgggtgacagagtgtgactgtgccaaaaaaaaaaaaaaaaaaaaaa

SEQ ID NO: 20459 - DNA, 556 bp, Homo sapiens
  misc_feature 1, 4, 13, 26, 29, 31, 33, 37, 38, 46, 47, 55, 59, 61, 73,76, 86, 97, 102, 126, 469, 529, 548: n = A,T,C or G
ntanctttgggtnccacaggccccanttngntncttnnggccgggnncctaaggnaaangnaaattatatcangtnctctttcagnaccacagtggnaatanaattgaaaatcaattccaaaaggnaaccctcaataccatgcaaatacatggaaattaaataacctacccttgaatgatccttgggtcaacaataaaatcaaggtggaaatttaaaaaactatttgaactgaattataatagtgacacaacctatcaaaacctcttggatacagcaaaaggtggtgctaacaggaaagttcatagcattaaatgcctacatcaaaaaatctgaaaaagcagaaatagacaatctcaggtcacgtttcaaggagctagagaaacaaacccaaatctagcagaagaaaataaataggttaagattagagccgaactaagtgaaatcgaaacaaacaaaaaactataccanagataaataaaacaaaaagctggttcttagaaaagataaaattgacagaccattcacaanattaaccagaaagaagagnagaagttc

SEQ ID NO: 20460 - DNA, 340 bp, Homo sapiens
  misc_feature 26, 33, 323: n = A,T,C or G
acataaatcaccctgggggacagcanggaaagnttctgagatactctggggatgtttcttggggaaatcaggatttgacttggcctggaaggcattggaatgatagataagtaagggggattgggagaagggatggaagtagagaaatgtcttagatcctttgcaagctgacagaggctttcttggaaagaggccccagcccaggtgagcttatgggtcccgcccatggagagcttctccaggcagagttaaatagagtgggagtaggcagagccaagctagagagggccctgggactgatgaggggagaatgcctgtcagcngaactagactatgaaat

SEQ ID NO: 20461 - DNA, 245 bp, Homo sapiens
  misc_feature 236, 238: n = A,T,C or G
ctggagccacccgcgaaaatcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaananaaaaaaa

SEQ ID NO: 20462 - DNA, 430 bp, Homo sapiens
  misc_feature 4, 29: n = A,T,C or G
tacnttcttactgataacccactggtcantgtttttgcgttggtcttatattttggtaatttcaaaaatactcagtaatatgttgttattaatgcacagaagggatatgtgtgtctaaatgcttatatttgcttgctttgtcttaggtttggtgtgtctttttaaacttgggaatctaggtatatgctcttaaaaagtacttcttggggaattagaaaagatttctaagaataagacattgattttgttatcttagcagtgtaatcaaaacaaatattataacctcaggactaattcttaatgaactttgctgaaattgaaagttgttgctgacaacttaagagcatttcttctcatcgtcatcagcccattgtgaacgcccttgtttttcttgctgtcagctgttggagattgtcatggatgatgttaa

SEQ ID NO: 20463 - DNA, 184 bp, Homo sapiens
  misc_feature 3, 18, 22, 29, 45, 73, 86: n = A,T,C or G
ttnttttggtcaccaggnccanttttttncattatggccgggggncccgactagtgaggtggctgaggtaagnaggctcatttganccaagggggtcaagactgcagtgggctaagatcgtgcatctggactccagcctgggtgacagtgagaccctgtctgaaccaaaaaaaaaaaaaaaaaa

SEQ ID NO: 20464 - DNA, 400 bp, Homo sapiens
attgtgtttgcttaaatttgctgctttgggatttggctttctattctgccatcttgttgaataagagtgatcaggatagtaaatcttacagagctttaggagtcttcctttccttgcagcgggctatagatgaaaaattctctgctctagaagagaaagaaaaagaactgcaccagcttcgtcttgctgtgagagggcgagatcatgacttagagagactgcgcgatgtcctctcctccaatgaagctactatgcaagtaagagcaaaacctatctctgacttggtgttcctctcccacttgtatcctgagcctgaagcatgacccccttccatcattttctgaaaaccaggggattttgctttataaaggggggaaagaaaaccaaaaaggagcagtta

SEQ ID NO: 20465 - DNA, 180 bp, Homo sapiens
  misc_feature 4, 170: n = A,T,C or G
aagnacttaaggtgtaatttcattacagtccattagtaaagtgtattattggtgccattttcaaaaaaattaatttattttaccagcagtattcatagctgtggttatgttattttttatttaaaaactttatattaaagtcatttgtaatgttattgtatagttattgngtagcacata

SEQ ID NO: 20466 - DNA, 380 bp, Homo sapiens
  misc_feature 14, 24, 48, 202, 378: n = A,T,C or G
agcagcatcatggnaggtttgaantagccgcatttggattggatgaanccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggntgctccacaggtagctctaggagggctggcaacttagaggtggggagcagagaattctcttatccaacatcaacatcttggtcagatttgaactcttcaatctcttgcactcaaagcttgttaagatagttaagcgtgcattaagttaacttcccaatttacatactctgcttaanaa

SEQ ID NO: 20467 - DNA, 450 bp, Homo sapiens
  misc_feature 82, 173, 174, 175, 399, 400, 433, 438: n = A,T,C or G
tacaaccacacaagtaacatctaccacaactcaagataccacaccattcaaaattactactcttaaaacaactactcttgcncccaaagtaactacaacaaaaaagacaattactaccactgagattatgaacaaacctgaagaaacagctaaaccaaaagacagagctactnnntctaaagcgacaactcctaaacctcaaaagccaaccaaagcacccaaaaaacccacttctaccaaaaagccaaaaacaatgcctagagtgggaaaaccaaagacgacaccaactccccgcaagatgacatcaacaatgccagaattgaaccctacctcaagaatagcagaagccatgctccaaaccaccaccagacctaaccaaactccaaactccaaactagnngaagtaaatccaaagagtgaagatgccggtggngctgnaggagaaacacc

SEQ ID NO: 20468 - DNA, 440 bp, Homo sapiens
  misc_feature 24, 49, 204, 416: n = A,T,C or G
cacagtgtcggtggcgtcggtttnttactgactcatccgctgtaaatgnccgcgatactgaactacaggccggagggcagcgaggactactacgccttgctgggatgcgatgagctctcctcggttgagcaaatcttggcagaatttaagattagagctctggagtgtcacccccgacaagcatcctgagaactccaaagctgnggagacttttcagaaattgcagaaggcgaaggagattctgtgcaatgcagagagtcgagcccgctatgaccattggcggaggagccagatgtcaatgccgttcgagcagtgggaagctttggccgactcagtgaaaacttcgatgcattgggctgtcagaagtaaagaaggacttgatgctggaaggaaagtggccagacgttcaccagctncagttccaaacaaggaacgggagt

SEQ ID NO: 20469 - DNA, 500 bp, Homo sapiens
acagcattcgggttcgaagagtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatggaggggtat

SEQ ID NO: 20470 - DNA, 420 bp, Homo sapiens
  misc_feature 35, 38, 184: n = A,T,C or G
ctttcctgtagtatatagttttactattttaaagnagnatctctgaattttacaagaggaaccaacattccttaatggcagaactttgaaagttgatttgggaggctttttgctgcaggatctcaaaaatagagagagagatgattctacttaaatgtttttaattttctaacttccatcaggntgatacttaagctctattttgtaaagagtaaatcatcctttagtatgctgcataagatgatcagcattcttgcactttctcagtaataagacgtgccgggcaattggctccccaggacgcattgtgtttttaacctaacgagaggactttggggcaggtgattaaatttattatagggtacctcaagaaaaagaacctgaatatgctgcattttctttctttagcttttacatgta

SEQ ID NO: 20471 - DNA, 440 bp, Homo sapiens
  misc_feature 94, 106: n = A,T,C or G
cgccggggcaagtgaggagccggccgggcactgggcgactctgtgcctcgctggaggaaaaataactaaacatgggcaaaggagatcctaaganaccgagaggcanaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttggaagatatggcaaaagcggacaaggcccgttatgaaagagaaatgaaaacctatatccctcccaaagggggagacaaaaaagaagttcaaggatcccaatgcacccaagaggcctccttcggccttcttcctcttctgctctgagtatcgcccaaaaatcaaaggagaacatcctggcctgtccattg

SEQ ID NO: 20472 - DNA, 400 bp, Homo sapiens
  misc_feature 25, 30, 121, 148, 165, 202, 211, 234, 285, 313, 333, 348: n = A,T,C or G
gcactactgcattccagcctggccncagantgagtactctgtgctcaaaaataaataaacatatgtctaaaatgtgaggcaaacacatctctcagatctttatgctgggaggtagtaaggnaagaatggcatttataggccaggtgtngcggctcatatctgtantcccaggactttgggaggtcaaggtgggtggatcgcntggaagctnggaatgagaccagagcctgggcnacattgtgaaaacctgtgtcttaaaacaaaacaaaacaagccaggtgttgngacacgtgcttgttggtatgagctactngggaggctgaggatggaggngtggcttgaacccanaaattgaggctgcagcgagctattgatggcaccactatattccagccctggg

SEQ ID NO: 20473 - DNA, 175 bp, Homo sapiens
  misc_feature 7: n = A,T,C or G
cttaagncattcagttttgctttcaattttatgtaccttagttctgagctagacctgcagatgtgtacagatagttcatatttatgtattgcacataatcatgctattcagcattgatgctatattgtattatgtaaataataaaagccatgtacagaggaaaaaaaaaaaaaaa

SEQ ID NO: 20474 - DNA, 170 bp, Homo sapiens
  misc_feature 25, 117, 157: n = A,T,C or G
tctctgaaatacattcttttttctncttcctttgaagtaatataaaaatttcctttagctatggggcgagacagacagaggcctaaagctagatttggccagtggaccataatttgntgacatctgttatatacagaaatagataattgaaaactgnaaatactggccag

SEQ ID NO: 20475 - DNA, 400 bp, Homo sapiens
  misc_feature 25: n = A,T,C or G
aaagaagtttttcttgggtgtttgncaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaa

SEQ ID NO: 20476 - DNA, 310 bp, Homo sapiens
  misc_feature 285: n = A,T,C or G
gtagatcgtcagaatcgacgtgccaacaatggtccacccaaatcagggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattgtactgggaaaaaaagagaagaccccaaaccaggccctaaaaaaccaaaagagaaagnggatactctatcacagtttgatctc

SEQ ID NO: 20477 - DNA, 460 bp, Homo sapiens
  misc_feature 15, 182, 183: n = A,T,C or G
acacaagtaccctgnaaactggacccgcagggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagnngagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatggcttct

SEQ ID NO: 20478 - DNA, 500 bp, Homo sapiens
  misc_feature 326, 493: n = A,T,C or G
gttaatagttacttatttctgcctaagcactcaccttccgattttacccaagtatatataggatagaaaaaaatgcattatatttgagagctacttcgcccaaattacaaaatgagtgtttttagattcaagtgacagtaaaaggatttgggcccttcagtgacttgagtgttttagttatgcataagtatttctagcaaaggaagggtagaaaggaattgaaaattaatttacactagttgctacttgggaataaagggctttttgaggggggtatggatattaaatgttttcgttatatacttatccctattaaaacaggcagntgtttctttgaatatgcctaaataacagtattcttaaaatctgacagacaagtaacatgtcaattacttgatattccttggctccagtaccacaggccactcttgacatcccatgtttgcctggataaaggtccctcatttcaaacagtatacatactttctttgcnggtcatt

SEQ ID NO: 20479 - DNA, 430 bp, Homo sapiens
  misc_feature 6, 8, 41: n = A,T,C or G
gtaagnanaattttattcaaagctaggaagaactacttagnagcaaaagtaaataaaaactatttgtcatctaagtccgtggttctcaacgtggttctcttaggggtgatttttgccactgcccccgccccacaacatttggccatgtctggagacacttgtatgtcccatcctggcagggcagggcgggaggctgaggaagggcatctagtaggtagagcttaggtatgctgctaaacattttatagtgaacagggcagccctcaacaacgaagaattatccagtccaaaatgtcaatagtgccgaggttgagacaccctaaataaagaattggaatgaatccatttcgtgatgacccaaggaaccatcttatgctccaggaaaatttgggcttcaataagcaaggaagtctggtggccgttgagcact

SEQ ID NO: 20480 - DNA, 320 bp, Homo sapiens
  misc_feature 33, 37, 46: n = A,T,C or G
aaaaagtctgttttgcaatgctggagacatggngaanaggccaaanattcttcttcgttcaagatgaattctgttcacagtggagtatggtgttcggcaaaaggacctccagcaagactgaaagaaactaatttatttctgtttctgtggagtttccattatttctactgcttacactttagaatgtttattttatggggactaagggattaagagtgtgaactaaaaggtaacattttccactctcaagttttctactttgtctttgaactgaaaataaacatggatctagaaaaccaaaaaaaaaaaaaaaaaaaaaa

SEQ ID NO: 20481 - DNA, 500 bp, Homo sapiens
  misc_feature 14, 25, 360, 363: n = A,T,C or G
tggtagccactagnacacatgaacnttgaacacttaaaatgtggctagtgtgacccaggaattgaattttcagtgtaaatttaaatagccactcataactaatggctgttatactggaaaatgcaagtctagagccttaaagtccgctccatcacacacctgtctggcatggcagtataaacacaatggccagaacaaggtaactgagatgtggtctgacttatacagaatatggtggggtcatctctcaaccagaataccagacattaatgaagtttcagattatattagcattttaagtaccatgttgtattattggctcatactgagtttgtagtcagctgttattagtaagcttgntgncacttttcataagaattgcttttacatgggccttgtaaaaatgcttgattaaaattccaaaacactgccttatcccagctcaattctcatcttgcttttttgagcatattttagtacattgagagggttttgggatc

SEQ ID NO: 20482 - DNA, 520 bp, Homo sapiens
  misc_feature 19, 180, 181, 377, 382, 390, 400, 414, 416, 502: n = A,T,C or G
ggaggtcttttccagctgnaggccttaaaatgctaaaatcagcattcataatatctgtttattattagagtagatgcaatgcattttgagctattagaataaaaaatgaaagttatatataacttaaagacatcctaggaattcaactaggatttctatctcctaggaactaaacatatnntctaggtaaattatgccattattatggaccaatgttgtaatgaaactagtgagatggtaaatttgtaaaaataaatttcattcacgggggactggaaagcaccatttctttccttagaaaataattccccaaactcctacactggataaatgacttgcctctttaaggaagtctggctttcttagaggctagtgtnactgntttacagntcactttcgnttacatcagggggngnccaatctttttggcttccctgggccacatcagaagaagaattatctcaagccacacataaaaacactaacactaagatagggggangagccaaaaaaaaaaaaa

SEQ ID NO: 20483 - DNA, 348 bp, Homo sapiens
  misc_feature 25, 26, 236, 298, 300: n = A,T,C or G
catcacgatgaccttggaataaacnntgcacacactcagtgcagcaatatattaccagcaagaataaaaaagaaatccatatcttaaaggaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgngctagaatactttttaaaaggtattttgaataccattaaaactgcttttttttttccagcangnatccaaccaactggggtctgcttcaataaatctttggaaaaaaaaaaa

SEQ ID NO: 20484 - DNA, 420 bp, Homo sapiens
  misc_feature 57, 62, 250, 341, 350, 383: n = A,T,C or G
aaatgcatatacacatataaaccccaggaaagggggtaaaagcgggggagagagagnagagnagagtacaacacattataatgtgcttgaagttttacttaaagtgttaaattttctttggctaatatattttgttatttattttaatagtctacctgaaaccatttcctttcttttactttcatcattttaaggtagtttttgaattactctaaatgtagaaggatagtaagtagtaaaattaaactgntttgttttcctttttattttagaaaaggcaatcacagctgtttttaacaggtagaccttgtaagcatgcatgttttctttattttcatggnggtttcagntatctattaagtaacagtcatctgttagcagtntcataacacatagattagaaagggaggcagcttttag

SEQ ID NO: 20485 - DNA, 418 bp, Homo sapiens
  misc_feature 19, 21: n = A,T,C or G
attaaaaatctctgtaaancntgtagtgtttcataaaatctgtaactcgcattttaatgatcagctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacaggggaaattttcattaaaaatattgggttggaaaaaaaaaaaaaaaaaaa

SEQ ID NO: 20486 - DNA, 397 bp, Homo sapiens
  misc_feature 1, 248, 363: n = A,T,C or G
natagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgntctaatcttggcaaccagtgcaagtgaccgacaaaattccagttatttatttccaaaatgtttggaaacagtataatttggacaaagaaaaatgatacttctctttttttgctgntccacccaaatacaattcaaatgctttttgttta

SEQ ID NO: 20487 - DNA, 211 bp, Homo sapiens
  misc_feature 36, 71, 73, 91, 97, 124, 128, 186: n = A,T,C or G
aatagcttaagattttaagagaaaatatgaagactnagaagagtagcatgaggaaggaaaagataaaaggntnctaaaacatgacggaggnggagangaagcttcttcatggagaaaaaaatgnattnaaaagaaatggagggaaaggactacagagccccgaattaataccaatagaagggcaangcttttagattaaaaggaagggact

SEQ ID NO: 20488 - DNA, 500 bp, Homo sapiens
  misc_feature 15, 25, 213, 312, 336, 366, 402, 411, 413, 474: n = A,T,C or G
gctggaagtcttagnaaagccttgnaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgncttttctgtgtttggtcgatattaataatggcaaaatttttgcctatctagtatcttcaaattgtagtcttttgtaacaaccaaataaccttttgtggncacttgtaaaaattaatatttggnagacagaatccatgtaccttttgctaaggntaagaatgaataaattttattggaatttttaatttngaaagggtngngccttttttaaaatggagcccaaggactagagggggaaactatccaccctaaaattcaggnttgggaaaacaagacctaaaaaaggg

SEQ ID NO: 20489 - DNA, 340 bp, Homo sapiens
  misc_feature 25, 271, 308: n = A,T,C or G
aaaggctattttctatatttattgntgggaaaagtcactttaaagacttgtgctatttggaagcaaagctattttttttgtcagtggaatgcagtttttttactattccatcatgaggaacaacatagattccatgatctttttaatgacagtacagactgagatttgaaggaaacatgcacaaatctgtaaaacatagaccttcgctttatttttgtaagtatcatctgccaccatgttttgtaatttgaggtcttgatttcaccattgncggtgaagaaaattttcaataaatatgtattacccgnctgaagcttaaaaaaaaaaaaaaaaaaaaaaa

SEQ ID NO: 20490 - DNA, 500 bp, Homo sapiens
  misc_feature 32, 370, 409: n = A,T,C or G
cagtactggcgttttaccaaccatataaaagnatgcagggtaccccaaaccaattttcaaagggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagntaaagtgagtatactggggagaggacttccaaatgtggntacctcagctatatcactgcccaacatcagaaaacctgacggctatgattactatgccttttctaaagatcaatactataacattgatgtg

SEQ ID NO: 20491 - DNA, 370 bp, Homo sapiens
  misc_feature 49, 131: n = A,T,C or G
actggaaagaatggagagagaattgaaaaagtggagcattcagacttgnctttcagcaaggactggctttctatctcttgtactacactgaattcacccccactgaaaaagatgagtatgcctgccggggngaaccattgggactttgtcacagccccaagatagttaaagtgggatcgagacatgtaaagcagcatcatgggaggtttgaagatgccgcatttggattggatgaattccaaattctgcttgcttgcttttttaatattgatatgcttatacacttacactttatgcacaaaatggaggggtataataatgtaacatgggcatgatcttctttataattctactttgagggctgctccat

SEQ ID NO: 20492 - DNA, 180 bp, Homo sapiens
  misc_feature 20, 35, 45: n = A,T,C or G
gtgaagtagcgcctccaggncaagcaagggggagnatcatcaagnactttatccaagggagggaagagtaccaagaaaataaaacctcccactttgtctgtacatactggcctctgtgattacatagatcagccattaaaataaaacaagccttaatctccaaaaaaaaaaaaaaaaaaa

SEQ ID NO: 20493 - DNA, 296 bp, Homo sapiens
  misc_feature 22, 26, 39, 73, 198: n = A,T,C or G
accagttaggtgacgtgtggcntttncaaagcataaggntttcgaacctcacttcttttttgtattatatggngttaatacccatttgatttaatttaaagtttttgtattatttaagactttcaatgggtgcttgagttggttgacatttttgaaaaaatcaagttgtaaacttttattacaaattaaaagtgaagngcttaaaaatctcaacttgacatatgaaccaatttaaaagcttttaaaggcatgttgagaaaaaccaaatttaaaaaaaaaaaaaaaaaaaaaaaaaa

SEQ ID NO: 20494 - DNA, 270 bp, Homo sapiens
  misc_feature 170, 174, 241: n = A,T,C or G
cccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggntggncaatttcgtgccagccaccgcggtcacacgattaacccaagtcaatagaagccggcgtaaagagtgntttagatcacccccctccccaaaaaaaaa

SEQ ID NO: 20495 - DNA, 500 bp, Homo sapiens
  misc_feature 20, 180, 479, 481, 482, 484: n = A,T,C or G
ttttaatcttgctcctcagnaccaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagnagtacatgggggataacttctacttttaggaggactactctcttctgacagtcctagactggtcttctacactaagacaccatgaaggagtatgtgctcctattattcctggctttgggctctgccaaacccttctttagcccttcacacatcgcactgaagaatatgatgctgaaggatatggaagacacagatgatgatgatgatgatgatgatgatgatgatgatgatgatgaggaggacaacctcttttttttccaacaagagagccaagaaagccattttttttccatttggancnngntccaatggggccattt

SEQ ID NO: 20496 - DNA, 450 bp, Homo sapiens
  misc_feature 23, 356, 358, 406: n = A,T,C or G
atgcctgtggccaagctggctgncttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgtttttgatgtattataggcaggaaggggtttttgctaccgngnaaacctttacctagatcagccatcagcctgtcaactcagttaacaagntaaggaccgaagtgtttcaaggggatctcagtaaaggatctttg

SEQ ID NO: 20497 - DNA, 500 bp, Homo sapiens
  misc_feature 37, 250, 295, 304, 330, 344, 370, 430, 454: n = A,T,C or G
ttttaactccagatatcctaaagctcaattgtttggnctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggnatttttatgcacagaatacacttagattgataggaaagaactcgnaatgggagnttgagtaaaagaaaatgactggatgnacctaaaacccagnaaaaaattgttgaaaatgttaaaggncagcatgttctaattgggaatctaagatatagcttaagaatttcctattggcttaagagnattttgctataaccaaatggaagngcaatgacaattatatatttcctactcgggcatactggactgggtt

SEQ ID NO: 20498 - DNA, 131 bp, Homo sapiens
  misc_feature 12, 22: n = A,T,C or G
atcataagcagnatcccctgtncagcccacaaaacgtgagtaagaatgtatttaaatcagtgaaagactctaaaagacagtagtacaatacacaggaggattaatacgaaaaaaaaaaaaaaaaaaaaaaa

SEQ ID NO: 20499 - DNA, 500 bp, Homo sapiens
  misc_feature 330, 336, 471, 480, 490: n = A,T,C or G
ggcacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaatatcatgtttttatataaatgcccaaatttgagatgcattattcctattactaatgatgtaagtacgaggataaatccaagaaactttcaactctttgcctttcctggcctttactggatcccaaagcatttaaggnacatgntccaaaaactttgaaagctaatggttcccatgatcgctcattcttcttttatgattcatacggtattccttataaaggaagacctttggtttcctcctatcaaggcagctattttattaaaatttttcacttagnctgagaaanagcagatagnctcatatttt

SEQ ID NO: 20500 - DNA, 393 bp, Homo sapiens
gaccaaccgtaacccccttcgaccttgccgaaggggagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttgtcaccaaggaccctacttctgacctccctgttcttatgaattcgaacagcatacccccgattccggtgcgaccaactcatacacctcctatgaaaaaacttcctaccactcaccctagcattacttatatgatatgtctccatacccattacaatctccagcattccccctcaaaccaaaaaaaaaaaa

SEQ ID NO: 20501 - DNA, 400 bp, Homo sapiens
  misc_feature 23, 352: n = A,T,C or G
tttgcattatacttgccaggtgnccatcccaaatctgaaaatccaaaatctgaaatgctccagtgggcatttctcttgagcatcatgttgatactcagaaagttttgggtttgggaggattttgtattttcaggttgggcatgctcaacctgtattcatacagtgggatactaatcaacaatataaagaaaggaattattgtcccatgcaccaacatgaataaatctcaaaaacatcatgtttagccagggacagatataaaagagaacattttgaatgatttcctttatatggagataggaaaggattggataagaaaacaaggggatctttctgtgatgatgaggatggnctatatcttggttttatgggatgggtatgtaagatttatatggggctt

SEQ ID NO: 20502 - DNA, 254 bp, Homo sapiens
  misc_feature 46: n = A,T,C or G
ggataacttgaggccaggagttcgagaccagcctggccaacatggngaaaccccatctctactaaaaatacaaaaattggctgggtgtggtggtgggcgcctgtaatctcagttacttgggaggctgaggcaggagaattgcttgagcctgggaggcggaggttgtgcagtgagccagtgcacatgagtctgtgccactgcactccagccggggcagcagagacttttacaaaaaaaaaaaaaaaaaaaaaaaa

SEQ ID NO: 20503 - DNA, 440 bp, Homo sapiens
  misc_feature 25, 49, 50, 290, 389, 406, 434: n = A,T,C or G
aaaatattacaaaactgaatgcttntgtcctttgtggtgcttgttcctnngaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgngtactttgggaatttttaatttaaagaaagcaactgaaattgaaatcttgaggggcagctgtatctactaatgagccttattccatttcctgaggtttnaaaagaagaaacactgncttgattatacgaatacactcagaaagnacattt

SEQ ID NO: 20504 - DNA, 500 bp, Homo sapiens
  misc_feature 23, 325, 385, 399, 428: n = A,T,C or G
aataatcagtatggtttatatgnccgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgngaactatctttaaaacactagaaaaaagaaaatgttagtatctcaattacacccaactgngcaaatgaactttngataaaatagaaaaaatctacattggccnttgggaaatctggggagagctttaaggattctagtagatggtactggatactcaggcccccttatttattaa

SEQ ID NO: 20505 - DNA, 179 bp, Homo sapiens
  misc_feature 21: n = A,T,C or G
atactatattaaattctgggngccctttttttttgttcccttgagaaccaaaatttaagttaactgctgctggcagtctaagtgtaaatgttaacagcaggagaagttaagaattgagcagttctgttgcatgatttcccaaatgaaatactgccttggctagagtttgaaaaactaat

SEQ ID NO: 20506 - DNA, 300 bp, Homo sapiens
  misc_feature 97, 153, 155: n = A,T,C or G
gtattgcttaagtatttggctgtttttattttttaaaaggtataaacaccaaaaaaaaaaattaacattgtatgaagatggaaaataagaagatgcnctttctgtaactttgtctaaggatttaaattactaacttatgaactccaattggantngaacttaactatcggctttcttactgggaaaattatatggttaattttaaatgcgtacatattgaccaatggcctctgaaaaagcacattttagatactgaaattgaaggaaagaaaatgcatcttcaaacattttttgggaatc

SEQ ID NO: 20507 - DNA, 520 bp, Homo sapiens
  misc_feature 49: n = A,T,C or G
tggaaactataaacttacagcttttgctccaggctatctggcaataacnaaggaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagaattcattttcctacctatattacacaaaaaagtatagaaaaagatttaaggtaattttgccatcctaggcttaaatgcaatatttcctgggattatttacaatgcagaaattttttgagtaattctagctttcaa

SEQ ID NO: 20508 - DNA, 450 bp, Homo sapiens
  misc_feature 23, 25: n = A,T,C or G
ggagaaaattataaccaagcatncntatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacccaaaaaaaaaaaaaaaaaaaa

SEQ ID NO: 20509 - DNA, 365 bp, Homo sapiens
atttttagtagagacgtggtttagtagagacgaccttccaaagtgctgggattacaggagtgagccaccacacctggccagaaaccaggtgtttgatatcaggtgacggttgtgatcattgttcgcaccactactttgaaatgacataggtgccactggaccttgttatttaatgtgcgaataaagagacagttatttaaggcattaataagagctatattacaagtttttaaaagtcttttgaggactgtttcaaaaagtcttttgaggactgttctcctttgcaatcctctgtaaatgcaccattgcattccaacccgggcaacaagagcaaaactctatcaaaaaaaaaaaaaaaaaaaaaa

SEQ ID NO: 20510 - DNA, 148 bp, Homo sapiens
  misc_feature 24, 29: n = A,T,C or G
gtatgcagttgataaggagggganccggnataattatggtgggtgattattttttatactgtatgtgccaaagctttactactgtggaaagacaactgttttaataaaagatttacattccaaaaaaaaaaaaaaaaaaaaaaaaaaa

SEQ ID NO: 20511 - DNA, 267 bp, Homo sapiens
  misc_feature 23, 25: n = A,T,C or G
tggatcaggacatcccaatggcncngccggtgttaaaggttcggttgttcaacgattaaagtcctacgtgatctgagttcagaccggagtaatccaggtcggtttctatctacttcaaattcctccctgtacgaaagggacaagagaaataaggcctacttcacaaagcgccttcccccgtaaatgatatcatctcaacttagtattatacccacacccacccaagaacagggtttgttacgaaaaaaaaaaaaaaaaaaaaaaaaa

SEQ ID NO: 20512 - DNA, 500 bp, Homo sapiens
  misc_feature 17, 21: n = A,T,C or G
ctacgtttgattggtgntccnccaagtgatggggagaatggatgcaagttagaaaacaatcttcaggatattatccagggagaacttcccctacctagcaaggcagaccaacattcaaattcaggaaatacaggagaacaacacatacatactccttgagaagagcaaccccaagacacataattgtcagattcaccaaggctgaaatgaaggaaaaaatattaagggcagccagagggaaaggtcgggttaccctcaaagggaagcccatcagactaacagtggatctctcagcagaaaccctacaagccagaagagagtgggggctaatattcaacattcttaaagaaaagagttttcaacccagaatttcatatctagccaactaagctttataagtgaaggagaaataaaatcctttacagacaagcaaatgctgagagattttgtcaccaccaggcctgccttacaagagctccctgaaggaagcactaaacatg

SEQ ID NO: 20513 - DNA, 205 bp, Homo sapiens
  misc_feature 128: n = A,T,C or G
taaatccttacttttaatcatagttaacatattttaaaattacttttggataagtgggattgatccaacccaaatcaaattgttaaatgccctcttgaatttttttgtctgttatttaattatatggnggaattaataataaaataaacttcatggctctgattcaaggctgtcgcaaaaaaaaaaaaaaaaaaaaaaaaaaaaa

SEQ ID NO: 20514 - DNA, 400 bp, Homo sapiens
  misc_feature 229: n = A,T,C or G
cttgaaatatataatattcagccagcttaaacccataacaatgtaatgtacaatacaatgtacaattatgtctcttgagcatcaatcttgttactgctgattcttgtaaatctttttgcttctactttcatcttaaactaatacgtgccagatataactgtcttgtttcagtgagagacgccctatttctatgtcatttttaatgtatctatttgtacaattttaaagntcttattttagtatacatataaatatcagtattctgacatgtaagaaaatgttacggcatcacacttatattttatgaacattgtactgttgctttaatatgagcttcaatataagaagcaatctttgaaataaaaaaagatttttttttaaaaaaaaaaaaaaaaaaaaa

SEQ ID NO: 20515 - DNA, 490 bp, Homo sapiens
  misc_feature 39, 41: n = A,T,C or G
agggaagctctttaaaacaaatatcatttctgagcgagnanaatgttcagcatctcagcctcatttgtatcatttgataaaagggccccactgagccaagtgtgaggatgatgcttgagccagacacatagacaccagacattcctctgatgtctgctccccaggcttggccacattgcctcccaccaaccccatctcaatgacacatccattacctgccatcagttggctctatggtgctgggaatgacagagtgtatctaccctggatttcagaaaggaccctcctggcttatcatggcaacaccctttggacactcgtttaaagagtccttctttgggccagtgttatccttttgggggcatctggtatggacggccaatttgaatctgactgggacatgctaatgagccattcatatgtgtggggatttgtttctgattcgattaagcttcagagagaggaaagaaagagccactgattagagacg

SEQ ID NO: 20516 - DNA, 500 bp, Homo sapiens
  misc_feature 326, 416, 451: n = A,T,C or G
cccatatatatagtctccttgctcatgttaaactcataattagctaccagggaaatatttgtggaattacttatttcacatcatatttttacatatctactgaggctgatgagacaaatcataagaagaataaacatattttagcccatctgtgctgctataacaaaaataccgtgaactgggtaggttttaaatagcagaaatttatttctaacagttttagaagctgagaagttcactatcaaggttccagcagatcagagtgtctagtgatgatacattttctcattcataattgataccttctagctgtgttctcacatggnggaagggacaaaggggttctcatgggccttttttttataaaggcactgatgtcattcatgagggctctgctcccatgacataattacctnccaatgggtcaacttcctgataccctcacataggngatggggttcaacatatgaattttggggggacacaatcattaagaccct

SEQ ID NO: 20517 - DNA, 500 bp, Homo sapiens
  misc_feature 17, 20: n = A,T,C or G
caatatatacttgtcgnatnaatgattaagtcactgacttattggctgtggttccatagccacattctgggactatttaaagctccactgtttcttctaggctgctgtgaggattaaatgagaaaacacatggagaaacaacaggcatatggctgacaaatcataagccctttctaatatccttggaacccaaatcttaactgggacttggtcgggtcatttaagcagctcatctgagatcaaggtttcactgaccctacaggggaattagcatgttaaagggaaataaagcatctgaaattctattgtcttctctacaaacctcatcacagggtacaaaaaatagaggaaggaaaatgtaaaagcagctaagaaaatagagaggcaaggagataacctagagtgaatgagggggcagataataaagatgaaatgcaaaagtacatgagagctctctgatgaacaactctggtcattgcaaacttaaaaaaaaaaaaaaa

SEQ ID NO: 20518 - DNA, 500 bp, Homo sapiens
  misc_feature 53, 410: n = A,T,C or G
aacaaattggcagtttatatatacactgattatattcctatccttccatgttntgttatcatatgtttttgatttttgttgttacaaaaataatgaaaataacacaaattatagtaatatataatatgtgaagaataagctttatcttctgtgtttcctgctgttcctatatttttacaaattatctatgattacttatatttttagttattgtgagctaataataaaatacacctggggagagagtttgtcaaggtgcagaggggagtgtttgtatactcttggtggcaaagtcatttggtgcattgttttaggagacagtttggaaatatgtagttgaatttaaaatgtgaactccctttgatcatgcaatttcactactaggaaaactcttctactgatatgcttgnataaacatgcaaaggtagatagaaggatgatcacaaaagtgccctttagaaatgagaaattgaaaacaaactaaacattggtcagtaaaa

SEQ ID NO: 20519 - DNA, 380 bp, Homo sapiens
  misc_feature 27, 49, 54, 302: n = A,T,C or G
cccacaaaattattttgtttcttaccnttagcatgtcttttagaataangggcncctctagtaaacacttccattaaactaatctaagctcttatttgtattttttgagcttctccatctcctcccatctcatcattataccagagctaaggttgccttcataaggtaccatttctgttaaataacttcagggctcaagaatttaaagtgactcctttttgcctgcagtcaaattcttgtgtttgaggttcaggtccaactgacaggtgtagtcactgagtatttacttattgggtactggnccatctttgcgatccatttttctttgttttttgctcatggggcttttcttatatggtagctatgtttaactgtaagct

SEQ ID NO: 20520 - DNA, 440 bp, Homo sapiens
  misc_feature 12, 21, 403, 436: n = A,T,C or G
ggccaagccagnattgtatcntcacttgtgatggtaaaaacctcaccataaaaactgaggagcactttgaaaacaacacagttttcttgtaccctgggagagaagtttgaagaaaccacagctgatggcagaaaaactcagactgtctgcaactttacagatggtgcattggttcagcatcgggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactggttctttcttttttttttcattactgggntcaattatctttatcataaacattttacatgcngctt

SEQ ID NO: 20521 - DNA, 500 bp, Homo sapiens
  misc_feature 23: n = A,T,C or G
aggagtctcgctccgtggccttngctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaaggatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatggtaacatg

SEQ ID NO: 20522 - DNA, 120 bp, Homo sapiens
  misc_feature 24, 84: n = A,T,C or G
tgtgacttcgaggaccaaaggaanctgtcagctatacatttatctttatgaactcatttatattcctttttaatgactcgttgntctaacatttcctaggaagtgttcttataaaggtct

SEQ ID NO: 20523 - DNA, 430 bp, Homo sapiens
  misc_feature 37, 150, 382: n = A,T,C or G
tatacaccaggagctgccactgcatgtcccaaccagnactgtgtctgtctgtgtctgcatgtaagagtgagggagggaaggaaggaactacaagagagtcggagatgatgcagcacacacacaattccccagcccagtgatgcttgtgtngaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggntaaatacacacaccatacactatccacggatatagccaagtagatttg

SEQ ID NO: 20524 - DNA, 148 bp, Homo sapiens
  misc_feature 17: n = A,T,C or G
acatatttcaatacagnaaactataacattcaatagtgtgctgtcaaagtgtgcttagctcacctggatatacctacattgttaaatgtctaaacagtaatcattaaaacatttttgattaaaaaaaaaaaaaaaaaaaaaaaaaaaa

SEQ ID NO: 20525 - DNA, 483 bp, Homo sapiens
  misc_feature 23, 433, 435, 454: n = A,T,C or G
cctttgccatagttcagctaatngtagttttatataggaaatgatcctgaacactctgaacttgacgtagtcctgcggtgatattctatctgcagtatttgtacctccagaatggcagatccctcagcaggaacaaaggcatattgacggttctctcagcgtatgcattaaaaaaggtacttcctgaaacttttgattcaataatgactaaacatactatgtacacaattactgtaaggctaattcacgtgccatactccacctgaaagcctgagttatcttgctataagcttttcatggagcacttcctttccagaaactgatttgtaactcatttagagaatgtcctggcgtcggtttttagcatatgtggtatttaaacagagctagaatgtgatgtctgaagataatgctgcatttctgggtttcttgngnggattttaaaataaattgngcctacgaaaaaaaaaaaaaaaaaaaaaa

SEQ ID NO: 20526 - DNA, 130 bp, Homo sapiens
  misc_feature 24, 35: n = A,T,C or G
agaggatctcttgagcccaggggntctaggccagnagtgagctgtgatcgtgccattgcactccagactgagtgacagagtgagactgtgtctaaaaaaaaagtttgaattaaaaaaaaaaaaaaaaaag

SEQ ID NO: 20527 - DNA, 340 bp, Homo sapiens
aatttgaggggccgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctattttaggggttaattactttagtaataagtggaaagtaagataccttgagtaatgtttgcctataa

SEQ ID NO: 20528 - DNA, 500 bp, Homo sapiens
  misc_feature 51, 152, 250: n = A,T,C or G
tcataatgaagttaaagtgagtatactgtggagaggacttccaaatgtggntacctcagctatatcactgcccaacatcagaaaacctgacggctatgattactatgccttttctaaaggtaaggtattaactaacagtttcccaaggaggngatatcatttgtgaaaacatgaagataaagtaaaaatgctggctgcaatgatgactgaatgtgagaagttacactacggtacttattctaattgctgnggaaaagagttaagacttttgctttaatttcaattaaaatgatggcactgcaattcaattctgctctaaccttcatgagattacgataaaacatccagttactagagtaaacttgctactgacaatagtattttaccttctatcatttggggcatttaacagataccttgtttggcacaagggtataatgatttgcatcactgcagagtctgtaagatcagaaagaagttcctgagaactaattttatta

SEQ ID NO: 20529 - DNA, 500 bp, Homo sapiens
aaggatagaaacaaaaacttctcatccagttaactagagtgaatgtagggagaattgttttgcttgtaacatggagagtttattttcaagtgaggaaagagaaaaaaattactcagacttgttcctggtgaagtgcattctctgtttgtatactttttgatggagaaattgatctatagaactgcttaattttttgaggcatttagacagcaatgaaaggtagttctccacaggacaccgaatcaaaaggagagaccagactctggcctcatacccagcctatttgaaacaagctatctagtttctcctgcagacaccttgtcaacaacatgcaacagtgtcaggtgccttgcaggaaaataatctgagtcccaagctagcctgtgctcatccacaatcacaatgaacatgtcaaggaagaatttgcagagactcaagggaagcacaatgggataaggtaatcactttcagtgaaaaactgttttcttgaaaacaggctt

SEQ ID NO: 20530 - DNA, 194 bp, Homo sapiens
  misc_feature 45, 52, 69, 144: n = A,T,C or G
gaagtagtctcgggtatgctgttgtgaaattgaaactgtaaaagnagatggntgaaagtactggtatgntgctctgtatggaaagaactaattctgttacgtcatgtacataattactaatcacttttcttcccctttacagcncaaataaagtttgagttctaaactcaaaaaaaaaaaaaaaaaaaaaaaaa

SEQ ID NO: 20531 - DNA, 500 bp, Homo sapiens
  misc_feature 22: n = A,T,C or G
atatggtgctgggtgcaggatncagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctca

SEQ ID NO: 20532 - DNA, 110 bp, Homo sapiens
  misc_feature 39, 79: n = A,T,C or G
gtgaccccccagaccatactgactcaacatggggtctcnctggccaagaaaaattgcctttaaaactcgaaaaaaggcngggggggggactcacacttgtatcccagcat

SEQ ID NO: 20533 - DNA, 536 bp, Homo sapiens
  misc_feature 41: n = A,T,C or G
tgcctgacgccgcctttttgggtcgcatgcatgctcccggncaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttagcaaaaaaaaaaaaaaaaaaaaaaa

SEQ ID NO: 20534 - DNA, 480 bp, Homo sapiens
  misc_feature 23, 44, 416, 441: n = A,T,C or G
taactttctctttgccatttctncttcttcttttttaactgaanctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgntttggtttgttcataatacaaaggngctaattaatagtattttcagatacttgaagaaggtgat

SEQ ID NO: 20535 - DNA, 500 bp, Homo sapiens
  misc_feature 400, 483, 489: n = A,T,C or G
ggaaggaagttagagtcagggaacttgtataccactatctatgcagcattgttatagtctgattatttctgtgttttgaatatgattttcctaatgctctaaataaaattttgttaaaaattaattttttatttaatgatgtgcaaatattgaatattttagtatatttattaaaagtggtagtcattaaaaatgcccatgttttagagttcatgtttggaagtttccattataggttaaggatttatattagtattgtccaaataaaatagtatagttttttttattgctctgttcagcagtagggtagtagaaaagccaaatgttaaaattatgagcttttagcttaaaaaaagttaatggtaagtaaaatctccttttaaatttctcagctatttgngagcaggttagctttaaagcattatctcttcactttaagaaagccaaatacaaaagtatattctgcattctttataagggagnattaangggggactaaa

SEQ ID NO: 20536 - DNA, 500 bp, Homo sapiens
  misc_feature 153, 353, 387: n = A,T,C or G
tcaatcgctacaaattcatctcatggcactaaaggaattttcagctgggactttggaatcactcttggaaaactttggaaaatccaggaaagaggagagatgagccaatttcttgatattttgcaacaaatggatgcctaaaattagacgtgntctgtgatgggaactaccaaatggatgaattgacagctcttgagaagacagtagtcattagatgctagccaggatgccaggctaacctcatttccttttttaaaaaaaatgattactgaacctagagtagaaaaattcccagggcatagtgtatctcagtttatgcaagtcacctgagaagtgataaattatattatggntgtgggcattttgtggatacatgtattgtatggngagggatttatgggttttggagcaaatgatctcccagagataaattaatcgaatagaagtctggtctttaaagagatgctgctttaatatgggtctgctcaacagttaatcag

SEQ ID NO: 20537 - DNA, 316 bp, Homo sapiens
  misc_feature 24, 43, 47: n = A,T,C or G
tgttctaatttacttgggttttgnttttttcccccattaagtngctnttgttattcatttgaaatacatttaagtttgttagttcctaccgtttggccttttttattactctgttcttggtgacttgattgtatgagtatgtaaaaatattagcatgctaccaaaagttaaaactagctgggtgtggtggctcacacctgtaatcccagcactttgggaggctgaggcaggtggatcacttgaggccgggagttcaagaccagcctgggcaacacagggaaaccccgtctctacaaaaaaaaaaaaaaaaaaaaaa

SEQ ID NO: 20538 - DNA, 394 bp, Homo sapiens
  misc_feature 9: n = A,T,C or G
gctcttagnagtttgattttcgcaactcagttcacatcttcttcttactccaggttcccagctccttgagccttgcccgtgaaggggttggagtcaggatgggaagccttgagctgccttgacctgctccatctctgactcagggatgtgccctgcttgtcacagcatgggtgtgctgggccttggggcatcttttcaggcagagagcaagacgttggcattgtggaaagctgtacctccaaacagcagcccattcacagactacagaggaagaaaagaccatacttgctacagtaacaatgcaattcagtaccagggaataacttaacatgaaacatgtcaaatctatgtaaacaactggaaggcactcctaaaaaatacttaaaaaaaaaaa

SEQ ID NO: 20539 - DNA, 308 bp, Homo sapiens
  misc_feature 8: n = A,T,C or G
caaaaagncatggaacaaaaggcaactgatggtataaaatagaagtgccagggactgcggaaagggcaactggataggggacacagataaaagaagctgaacaaagtacggctagaaagcatttgtttatttttcaactagcagcagaaccagccattctgcaatggtagattggaaagagaagatagtgacgacactggaaagactctcaagacctggagctgctctttgaaaagctttggaataaaacagctacgttgggccataggaaatgcgctaaagacaaaaaaaaaaaaaaaaaaaaaaaa

SEQ ID NO: 20540 - DNA, 234 bp, Homo sapiens
  misc_feature 28: n = A,T,C or G
cgcaacaatgcagctcaaaacgcttagnctagccacacccccacgggaaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaaaaaaaaaaaaaaaaaaaaa

SEQ ID NO: 20541 - DNA, 137 bp, Homo sapiens
  misc_feature 23: n = A,T,C or G
tgctgcatgatggtcagtgagcngatctgttatggcattcacttccagaattaattttccgtgtttgaagtatgtgcatatgtgctttacagaataaaacatctgattttaaaaaaaaaaaaaaaaaaaaaaaaaaa

SEQ ID NO: 20542 - DNA, 510 bp, Homo sapiens
  misc_feature 13, 16, 383, 386, 422, 492: n = A,T,C or G
cttctcaccttgnagnataatcctaggaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaaatcactgcagatgacaggaaagtcaagagcaccataaccttagatgggggtgtcctggtacatgtgcagaaatgggatggaaaatcaaccaccataaagagaaaacgagaggatgataaactggnggnggaatgcgtcatgaaaggcgtcacttccacgagagnttatgagagagcataagccaagggacgttgacctggactgaagttcgcattgaactctataacattctgngggatatattggtcaaaa

SEQ ID NO: 20543 - DNA, 250 bp, Homo sapiens
ggcgttatttctgagggctctgttctgttccattgatctatatctctgttttggtaccagtaccatgctgttttggttactgtagccttgtagtatagtttgaagtcaggtagtgtgatgcgatctaattaaactaaagagcttctgcacagcaaaagaaactaccatcagagtgaacaggcaacctacaaaatgggagaaaattttcgcaacctactcgtctgacaaagggctaatatccagaatctac

SEQ ID NO: 20544 - DNA, 390 bp, Homo sapiens
acagttgttctcccagcattgcatttgagctctgagaatggacagactgcctcctcaagtgggtccctgacccccttgtagcctaactgggagacacctcccagtaggggccaacagacacctcatataggtggctgcccttctgggacgaagcttccagaggaaggatcaggcagcaatatttgctgttctgcaatatttgctattctgcagcctacattggagatacccaggcaaacagggtctggagtggaactccagcaaactccaacagacctgcagcttgagagacctgaccgttagaaggaaaactaatgagcagaaaggaatagcatcaacatcaacaaaaaggacatccacaccaaaaccccatccataggtaccaacatc

SEQ ID NO: 20545 - DNA, 270 bp, Homo sapiens
  misc_feature 24, 108, 157, 195: n = A,T,C or G
acagcctctatatttgatgctagnaaaacacatatttttaaatggaagaaaaataaaaaggcattcccccttcatccccctaccttaaacatataatattttaaaggncaaaaaaagcaatccaacccactgcagaagctctttttgagcacttggnggcatcagagcaggaggagccccagagccacctctggngtccccccaggctacctgctcaggaaccccttctgttctctgagaagtcaagagaggacattggctcacgcactg

SEQ ID NO: 20546 - DNA, 499 bp, Homo sapiens
  misc_feature 25, 26, 204, 289, 295, 297, 313, 406, 468: n = A,T,C or G
ccaacaaactatggcttactggccnnatgtggcccagcacctttcttttgtaaatagaattttactggaacacagccatgcctattcatttaggtagtgtctatgacagcttttgagctgcaatagcagagttagtggttaccacaggggcctgcaatgcctaaggcatttggccccttccagtaaaagttttcccacccaggnattacaaaaggtcttgtattattacttctgtatttgaagaaatagataagaactcagtttcatcattattttggagaactaacancttggntnctcattttagatgagncaaacagagatgagttgtgtgggcagtgagttgagtatcacattgcataatagctaatttctccccacaggcagtgtatggtacccctgaagnttttctaacctgcttaaaataagtttccaggagcaggcagtcctttgaatgcagggctaaanccctctattctgttgagtggctgttttggag

SEQ ID NO: 20547 - DNA, 250 bp, Homo sapiens
  misc_feature 221: n = A,T,C or G
cagaggcaccctggatcttttgacgtggttcacgtgaaagatgccaatggcaacagctttgccactcgactttccaacatttttgttattggcaagggcaacaaaccatgggtttctcttccccgaggaagggtatccgcctcaccattgctgaagagagagacaaaagactggcggccaaacagagcagcgggtgaaatgggtccctgggtgacatgtcngatctttgtacgtaattaaaaatattgtg

SEQ ID NO: 20548 - DNA, 307 bp, Homo sapiens
  misc_feature 29: n = A,T,C or G
gctggaaccaacactacaaaccaactagnaactaacaaacatatagaactctccactcagtaatggcagaatgtatattcttcacaagcatacatggaacaatctccacagtagaccatatgttaatccataaaaccaaccaataaatataaaaggattgaaataatacagagtgtgttctctgaccatagtacaatgaaatttaaaaatcagtagtagaaaaaaattggagaaactcacgaatatatagaaattaaatacacttctacataactgtcacaccaaaaaaaaaaaaaaaaaaaaaaaa

SEQ ID NO: 20549 - DNA, 190 bp, Homo sapiens
  misc_feature 49, 175, 187: n = A,T,C or G
agctttggaagctggacttcaattcgtcttttctcattcaacacaaagnacgtcactcattcgcaggacggactctgcctcccaggcctggaccccagtcactgggattggacgttccagttaaaaatacaactttagaagcacctcatttgagctggcctcgagaacaacaaantagtctcacacngga

SEQ ID NO: 20550 - DNA, 359 bp, Homo sapiens
  misc_feature 298: n = A,T,C or G
gctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccgtgagctataatcaacggtgagctttaatgtctatgctgacagttaggttttgctctcttttgtaacaggttacgtagaccagcagtgtttaaatctaaatacgttgngagtctgttatctgtcctatcgcggtttttaaatgactttttattctttatcatagctaag

SEQ ID NO: 20551 - DNA, 150 bp, Homo sapiens
  misc_feature 67: n = A,T,C or G
cttcgcttttcctccgcaaccatgtctgacaaacccgatatggctgagatcgagaaattcgataagncgaaactgaagaagacagagacgcaagagaaaaatccactgccttccaaagaaacgattgaacaggagaagcaagcaggcgaa

SEQ ID NO: 20552 - DNA, 410 bp, Homo sapiens
  misc_feature 27, 55, 62, 103, 112, 113, 126: n = A,T,C or G
gctggtggcaacatatccattcattcnctgctaaaggacagaaaaatactgatgngtgtttnaactaactggtatattgataccatgggaggctgcacagaanaccctgcgnncaggaggggcatngtcagtggctgcttctcctgagctccacgccttcattgcagctgcatgttcgatacaatacacctgcttcacagccccatggacatccctacaggtactgtcatgtgaagccttgcctagtagttctctccagggcaaatgaagctcacagttttgcaaggtggaaacctcttattcacatttgctttgattccccgatggagtagactgccgttgttccatacaggcaaagtaaggatattttaatatcatcctccttcttattagcatttcatttgtctatg

SEQ ID NO: 20553 - DNA, 300 bp, Homo sapiens
  misc_feature 211, 278: n = A,T,C or G
ataattgttaatcactttgcaaataggggctatcagattacctatattggcattgctggattataaactctatatctgcaatataaagtgtttgagtttttaattgggctgttatgatcagtagttgattttgagaaagctctatgagctctaagtaactgcatggttttttgtttaatgtaatataggagacccttcacattcccaaggnatatattccaaaacatttttgtgaatatctaagtttgtgaacctactagggcatgatacagtaaggngtaattacagaatttacgaaat

SEQ ID NO: 20554 - DNA, 370 bp, Homo sapiens
tttcatactttctgcattatttcatgtaaattttctacacatttgtatacaaaatcggatacagcaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacttaactaggaagtggcagaactgattctccagccctggtagcatttgctcagagcctacgcttggtccagaacatcaaactccaaaccctggggacaaacggcatgaaataaatgtattttaaaacatc

SEQ ID NO: 20555 - DNA, 171 bp, Homo sapiens
  misc_feature 21: n = A,T,C or G
attttgtaatctgtataaggntcaactgatcactttttatataacaaaaagctcaagtattaggggaaatagtttgtctgatacagtcatgtaaattatcctctttcagtattttcgcattattaaaggattaccttcctcctaaaaaaaaaaaaaaaaaaaaaaaaaaaa

SEQ ID NO: 20556 - DNA, 310 bp, Homo sapiens
  misc_feature 9, 24, 122, 142, 189, 192, 214, 247, 290, 293: n = A,T,C or G
tgtactgtncctaaaacagctaantatcttctctctccccctttgacaggaaggggcttcaggtgttcctccatggctagaaccgtaataaacaatgagcccgtaatttgtaacataaagtntgcatatatgttagtaacanttcttgcagccttcctttccagagttcattttattttgatcagatcngtntcttgcactaattattttaggnattttcattatatggaaagctaccatgtgtcangagatgatttaatctatttaagtgttggactgctaggagaacntgnacatttatgataatgca

SEQ ID NO: 20557 - DNA, 355 bp, Homo sapiens
  misc_feature 18, 63, 192: n = A,T,C or G
tttgcctgccttttcagnaatcatcttttgaagctttctgttgatgttaactgagctactagnagatattcttatttcactaaatgtaaaatttggaataaatatatatgtcaatatttagtaaagcttttcttttttaatttccaggaaaaaataaaaagagtatgagtcttctgtaattcattgagcagntagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatt

SEQ ID NO: 20558 - DNA, 180 bp, Homo sapiens
  misc_feature 2, 13, 54, 145, 159, 166: n = A,T,C or G
anataaagccctnacttgcccttggaccactctattgctactattagaagcagncttacaatggaaattaacactggaaaataatagggaaggaaaatatcaggaccccttaaagggcaacattaaggctgctgactgggatctncctcagcaatgctncctcctnattacataagggca

SEQ ID NO: 20559 - DNA, 440 bp, Homo sapiens
gttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcattgggggtaccccaatctgaagtcagtaaatgaactaatctacaagc

SEQ ID NO: 20560 - DNA, 430 bp, Homo sapiens
tgttttcataaaatgtagcattttttttcttatggaaataagagtttcaggtgtctccccacctagggcaaattcgtgcacattgtcatgttataccaccattctggaaatgatttctgtggatttgaaattgcacttttaattttatatatgacagcatttaaatgcaaacactaccatgaatttaatgtataaaatgttgtcaaaccaagggaaaaaaccacagttcaccatgtggagtttactttttttatatgaatgtttgttgtactgtgtctaagcataacttccctaatgtcattacttttacataccagatttgactgaccactaatgtagtactggggataacttaatatcctatgttgtgtcaagactctttgaagactttcttgaattgctttcgtaaaggtctgaacactgttaagga

SEQ ID NO: 20561 - DNA, 493 bp, Homo sapiens
gcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgccgttcgaaagcatcttgagaggaacagaaaggataaggatgctaaattccgtctgattctaatagagagccggattcaccgtttggctcgatattataagaccaagcgagtcctccttcccaattggaaatatgaatcatctacagcctctgccctggtcgcataaatttgtctgtgtactcaagcaataaaatgattgtttaactaaaa

SEQ ID NO: 20562 - DNA, 330 bp, Homo sapiens
  misc_feature 21, 150, 151, 159, 208, 220, 223, 265, 273, 292, 297: n = A,T,C or G
cacgtgtcgccagggccggcntgcgagtctctttgcggcgctacactagagcagagtacgagtctgaggcggagggagtaatggcaggacaagcgttaaaaaagtttcttccactctttgaccgagtattggttgaaagggagtgctgcnngaaactgnaaccaaaggaggcatgatgcggccagaaaaaatctcaaggaaaagtatngcaagcaacagnagncgctgggtggatcgggttctaaaggaaaaggggggagagatncaaccagntagcgggaaagggggaganaaagntcttctcccagaatatggaggcaccaaaggagg

SEQ ID NO: 20563 - DNA, 500 bp, Homo sapiens
  misc_feature 493: n = A,T,C or G
gccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgnaggatgt

SEQ ID NO: 20564 - DNA, 400 bp, Homo sapiens
  misc_feature 12, 20, 45, 393: n = A,T,C or G
tgggcttcaagnaacccttntaggctattgagggcacctaacatngacaaggaaagccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaaggaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagntattttt

SEQ ID NO: 20565 - DNA, 154 bp, Homo sapiens
  misc_feature 23, 24: n = A,T,C or G
ccagtaatcaatttggcaacttnnatcgaggttttcaaaattccaaggagggttaataaagaatgataatcagttttatttgctaatagctaagacaaatttgtaataaagtgttttataatactccaaaaaaaaaaaaaaaaaaaaaaaaaaa

SEQ ID NO: 20566 - DNA, 380 bp, Homo sapiens
  misc_feature 333, 345, 372: n = A,T,C or G
accaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcnccccatgctgtngattgctaaatgtaacagtctgatcgngacgctga

SEQ ID NO: 20567 - DNA, 128 bp, Homo sapiens
gaaattattaatgcaatttatgaacctacggaagtaagtaatgtgaatggaaaccagatgaagaagatgagatttcggaggaattgaaagaaaaggccaagattgaaaaaaaaaaaaaaaaagaaaaa

SEQ ID NO: 20568 - DNA, 500 bp, Homo sapiens
  misc_feature 24, 32, 488: n = A,T,C or G
actttgctattacttatacctgcngccatagnaaaaaaataagtttattcatgacacatttacatttgatcataaataaaagaaaaaagggcacctttttggagttagtcatggtagtcattagtgatatttctgaacagttcttaatttaaaatacttcaaaggaagtaaaggtcatggcttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattccttgagtctgagcttgngggtggaattct

SEQ ID NO: 20569 - DNA, 300 bp, Homo sapiens
  misc_feature 273: n = A,T,C or G
ctgctgagggggcaggcggcccttgaggaaaccgcagaataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtataanaaaaaaaaaaaaaaaaaaaaaaaaaaa

SEQ ID NO: 20570 - DNA, 400 bp, Homo sapiens
  misc_feature 80, 115, 369, 371, 383: n = A,T,C or G
ttttaaatgtcttacctcctcatcttttcttcttacacagtgtctgagaacatttacattatagataagtagtacatggnggataacttctacttttaggaggactactctcttntgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgaggacaactctctttttccaacaagagagccaagaagccattttttttccatttgatctgtttccaatgngnccatttggatgncagtgctattcacgagt

SEQ ID NO: 20571 - DNA, 234 bp, Homo sapiens
gtataaagtgaacagttgcaaccatttatcaaaagaaaagctgctgtggcaatattactattagacaaaatagaattaggaaaaaaatcataactgtagataaacgtttcactaagttaaaggtttcactgagaagaaataaaaattttgaatttataagtacttataacaacattaagaaactagaaaatagaaaaagaatagagccaaattgactgactaaaaaaaaaaaaa

SEQ ID NO: 20572 - DNA, 360 bp, Homo sapiens
  misc_feature 39, 64, 79, 207: n = A,T,C or G
cactagaacataatgcttttgacaaaaatgtaaagacgnatgaaaaaatgttttagaacctttncaatcacttcttggngaacaaagttagtattatagagaggcttagtgatgtttccaaaatgtaaatcattctgacagatgacacatcagtggcagaaaaatcatggacagattctgggaaaaaaatgccaatatgtttaaagnctatgtttaaaatattagctttttaaatgggatctttcttaatttctttattttgggaaaactcgatattcataaactgttaagaatgactttttaaaattcattttcttaccctccctcaaataagaatgagaggatactaacaaaataatt

SEQ ID NO: 20573 - DNA, 500 bp, Homo sapiens
  misc_feature 379, 465: n = A,T,C or G
ggagaaagggccatgttcctaactttggagatacgtcattgccgggaacctagtatcttccaacttgaattggtggcagctgttccagtgagacaaggcacatgtatgccttgtggctaagtgagcaaactgggtttccacttaaatgtttgggaccctcaattgattctttatttcaaacctttataaaaggtacagttttgtaagccattattaataattaatgcttatcggctgggcacagtggctcacacctataatcccagcactttgggaggctgaggcggttggatcacttgaggtcaggagtttgagaccagctggccaacatggtgaaacagcgtctctactaaaaatacaaaaatttgccgggcgtggnggcgcatgcttatagtctcagctactcaggaagctgaggtacgagaatcacttgaacccaggaggtggaggttgcagtgagctganattgtgccactgccctgcagcctgggcaacagagc

SEQ ID NO: 20574 - DNA, 100 bp, Homo sapiens
  misc_feature 15, 29: n = A,T,C or G
agtggtggctggggnaatttgtgctccanatccagccaggcatctcggcgctttggcacccatggagttctattgtcttgggggccggacgaacacttgt

SEQ ID NO: 20575 - DNA, 500 bp, Homo sapiens
  misc_feature 20, 61: n = A,T,C or G
ccctggttcatttaaatagnaaactcatctttctttctcatatctggaaattacattaagnacaggtaaaccttggaagttattcagtgaattgcttgaatatcggcattcaagtcggacagggaggagccaaaagtatatcatttaggacataaagttagctttgaaactacaaagttatccaattatgacctatgcaaggcatgtttccaaatatttaatagaagcagtgttttggaaattcttttctccattaggaaggaaactttattcaccttcagaaaccatgtggtgtgtttgatagtaattaaatatatatatagttttcattttgtttccttttaaatgctgcaaaaataaacctcaaggatctgttcacatagctgctactggagttttatctcattgaatattctttagaataataaggattagaacaaggcattataaattttcttgctaaattatcttaagtcatttaatagtcttgcccttagaga

SEQ ID NO: 20576 - DNA, 259 bp, Homo sapiens
  misc_feature 1, 4, 8, 9, 18, 22, 26, 95: n = A,T,C or G
nttnggtnnccaggccanttcntttncattatggccgggtagcaatcttagttcaactttaaatttgtccacaggaaccctctaaatccccttgnaaatttaactgttagtccaaaggggaacagctctttggacactaggaaaaaaccttgtagagagagtaaaaaatttaacacccatagtaggcctaaaagcagccaccaattaagaaagcgttcaagctcaacacccactacctaaaaaaaaaaaaaaaaaaaaa

SEQ ID NO: 20577 - DNA, 174 bp, Homo sapiens
  misc_feature 19: n = A,T,C or G
tgtcacacacgcccaaaancaggcttttaaaaatctctttgcggccaggcacagtggctcatgcctgtaatcccagcactttgaggggccaaggcaggtggatcacgaggtcaagagatcgagaccatcctggccaacatggtgaaaccccaactctacgaaaaaaaaaaaaaa

SEQ ID NO: 20578 - DNA, 510 bp, Homo sapiens
  misc_feature 25: n = A,T,C or G
agggctacatcgtacttccgaatgnctgatgaaggtggagaatcagaacttcttggagaggatcttccacttgaaccttctgtcaccaaagcagaaaggagtcacttgatagtgtggcaagtgatgtatggcagtgagtgagcccatgggaaacaggtggagatggggaagccgtttcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtgggttactctgccacaggctaatgtcattcacttcatttgatggggtcacttgttagctgtcactaataatggaattaatgggaaa

SEQ ID NO: 20579 - DNA, 243 bp, Homo sapiens
  misc_feature 35: n = A,T,C or G
gaaagctttactgagggtattaccaaggaaccagnattttgaaggaaatatgttttttgagaaagagggcattcttcttagccatagagcatgaacaaagacattattggaaggagcatcctcattatttattgcctaattattataaaagcaaagttgtttcctataggttgattgaattaggcattagctcagcatactggggacagccattggaaaaaaaaaaaaaaaaaaaaaaaaaaa

SEQ ID NO: 20580 - DNA, 417 bp, Homo sapiens
  misc_feature 23, 24, 183, 188, 205, 262, 271, 272, 275, 382: n = A,T,C or G
tgtggctatttgtgtttccattnnacgttggttttaaatatgggaggaatgtgttaggaatttaaaacaccatgtcagctagggattgtgaacttaattaaaagcatttctttagctgggcactgtggctcattcatggaatccccagcactttgggaggcccggaggcaggcagatcacttngtggncaggagtttgagactancctggccaacatggggaaaccacatttctaccaaatatataaaaagttagccagggnggggggccnnccncctggtaatccccactactctggaggctgaggcaggaaaatctcttgaacccaggaggcggaggttgcagtgagctgagatcattccactgcactccagcctggggngacagagcaagactccatcccaaaaaaaaaaaaaa

SEQ ID NO: 20581 - DNA, 100 bp, Homo sapiens
  misc_feature 4, 10, 42: n = A,T,C or G
tgtncttatncaagtggcctttttaaaaaattattaggactnaaaataacaccacattcccctggccccaggtttttttttttcttttaccaagggggga

SEQ ID NO: 20582 - DNA, 100 bp, Homo sapiens
  misc_feature 24: n = A,T,C or G
catggaggaatcttgaacacgtgntgctaggtgaaaaaggtcacaaacgtccgtgtgtgctgcaatgccatgacctgcctgggaatacacggattcatag

SEQ ID NO: 20583 - DNA, 440 bp, Homo sapiens
  misc_feature 15, 48, 65, 242: n = A,T,C or G
gagcactgttaaagnaactgtgcagacgctggtatccaggaaggaatntgaatttgcaccaaagnaaggctgcttctcatagggcacttgatgacattagtgaaagcatcaaagagcttcagttttaccgaaataacatcttcaagaaaaaaatagatgaaaagaagagggaaaattatagaaaatggggaaaatgagaagaccgtgagttgatgccagttatcatgctgccactacatcgntatctggagacaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatat

SEQ ID NO: 20584 - DNA, 498 bp, Homo sapiens
  misc_feature 23, 42, 108: n = A,T,C or G
tgaagtaaacagccttctcaagnatttgtgaagtgactgagnaatctagcacttctccacttgtagctgcactttaagtctcagcagaagatacgatcgtctgccttnataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtataccaggaactgaaaatctttgaacagatattaaaatctacgtaagtgtacaaactagttgagggatacactgtttgcttttataaaataactttgattacatgaatataataaaattatgtgcatataaaatg

SEQ ID NO: 20585 - DNA, 500 bp, Homo sapiens
  misc_feature 475: n = A,T,C or G
agtctcgctccgtggccttagctgtgctcgcgctactctctccttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaggtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtangggttataataatggtaacatggac

SEQ ID NO: 20586 - DNA, 189 bp, Homo sapiens
  misc_feature 29, 39, 55, 173: n = A,T,C or G
tatttcccctgctttatccgacctattgnttcttctttntctgaacctctgttgnatttagaatcatgcctataatcctaccattttgggaggctgagacaggaggatccctggaggccaggagtttgagaccagcctgggcaacccagcaagatcctctccctatctttaanaaaaaaaaaaaaaaaa

SEQ ID NO: 20587 - DNA, 110 bp, Homo sapiens
  misc_feature 21, 22: n = A,T,C or G
ttttttctttactctggggtnncggctgccctgtggcctcgctcctcgggaggtttttcagttatgggacaaaaatattatatcaaaacactggaagctttgcaatctaa

SEQ ID NO: 20588 - DNA, 300 bp, Homo sapiens
  misc_feature 7, 11, 55, 173, 272: n = A,T,C or G
aagcagnaagnaaagggtattcaggagcttgaagatcaacttaatgaaataaagngtgaagacaaggttagagaaagaagaatgaaagggaatgaacaaagcctccaaggaaatatgggactatgtgaaaagaccaaactatttttgattggggtacctgaaagtgacagggngaatagaaccaagttgggaaaacacacttaagggtattatccagggaaacttccccaacctagcaagacaggccaacattcaaattcaggaaatatggngaacaccacaaagatgctccttggggaa

SEQ ID NO: 20589 - DNA, 406 bp, Homo sapiens
  misc_feature 24, 179, 193, 199: n = A,T,C or G
cgctagttgtggaatatacatcanaagcacaaattatctcaccaacaaaagcaagcaattcagtaatcttagtattttgtggccttaaaggaataatgaaaactgggttttctcaaagtttaaaggaaagatatatggttaaagaaaataagaaatataggagatagaaagtgagctgnttaatctgcgtgangaaggngaaaaaccattaggaagagggacgtcacattggaagccaccaaatataacaaacacaaatgaaaacacaggaatcaacagacttgagaaacttctacaaaacaaagtgaaaaagatgagagaaaaaggatttctgtgaagatgatacataggagagacaaaggcttattcatcacatattacttgtttttcctaacctaaaaaaaaa

SEQ ID NO: 20590 - DNA, 450 bp, Homo sapiens
agcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctac

SEQ ID NO: 20591 - DNA, 140 bp, Homo sapiens
  misc_feature 34: n = A,T,C or G
gtttggtacatctagtcttttttctgctataagntttccttacctgtcctttagtgtagattttattcatcacaggacagaataatcaaggacaaccaaaatccttttgttagtttcagtacccttcagctattcaacat

SEQ ID NO: 20592 - DNA, 167 bp, Homo sapiens
ctggttgtctgggagttgagtaaaagttcagcttcgtgcaccccaaattaaaaaattaaatttaatttaacacaaaattaaggagaaaaatacgaaagttagttaaagagggtacagcccctttaacaaaggatacaaccttttcagggaaaaaaaaaaaaaaaaaa

SEQ ID NO: 20593 - DNA, 530 bp, Homo sapiens
  misc_feature 22, 457: n = A,T,C or G
tcttttaactgagcaggtgacntcgaaatttgggcttttttattttgtagtaagggttttgagagagcgttccggacttaatctcttcagcagcctcttgcataaatcacattgatactccttttcctgcctccagttgttttcacgtctgtatttttctcctgttatatttacatgttcagtttttatttaacctttgaggaatggaaatgaaggttgtgtctataagtcgaggttccagatataaaattctgtcttcctttttgatcattaacttgtttgtttcagaatatttggtgaatgcaactgtgatgatactagtgtgaataacaacggaagacactcacttggctttggctaggtgtagtgttgactacagaggtgtttaaaaagtggcctgagggccggcctgttagagctcttttggctgtggaagctaatttgtgctgaatgtggngcctacagaaaaacccttcagaggtcatacagtgtgtactctttctgccgggcaggttgaggctccttaccta

SEQ ID NO: 20594 - DNA, 500 bp, Homo sapiens
  misc_feature 22, 281: n = A,T,C or G
gtgtaattgtgtgaggcctttnatgataagtggcatttcttgatcatgtttaaatcctccagaatctggggctttgactgtaaagtataagacagaagtagaaattacctccacagttacctgacacgtatacacctttattcatgaaacattgggtctggacatgacattgcatcaggccgtgtggatttcagaaaaagtgaaaaaccacttttctggatgtgtttcatgttcatcctaggatgcatgagggcctcggttggatgtaaaagtgtttatgngggagaagaggcagaaggaagggaagagatgaatataaggttaggaacacccggcgtctccttgttagagtgcagggagagatcccattcctgaaatatagggttgaggcaggattgttgaaggagtagttatcgtagtttcaagtgtgcataatttgggcatctattaatccaaaacaaacattttctagatgataccacttttgagatcttaattat

SEQ ID NO: 20595 - DNA, 168 bp, Homo sapiens
  misc_feature 17, 23: n = A,T,C or G
tttctttcaaaatgagnatttcnaattgaagataccctcataatattatctttaatattattttctgctgattttcctgatgattacaactgatatatgttatatgtttttgttataattgtggaggatgttattatttgttctatatgtatgtagtattgctttgac

SEQ ID NO: 20596 - DNA, 100 bp, Homo sapiens
  misc_feature 46, 69, 77: n = A,T,C or G
ggtgtttttttaaaaaaaccttttggggaccaaattccattttcanccacccttaaaaaaaccaggganttttgggnataaaattccctttttattttcc

SEQ ID NO: 20597 - DNA, 500 bp, Homo sapiens
  misc_feature 473: n = A,T,C or G
gaggacacacttcagggacccagccccactgggagtgtggccaagggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggaaagaaccttgctacttggtctctgcaatctccttggaaaatagaatgctcctgtagccagaacactctttggaaatgatgtaacgccacagaatatgctcacgaccagcctcagtagtgaaggcttgttataaaacatagatctattcttcatggggaaaaaaagtcatcccaggatataataaaattacacttaagaatgcagcaacccttttaaaaacatattcaacaaaaaaaagccccctgccgntttctgatatcatgggaatactcctaa

SEQ ID NO: 20598 - DNA, 500 bp, Homo sapiens
  misc_feature 4, 30, 38, 491: n = A,T,C or G
aatncaaagacactattttcatactaggantcctgagnacaaatactcactgaagggcttgtttaaaaataaattgtgttttggtctgttcttgtagataatgcccttctattttaggtagaagctctggaatccctttattgtgctgttgctcttatctgcaaggtggcaagcagttcttttcagcagattttgcccactattcctctgagctgaagttctttgcatagatttggcttaagcttgaattagatccctgcaaaggcttgctctgtgatgtcagatgtaattgtaaatgtcagtaatcacttcatgaacgctaaatgagaatgtaagtatttttaaatgtgtgtatttcaaatttgtttgactaattctggaattacaagatttctatgcaggatttaccttcatcctgggcatgtttcccaaactgtgaggagggaaggctcagagatcgagcttctcctctgaggttctaacaaaatggngcttttgag

SEQ ID NO: 20599 - DNA, 370 bp, Homo sapiens
  misc_feature 49, 50: n = A,T,C or G
gtcacaatgatgtgcaaaaccttttactggttgcatggaaatcagccannttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatc

SEQ ID NO: 20600 - DNA, 187 bp, Homo sapiens
  misc_feature 17, 74, 76, 167, 170: n = A,T,C or G
gtggcagccagcgcagntttttctgctgagggggcaggcggagcctgaggaaaaccgcagataagttttttttntntttgaaagatagagattaatacacctacttaaaaaatatagccaataggttactaagatattgcttagcgttaagtttttaacgaaatttnaanagcttaagattttaaga

SEQ ID NO: 20601 - DNA, 500 bp, Homo sapiens
tctcaccccaaaaactccttgaagcctggtgagcaacttcagcaaagtctcaggatacaaaatcaatgtgctaaaatcacaagcattcctttacaccaacaatagacaagcagggagccaaatcatgaatgaagtcccattcacaattgctacaaagagaataaaatacctaggaatacagctaacaagggatgtgaaggaccttttcaaggagaactacaaactactgctcaaggaaataagagaggacacaaacaaatggaaaaacattccatcctcatggataggaagaatcaatatcatgaaaatggccatactgtccaacgtaatttatagatttaatgctatcctcatcaagctaccattgacgttcttcacagaattagaaaaaaaactactttaaatttcatatggaatcaaagaagaccctgtatagctaagacaagcctaagcaaaaagaacaaagctggaggcatcaagctacctgacttcaaactata

SEQ ID NO: 20602 - DNA, 180 bp, Homo sapiens
  misc_feature 13, 25, 50, 59, 121, 169: n = A,T,C or G
atccaagtctttncaaacaaattgncagccttcaaaaaaacggctttcanccccttagncccaccacccccccccacgggggaaaaaaccaggccaggttggattttaaaccccttttttnaggccaatttaaaaacgggaaaaggttttttaaaccttaaaggccttnttaccttaaaa

SEQ ID NO: 20603 - DNA, 198 bp, Homo sapiens
cccgtctctactaaaataccaaaaattagctgggcgtggtggtgggcgcctgtaatcccaggtactcaggaggctgaggcagggagaatcgcttgaacccgggaggtggaggttgcagtgagcgaagatcaccccactacactccagcctgggcaacagagcaagactccatcccagaaaaaaaaaaaaaaaaaaaaa

SEQ ID NO: 20604 - DNA, 500 bp, Homo sapiens
  misc_feature 5, 466: n = A,T,C or G
cgggngctgaaggctgcagccgcgaatgccgtagggcttttttccagacttcaagctcccattccaacagtaagagcttcttccacatcacagcccttggatcaagtgacaggttctgtgtggaacctgggtcgactcaaccatgtagccatagcagtgccagatttggaaaaggctgcagcattttataagaatattctgggggcccaggtaagtgaagtggtccctcttcctgaacatggagtatctgttgtttttgtcaacctgggaaataccaagatggaactgcttcatccattgggacgtgacagtccaattgcaggttttctgcagaaaaacaaggctggaggaatgcatcacatctgcatcgaggtggataatattaatgcagctgtgatggatttgaaaaaaaagaagatccgcagtctaagtgaagaggtcaaaataggagcacatggaaaccagngatttttctccatcctaaagactgggggggagtc

SEQ ID NO: 20605 - DNA, 425 bp, Homo sapiens
  misc_feature 25, 65: n = A,T,C or G
tcaactttaaatttgcccacagttncctctaaatccccttgtaaatttaactgttagtccaaagnggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctctgcataagcctgcgtcagattaaaacactgaactgacaattaacagcccaatatctacaatcaaccaacaagtcattattacccccactgtcaacccaacacaggcatgctcataaggaaaaaaaaaaaaaaaaa

SEQ ID NO: 20606 - DNA, 500 bp, Homo sapiens
  misc_feature 25, 50, 416, 421: n = A,T,C or G
ccaacttttacattgttggacgagnaccctgctggcatgcctcatccagnaaacagggaaggatctttatgagccaagtcatggtgccaaagtgctgacgatggcccctggtttaatcactttggaaatagttccctttcgagttgcagcttacaacaaggaaaaagaagcgtatggactactatgactctgaacaccatgaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttggcatttctttgnggggnctgtctggacatgcttcctaaaaacagaccattttccttaacttgcatcagttttggtctgccttatgagttctggttt

SEQ ID NO: 20607 - DNA, 500 bp, Homo sapiens
  misc_feature 10, 16, 58: n = A,T,C or G
atggctaaanttagcngtggagctatgcaaatggggggtgaaggcatgctttttaagnaagggtggatataagtagatgaaaaatgctttcatctgtgttatgaataattcagtatttcctcctgtatcaagaagacacgtgttttagacacttaaaatataagaactgccttacagagttagactgctgagaaatggaccatagcatatttattctgcaaacaaatatgaatgcctagggcctacttgatgtagtgtgctatgctttttaaaccaagactataagtagaagtaagtctcattctaagttttactaaagattgtggtgaaagttaagtctttttactagttttcaataactgacagctgaactattttaattcaacaagttatatcattatattgaggggcatttctttatgctttaaattcttacacagacacattccaaattttagagacattgtatctgtctttgcatttccagtaattagcagagt

SEQ ID NO: 20608 - DNA, 239 bp, Homo sapiens
atgggctggtttctttcaagtttaaaaaagcccccttctccatgcacaagttcattccctccatgctgtcgtcatcgacatatacaggtgtgtacgtaggtgtatgtgtgtactctgcacgtatatctcttctgtcttgaagaccctgttaactttgtgaaataacttccacatttcaacacacttcacagtacaggaaataaagtaatatgaaaaaaaaaaaaaaaaaaaaaaaaaaa

SEQ ID NO: 20609 - DNA, 500 bp, Homo sapiens
  misc_feature 22, 24, 371, 406, 457: n = A,T,C or G
ggccgcttgccttgctctcagnantcgctgccgccatggctagtcagtctcaggggattcagcagctgctgcaggccgagaagcgggcagccgagaaggtgtccgaggcccgcaaaagaaagaaccggaggctgaagcaggccaaagaaagaagctcaggctgaaattgaacagtaccgcctgcagagggagaaaagaattcaaggccaaggaagctgcggcatttgggatcccgtggcagttgcagcacttgaagtggagaaggagacccaggagaagatgaccatcctccagacatacttccggcagaacagggatgaagtcttggacaacctcttggcttttgtctgtgacattcggccagaaattcntgaaactaccgcataaatggttagaagagagaacncctgtgctggggagtggcatttttagatgccctcacgaatatgaagcttancacagctctagttacattcttatgatatggcattaaattattt

SEQ ID NO: 20610 - DNA, 156 bp, Homo sapiens
  misc_feature 50: n = A,T,C or G
gttcaggcttatgttgtattttcgcaggagtctggttttatttgaacagnaaataactctacagaaagctcttgtaaataatgctcaaatttgcacccgacgatcaaatccattaaaaatgaatcttgtaaaaaaaaaaaaaaaaaaaaaaaaaaa

SEQ ID NO: 20611 - DNA, 330 bp, Homo sapiens
  misc_feature 9, 152: n = A,T,C or G
cagtcgagnatgtcagataaaaagcagccggtagacttaggtctgttagaggaagacgacgagtttgaagagttccctgccgaagactgggctggcttagatgaagatgaagatgcacatgtctgggaggataattgggatgatgacaatgnagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgct

SEQ ID NO: 20612 - DNA, 430 bp, Homo sapiens
  misc_feature 15, 41, 49: n = A,T,C or G
cctgtataagtaagnaaatattttgtctaaaatgcctcagngtatttgnatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaa

SEQ ID NO: 20613 - DNA, 500 bp, Homo sapiens
  misc_feature 25, 462: n = A,T,C or G
gaggtatggtgctgggtgcaggatncagtgtggctctggatagcaccttatggacagttgtgtccccaaggaaggatgagaatagctactgaagtcctaaagagcaagcctaactcaagccattggcacacaggcattagacagaaagctggaagtcgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcagacctgttatcctaaactagggtttttaatgaccacaacaagcaagcatgcagcttactgcttgaaagggtcttgcctcacccaagctagagtgcagtggnctttgaagcttactacagcctcaaacttctgggctcaa

SEQ ID NO: 20614 - DNA, 450 bp, Homo sapiens
  misc_feature 39: n = A,T,C or G
ttcttctttctttcttaagccctttgctctggaggaagntctccagcttcagctcaactcacagcttctccaagcatcaccctggggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatgtgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagta

SEQ ID NO: 20615 - DNA, 500 bp, Homo sapiens
  misc_feature 33, 36, 39, 261, 424, 465: n = A,T,C or G
gtatgattaaaagttgctttcctatggacaagnagnagnatcgtcatttttttttccttaaaatgcgtttagtaggaataatttatctctcctcttacctcttaaaatattttacttaaatattttggagcagtaatcactttttaacttgttattacaaatatgaaatataaatatttggtatatttgattagtcttcccttagtctgtaaactctgaaaggcaggatcaggtctcatttatcctggcatagccctcagngcctggctcagataagaaatttagtacacatataatgaacaatcaaatggtgacaatgacctaggctttcatttgattcctagaaaacaacctctatgtagatgttgactaagtcctgtatgttctctgttatgaaaaatactctgtatactactaggcatgngctatcatccagtccttatattacggcttttcatttagatngattttttatggggcacatgaacttggccctcaag

SEQ ID NO: 20616 - DNA, 540 bp, Homo sapiens
  misc_feature 20: n = A,T,C or G
agggggacccatgcctatgnagcttgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggagaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtgggtgagaccattgaaagcctttatcaactgaagagtccatttaacagcata

SEQ ID NO: 20617 - DNA, 410 bp, Homo sapiens
  misc_feature 5, 32, 99, 121, 133, 137, 141, 166, 245, 254: n = A,T,C or G
ctgcngttgttgttcttcattaaagcctgaantgcactcttcatgtaaggaatgatttaaaactcatcttttccagattaaagagaaggaagaagcccngcaagtagtacctagaagccgnggcccagggccntggngctnacctgatgagtcaggatgctccggnatggctcggtgtgcatgccgcgtgcatacaggagagggaaagagagttacaacaagatatgaaatacgaatttcatgcnagaggctangataatttgcactggtgtaggccccagagttccacttgggctgagtaaggggaagccacgccagtcagacccatttgacttaacaaaggaggaaacagcatcagtagttccagacaaacaagaagagctaggcctgtcattgggaactgagtttcc

SEQ ID NO: 20618 - DNA, 287 bp, Homo sapiens
  misc_feature 57, 266: n = A,T,C or G
ccccattccagtggagttcaccctctaaatcaccacgtatcaaaggggacaagcatnaagcacgcaacaatgcagctcaaaacgcttagcctagccacacccccacggggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctcccccnaaaaaaaaaaaaaaaaaaaaa

SEQ ID NO: 20619 - DNA, 500 bp, Homo sapiens
  misc_feature 33, 41: n = A,T,C or G
tggcccgggcccctcggtggtggccactgcgcnttatcagnacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagag

SEQ ID NO: 20620 - DNA, 465 bp, Homo sapiens
  misc_feature 24, 42, 59: n = A,T,C or G
cacagtactgaattcagtgcttancaactgaagttattgagnaggacagctttaaaagnatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatactaaaa

SEQ ID NO: 20621 - DNA, 397 bp, Homo sapiens
  misc_feature 48, 360, 391: n = A,T,C or G
ctgcaaatttctttgagcagaattgcttgcatatttctcctctgccgncacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagnggctaacacctggctactcttactgtaaaanaaaaaa

SEQ ID NO: 20622 - DNA, 363 bp, Homo sapiens
  misc_feature 11, 357: n = A,T,C or G
ccagccattgnaaatgacacattaagtcctagcatcacattgtatagtacagtcactcacaaacccttcaaggctaccctaatcattaacattaatatttgtttaaaagcaaatcaccgatttatctattgaaactacttaaatgacggcaaaccaggaatgacagatggctgtgtcagcaatggctttaatgtgttccctgcaagtggtctcctatgatagaactgcgttctcaaatgcactctcttcagggtcttaatattctgtgttttctctctgtatttgtaaaacattataacacattaatttcctatctctacacatttggtttgcttaaataaatgcaggatataaaanaaaaaa

SEQ ID NO: 20623 - DNA, 450 bp, Homo sapiens
gtgacttctgcccacctgggcacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagtcctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaggaaattttgcctgccattttcagaatcatcttttgaagctttctgttgatgttaactgagctactagagatattcttatttcactaaatgtaaaatttggagtaaatatatatgtcaatatttagt

SEQ ID NO: 20624 - DNA, 517 bp, Homo sapiens
  misc_feature 447: n = A,T,C or G
aaagtgagtatactgtggagccggcttccaaatgtggttacctcagctatatcactgcccaacatcagaaaacctgacggctatgattactatgccttttctaaagatcaatactataacattgatgtgcctagtagaacagcaaggagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctggttattcctcctctccctcccattgcatggntcacacctgtaaaagaaaaaagaatcaaattgaatatatctttttaagaatccaaaaaaaaaaaaaaaaa

SEQ ID NO: 20625 - DNA, 500 bp, Homo sapiens
  misc_feature 20, 404: n = A,T,C or G
agtatcttataatttagttnatttgttcagggtaaaatttgaaccaaaaaatttacctgtgcaaaatagttttttaaaaattatacatgtagctcaacttgaggtactgctatataaatattcactcacattatcacggaatttatgtatagtttctctaatatagaagataaaattggtgtcctcataactttaacaaagaaaaccctcagtcctatttattaatgggtagaattaaatatataattttatagctcagtttacccagtattcatctgcaaagccagattgctctcattgcttttatatttttaaattgtagcttttagagacctatgatcctcatggaacttaattttttattaaatattcaggtaacagttctgaattcatgtgataatggnggcattatatatgattaaacacttcagaactttctaatgttatcaggagtattttgagggagatatgattatatttggattttctcagataagaaa

SEQ ID NO: 20626 - DNA, 200 bp, Homo sapiens
  misc_feature 24: n = A,T,C or G
gtcagctgtgcagaaaatcagcanaaactgtggatttaaaccacactttacaccaaatggacctgactggtatttacagaacattttatccagcagccagagaatacacattcttctcatcagcacatggatcattctctaggatagaccaaacaagtctcaacaaattttttaaaaccaaaaaaaaaaaaaaaaaaaaa

SEQ ID NO: 20627 - DNA, 440 bp, Homo sapiens
  misc_feature 26, 50: n = A,T,C or G
tattacctgggggtctcctgattctnggctgcgagggaaaatatcacagnatatgctctgattcctagaggccagagggctcctttgtgatcccaagttctggttcaccttctatatggagttgtgtcctggtcttaagggacttacccttccattccagcactttctgccatcaaaactttcctttctgttttctgagacaatatcaatggctgtggatattgaacaattgtctgataaaagtgatttttgacattaaggatctaagtgctcatatttgagagtctgatctagtgaccctcatgaataacaatcacaccttacttagtactgggattttccctttacagttgatgtttacttacatgattgacctgcgtaacagtttaaaacaggtaggaccacgaggtcaggagattgagaccatcctgacaaacatg

SEQ ID NO: 20628 - DNA, 230 bp, Homo sapiens
  misc_feature 24, 207: n = A,T,C or G
gcttctgctgagggggcaggcggngcttgaggaaaccgcagaataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaaaantaaaaaaaaaaaaaaaaaaaaaa

SEQ ID NO: 20629 - DNA, 500 bp, Homo sapiens
  misc_feature 24, 50, 82, 495: n = A,T,C or G
tgtgtttggaactgctataattanatcaacaaccgcaaacgtgccggtancattgctgtgtaccctgcctttgaagcacctnctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctctttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgnttgca

SEQ ID NO: 20630 - DNA, 493 bp, Homo sapiens
  misc_feature 33, 75: n = A,T,C or G
attgtttaatgtcttatttaaataaaatccagnaaaaactggggctgctatctttaaagtcataacttgcccagnatgcaccaatgcagaaactgttcagagagggtgaaaggtgagcacctcattagattatccaaaattctccaaaactctccaaaattctccaacccaaaccatatggctatagtgggagctgccttgttcccaccataagatggcccctcctcccagctgaacatctgacccatgttgggccaatcagcacattcctcagtaattttgttactgagactaagaaatcagtctctctaccagtgacttaagagataatgtgaggttgggcatgttggctcacgcctttaatcccagcactttgggaggccaagacaggaggatcgcttgagcccaggagtttgagatcaggctgagcaacatagtaagaccctatctctacaaaaaaacaaaaccaaaaaaaaaaaaaaaaaaaaaaaaa

SEQ ID NO: 20631 - DNA, 188 bp, Homo sapiens
  misc_feature 10: n = A,T,C or G
aaggggcagnatgctttttattagtactgataaaacaaactgagggaaacatccctcttagctgggaaacttttactcttcaggagcttggcatcatggactgttaatgtatgtgattttccccctattttctctctccaaaatgataaaaacaataattttaaaaaaaaaaaaaaaaaaaaaaaaaa

SEQ ID NO: 20632 - DNA, 300 bp, Homo sapiens
  misc_feature 17, 20, 60, 208, 232, 254, 294: n = A,T,C or G
gccagcgtcgccgcgtnggngttgttggagagcgagcagttcctgacggagctgaccagnacttttccagaagtgccggacgtcgggcagcgtctatatcaccttgaagaagtatgacggtcgaaccaaacccattccaaagaaaaggtactgtggagggctttgagccccgcaggcaacaagtgtctgttaagagctaccgatgggnaagaagaagatcagcacttgtggngagctccaaggaagtgaataangtttcagatggcttatttcaaacctccttagagctaaccnggatgg

SEQ ID NO: 20633 - DNA, 358 bp, Homo sapiens
  misc_feature 233, 316: n = A,T,C or G
aagtaagcaggaagcatctgttttttagggttacatttttatgatttcagcaaataatatggtaagaaggagtttcataggatatatttttttaaaggaatatgtgttgatatgctaaaattatactaaaaattattaaaggatatacaaaaagaatagacataataaaaacttaagccttcataaagaattggaaaaaagtgaaaatgctgcaatagttataaattggtgcnaattttccaggaatttgctctaaggctaatatttgaagagctgaaaacgtgtttaaatggtattttctaaggatgtaactctngaacacccaacaagtaaatttgactccgttcccaaaaatttg

SEQ ID NO: 20634 - DNA, 213 bp, Homo sapiens
  misc_feature 13, 66, 146: n = A,T,C or G
aatattactcagnaggctgttgggtttaatttgatgagatgaagtaggactggggaaagggaaagnataattccccataccttaagattcgccatagctaagccagatgccgtggcttacacctgtgatcccagtacttccgaggngggtggatcatttgaggtcatgagttcgagaccgggctggcccgcctggggaaaccctgactctatt

SEQ ID NO: 20635 - DNA, 420 bp, Homo sapiens
  misc_feature 23, 73, 121, 352: n = A,T,C or G
gcagcaacgtgctttgggagcangagaagagggagaaagcagcatcttgcctggatgagccaggggacacagnaagagaagcccactatctcatttaatctttacaactctcttgcaaggntccctggttgtgaaaatacatgagataaatcatgaaggccactatcatcctccttctgcttgcacaagtttcctgggctgggccgtttcaacagagaggcttatttgactttatgctagaagatgaggcttctgggataggcccagaagttcctgatgaccgcgacttcgagccctccctaggcccagtgtgccccttcccgctgtcaatgccatcttcgagtggtccagngttctgatttgggtctggacaaagtgccaaagggtcttccccctgacacaactcttgctagacctgcg

SEQ ID NO: 20636 - DNA, 570 bp, Homo sapiens
  misc_feature 23, 375, 565: n = A,T,C or G
attgaggtagggtatatgcaagnatgataaatgggcttttcacttctttccactggggcagcagtgattctatggcgatgtagctaatatgacgtgagagagtcggttgctttctagcctctgccaggctcactatttctgtaatagtgacactccatgaaatagttatttctgtgacatcactgacacttttaaacaacagatagaggaaagatgtgaaggttccatgtctctacatgtggctgaactctcaaatgtggttagagaatcatgttttctccagtgcatttgagctgaacagtaagcaggattgcttggtgagtcgtcattagatagtgactcaacaccagcaccatctcctttaagatactgggntttgtctctaacttagatgccacgactttgatgtaattttatgattctcctttctaaaagtgaatcagcaatatgataaaaatttattcaaaaatggtgttaataccaaaacaacaggattactgtttttagtacagaggaatgtaagggactttggttatactttccagatagcaagagtgacacacgntagaa

SEQ ID NO: 20637 - DNA, 285 bp, Homo sapiens
  misc_feature 140, 198, 255: n = A,T,C or G
agcatcttatacgagtaatatgcctgctatttgaagtgtaattgagaaggaaaattttagcgtgctcactgacctgcctgtagccccagtgacagctaggatgtgcattctccagccatcaagagactgagtcaagttgntccttaagtcagaacagcagactcagctctgacattctgattcgaatgacactgtttnggaatcgggatcctgtcgattagactggacagcttgtggcaagtgaatttgcctgtnacaagccagattttttaaaatttatattgg

SEQ ID NO: 20638 - DNA, 480 bp, Homo sapiens
  misc_feature 16, 17, 168, 351, 371, 403, 466: n = A,T,C or G
cagccatctcgccgtnntaagcaagtgtcggatccgcaggccgcagccgtgcgatgttgtcctctacagccatgtattcggctcctggcagagacttggggatggaaccgcacagaagccgcgggccctttgcagctgcgattttcgccctacgttttcaacggaggnactatactggcaattgctggagaagattttgcaattgttgcttctgatactcgattgagtgaagggttttcaattcatacgcgggatagcccccaaatgttacaaattaacagacaaaacagtcattggatgcagcgggttttcatggagactgtcttacgctgacaaagattattgaagcangactaaaagatgtataagcnttccaataataaggccatgactacgggggcanttgctgcaatgctgtctacaattcctgtattcaaggcgcttctttccatactatgtttacaanatcatcggtggact

SEQ ID NO: 20639 - DNA, 500 bp, Homo sapiens
  misc_feature 9, 396, 429, 453, 466: n = A,T,C or G
gatcaaagnaacaggacataaaaacaaagtcacaatgacattccatagtaaatttggaatcagaactccaaatgcaacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactgcggaagaaaagtcccactgaggaaaagaaagtcttgtgatttttaaaggcaagttttcaagtgctctcatagttctatcctctaattccattaaatccatactaggagcgtcagngagggttttcatagcttttggaaatactttggnctctgaactggattagcaggagtnaaaacaggaacgncaaacgtcaaatgtttgctttgttacctggggga

SEQ ID NO: 20640 - DNA, 448 bp, Homo sapiens
  misc_feature 24, 177, 391: n = A,T,C or G
ctccatgtttggaggagtcatgcnctttgtgtttgacattacttttcctttgctgttgatgtttatccatgcatcgttgagacttcggaacctcaagaacaaactggagaataaaatggaaggaataggtttgaagaggacaccgatgggcattgtcctggatgccctagaacagcnggaagaaggcatcaacagactcactgactatatcagcaaagtgaaggaataaacataacttacctgagctagggttgcagcagaaattgagttgcagcttgcccttgtccagacctattttctgcttgcgtttttgaaacaggaggtgcacgtaccacccaattatctatggcagcatgcatgtataggccgaactattatcagcctctgatgnttcagaggagaagacctcagaaacccgaaaggaaaaccaccacccttcctattgttg

SEQ ID NO: 20641 - DNA, 323 bp, Homo sapiens
  misc_feature 21, 163, 168, 229, 231, 232: n = A,T,C or G
accacgaggaagcgcttgctnttaacatttaaggacaatggagtgtcttgctttctagaaatgcttttatttttattaccactatgcaaataaatgtaattttcacagtgtcataacattgattttgtcattgaagatattatctattttttccctgacaggngatgntaaaatacatttagctttgttaggtaagagaactttgatacttccttttcctctttattgngnntacaggtatatttgggatatatggcatttaagggtattcttttagaagacttggctaagttgttaataggtgtaaaataccacatattaat

SEQ ID NO: 20642 - DNA, 340 bp, Homo sapiens
  misc_feature 65: n = A,T,C or G
gcagaccccgggggaggctgaaaacagtgcagagacgtttgacaatgagtcagtagcacaaaagnaggatgacatttacctagcactataaaccctggttgcctctgaagaaactgccttcattgtatatatgtggactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaagg

SEQ ID NO: 20643 - DNA, 410 bp, Homo sapiens
  misc_feature 19, 197, 219, 319: n = A,T,C or G
gagttgacttcgaaatgcnctccctgctgttccgcaggacctccacctttgccctcaccatcatcgtgggcgtcatgttcttcgagcgcgccttcgatcaaggcgcggacgctatctacgaccacatcaacgagggggtgagggcctgtgccatccctgaccttggacccgggctgaggggtgacagtgggagtagnagaagctggggaaacacatcangcacaagtatgagaaacaagtagttccttggaggcccccatccaggccagaagggccaggtcccacccagcagcttgtttgcccagagctggagcctcancttgaagatgatgctcaaggtactcttcatgggaccaccattcgctgttggcaagaaaacgggttttacttacaaaacagactctttacct

SEQ ID NO: 20644 - DNA, 400 bp, Homo sapiens
  misc_feature 23, 63, 310, 395: n = A,T,C or G
aatgaataatgtattttcagtgnaacaaatttattataaaagtgtagttcgactcttcttggncttggagtttgagagtacagaattacagggaatgaagagaggtataagtagatattttaatgggaaatgaagtataaattaataacttgacttacccctccataagttactgctaactggagatacccttgtatgcccaacctgtaaaggaaaaagttctatttctatatttataggacattcttctcagtcaaggaacagtaagaaatatgtaggtttcaatcagttgctctcaaccctgactgcnttttagaatcatttggagagtttttaaaaatatccatgcctgaatcttgattcccattttcatgtaatttgagacaagacctggncatca

SEQ ID NO: 20645 - DNA, 190 bp, Homo sapiens
  misc_feature 5, 49, 105: n = A,T,C or G
taggnaatgtaaaatagtgttttttattttggaaaaccgtttggcagcncctgaaaaatgtaaaacatggagtgtaccagttgaccaagcaattctgcttctagnatacatatccaatagaaagaaaaaatatgcctacataaaatcttgtgcatggaagttcctaggaggaattattcataatagccca

SEQ ID NO: 20646 - DNA, 520 bp, Homo sapiens
  misc_feature 173, 408, 438, 459, 481: n = A,T,C or G
aagaaacacatctggtttggcgaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggncgaagcagctggcaacctcaagaaggccctgctcatccagggctccaatgacgtgggagatccgggcagagggcaatagcaggttcacgtacactgccctgaaggatggctgcacgaaacataccggtaagtggggcaaggactgttatcgagtaccggtcacagaagacctcacgcctccccatcattgacattgcacccatggacataggagggcccgagcaggaattcgggngtggacatagggccggtctgccttcttggnaaaacctgaacccagaaacancacaatccggttgcaaacccanaaggacccaagtactttccattctcaggcactcctagga

SEQ ID NO: 20647 - DNA, 313 bp, Homo sapiens
  misc_feature 44, 179: n = A,T,C or G
ccgtaacaattgggaaccaatttaaattagatttgggttctggnaacttaaatcattggacaaacttgggagatgttttagggtccaagtatggcagtcatccgatggatgttttgaaggcatttggccacctgagttggcatttaatcatgccagacaccaccagacttcttccgggnttcctatctccatttcactgctctttcagagttctgctttgtagagaatataagggggaaaggggaagacatgacccctgctctcaataggcttagctaggtcataaaaaaatatcaagtttttaaaaaaaaaa

SEQ ID NO: 20648 - DNA, 472 bp, Homo sapiens
  misc_feature 357, 358: n = A,T,C or G
aggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagnncatgtattagttaatggaaaaaaaaataccacactaacaatacatagctgcaatgtgtacaatggctgatttaattaaataaaaatgtacaagggttaaatgtggaaaaaaaaa

SEQ ID NO: 20649 - DNA, 369 bp, Homo sapiens
  misc_feature 24, 278, 289, 361: n = A,T,C or G
agacagtgaccaggaaactgttgntgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgatttttttttttaacattttaagcagactgctaaactgttctctgtataagttatggtatgcatgagctgngtaaattttgngaatatgtattatattaaaaccaggcaacttggaatccctaaattctgtaaaaagacaattcatctcattgngaggggga

SEQ ID NO: 20650 - DNA, 560 bp, Homo sapiens
  misc_feature 7, 179, 181: n = A,T,C or G
ctttaanaatgagggtgccgaaccaggatctaatcaggtccagcctgatgagtgaagaggctaagcgaggagcacccaacccttggctctttgaggagccagaggagaccagaggcttgggttttgatgaaatccggcaacagcagcagaaaattatccaagaacaggatgcaggcctngntgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggccggtaaacatggtggacagaaagtcagcctcttgtgggatgatcatggggattttactgctgcttgtggctatcgtgggttgttgcagtctggccgaccaactgatggcagtaaagagaccaccagcagtgacacctgccaatgacagatgcaagcccaacacccttttggtacgcaaaacctgctctcaataaattcccccaaagctctgaaataaaaaaaaaaaaaaaaaaaaaaaa

SEQ ID NO: 20651 - DNA, 597 bp, Homo sapiens
  misc_feature 13, 21, 25, 30, 34, 54, 169, 248, 408, 435, 542, 588, 590,593, 595, 597: n = A,T,C or G
tttttggggtacnagccccantttnccttnaggnccgggccgtttgcattgaanaattttcattttctttgaaattgtggaaaaagtgcttcttttttcccaaattttcacattgcacaattactgaaatgtaaattgttacatatttgttgacttacaggtttatggnagcttatgtttttataacccatttaaatacaattaaatcacacaggcatattcactttgaaataattcattcagctggncataatgatttattacacctttctatatgtaagatcttccataaaatttcattacattataagttgatgtataagatacaatgaattacctatgacaagatggcgtatcttaattttgtacttagaaaaacacacgcaacataaagagtataaatgatgngttggcaaataaaatacttttttgggnttaggtaagtaaaatattttaataagctctatcttattcatagatataaacatcagaacaccagacaggtaaatttctcttctatccctcttttcattgggtttggngaagcctttgggggggggggaccagaaaaggaaggttttgaatttntnttntnan

SEQ ID NO: 20652 - DNA, 500 bp, Homo sapiens
  misc_feature 1, 29, 80, 356: n = A,T,C or G
ncttattcacagttgttattgtttacagnaccatttaattaatatttcctctgtttattcctcctctccctcccattgcntggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgngttggataaaaaaattaacaatataatggcaataggtaagaggtacaacaaatgaatataacactataacacttcatattttccaaatcttaatttggatttaagggaagaaatcaataaatataaaatataagcacatattta

SEQ ID NO: 20653 - DNA, 390 bp, Homo sapiens
  misc_feature 17, 34, 116, 213, 269, 302: n = A,T,C or G
ggccgggccccatcagnattcaatattcacctgntagtactggcttatcaagaacaaagtgtccttcataatgaagttaaagtgagtatactgtggagaggacttccaaatgtggntacctcagctatatcactgcccaacatcagaaaacctgacggctatgattactatgccttttctaaagatcaatactataacattgatgtgcctagngagaacagcaagagcaattactactcgttctgggcagaccttatccaaagtctggnacaactgtccttagactgatgagcaaaggaggngtcaactaatgaagaaatgaataataaattttgacactgaaaaacattttattaataaagaatattgacatgaaaaaaaaaaaaaaaa

SEQ ID NO: 20654 - DNA, 580 bp, Homo sapiens
  misc_feature 11, 31, 35, 329, 466: n = A,T,C or G
gaagtcacacntaacaagctactgttaaaanatgnaatatttttagttttctgtaaattatcagttatttttttccagtctccttagaaaaatggcagcacagatggtagcttgcacagcttgcatcaatggtgtggaataacccaagtcagcaacaatttatgcaatttggaggaagctctggatcacagttgcctcaaatccagacagatgttgtacttccatcatgcaaaaaaaagctcctgctgaaactcctgtgaaagaaagactttttattggtgtttaatcctcatcctttacctttagacgtattagaagatatattctgncgttttggtaacctgatcgaagtttaccttgtgtcaggaaaaaatgtggggtatgccaagtatgccgatagaataagtgctaatgatgccattgccactctacatggaaagattctgaatggggtgagacttaaagntatgctggcagattcgccaagagaagaatctaacaaacggcaaagaacttactgattcttgaggtaagccctttttaatctgaattttaaaacatattgagtaaatagtatatg

SEQ ID NO: 20655 - DNA, 421 bp, Homo sapiens
  misc_feature 12, 384, 418: n = A,T,C or G
gcctcgcttcgnttttcctccgcaaccatgtctgacaaacccgatatggctgagatcgagaaattcgataagtcgaaactgaagaagacagagacgcaagagaaaaatccactgccttccaaaggaaacgattgaacaggagaagcaagcaggcgaatcgtaatgaggcgtgcccccgccaatatgcactgtacattccacaagcattgccttcttattttacttcttttagctgtttaactttgtaagatgcaaagaggttggatcaagtttaaatggactgtgctgcccctttcacatcaaagaactactgacaacgaaggccgcgcctgcctttcccatctgtctatctatctggctggcaggggaaggaaagaacttgcntgttggtgaaggaagaagtgggggtggaagaaanggg

SEQ ID NO: 20656 - DNA, 520 bp, Homo sapiens
  misc_feature 9, 28, 48, 397, 425, 441, 489: n = A,T,C or G
ggccgggtncctaacaacacgtaagggnacttcatgttcatgtcaaanatagctctttgcaagtgccttgattaaaccagaaaactgtcatcgtttaacccaaatatctgaatggtcatctggtaactcatgggtttttggcctcataagatggtccactctgtacacaggcattcctcctgcaataatgttgtatctttgagaccgttgtcagtgtacacaactcacatccttcatattgaaggtgactcatttttctgcacacttttttgatgtgatgcttgacgtgaggcccgacactaggattctcaatgcaagaatccagtaccttgcacatagaagtagcaacccatcccttgcctattttcatcttgctgttttcttttttttaaaaaanggatgtgacttgtttttgaatgttttgnattatacctggttttngggggggcataaattcattctgtaggatcttaagaaaaagagtcccanaatgttgcttctattattgggcacaaccatt

SEQ ID NO: 20657 - DNA, 510 bp, Homo sapiens
  misc_feature 476, 509: n = A,T,C or G
ttatttctgggagctaagtccattcagtccaccatctccagctcgcaggaattactgaagtttggggtattccttcccccattgatactgtttttactaggtgcaactgtgaaggaaaaactttcttctttaaggattctcagtactggcgggggaccaatgatataaaagatgcagggtaccccaaaccaattttcaaaggatttgggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggnttatcaagacaaaggtgtccttcataatgaagnt

SEQ ID NO: 20658 - DNA, 182 bp, Homo sapiens
  misc_feature 21, 142: n = A,T,C or G
gccaccctagcaatatcaacnattaaccttgccctctacacttatcatgcttcacaattctaattctactgactatcctagaaatcgccgtcgccttaatccaagcctacgttttcacacttctagtaagcctctacctgcncgacaacacatgaaaaaaaaaaaaaaaaaaaaaaaaaaaa

SEQ ID NO: 20659 - DNA, 500 bp, Homo sapiens
  misc_feature 470: n = A,T,C or G
tttggggtattccttcccccttggatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaaggcctgctctaaattatccagtgtatggagaaacgacacaggttagggagacgtcgctttgaacgtgctataggaccttctcaaacacacaccatcagaattcaatattcacctgccagactggcttatcaagacaaaggtgtccttcataatgaagttaaagtgagtatactggggnggaggacttccaaatggggttacctcagct

SEQ ID NO: 20660 - DNA, 500 bp, Homo sapiens
  misc_feature 19, 28, 93, 480: n = A,T,C or G
aatgttataattttcatgnaaaaggaangttgacaccagtgaatgaaacaattgctttcattctgaaaattctaccaccatttgcatctaagnattatttccaaggcttaaagcctgaagctgaataaaataatctttcagagtccagcttcaagtttagttgatgtaagctcactatttttttcctaccgcatgcattttctaatgtttggggtggatggtgtgtcggttatggaaggcatagacgtcattacaggtgctacgatctcacacacacacaaggaaatgttagtctccttattttatgattggaaaatcaatgacctagaggcaaaatggcatgtttaaggacctgggatgacaagtcattctgcagtcagccacagagccaaatttggactcctcaaccagaactccatgaaaagcctgactttgccaaacactgtgctggaaaagctaagcccctttcatttgtgaagnaaattttaaattcagatatt

SEQ ID NO: 20661 - DNA, 190 bp, Homo sapiens
  misc_feature 15, 41, 94, 139: n = A,T,C or G
atgccatggaaactnttttagggattgctataatgggagcnttggcttctttgtgaaattgatccatattcctattaataacatcattgttggnggctgaatacattttggaagagagtttttcatcttagagattggngaacaagtgtgagggtgtgagaaactcacagaatacaaatttgcctgtatg

SEQ ID NO: 20662 - DNA, 540 bp, Homo sapiens
  misc_feature 17, 35, 351, 386, 387, 442, 456: n = A,T,C or G
gctgaggggcaggcggngcttgaggaaaccgcagnataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccggaattaataccaatagaagggcaatgcttttagattaaaatgaaggngacttaaacagcttaaagtttagtttaaaagttgnnaggtgattaaaataatttgaagggcgatcttttaaaaagagattaaaccgaaggngattaaaaagaccntgaaatccatgaccgcagggaggaattgcggtcattttaaagccctagttaacgcatttactaaacgcagacgaaaatgggaag

SEQ ID NO: 20663 - DNA, 520 bp, Homo sapiens
  misc_feature 390, 441, 480: n = A,T,C or G
gctgagggggcaggcggagcctgaggaaaccgcagaataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggngattaaaataatttggaaggcgatcttttaaaaagagattaaaccgaaggngattaaaagacctttgaaatccatgacgcagggagaatngcgtcatttaaagcctagttaacgcatttactaaacgcag

SEQ ID NO: 20664 - DNA, 251 bp, Homo sapiens
  misc_feature 25, 180: n = A,T,C or G
ctccttttctcatttcaaagttgcnaccagtgtatgcagtaattagaacaaagaagaaacattcagtagaacattttattgcctagctgacaacattgcttgaatgctggtggttcctatccctttgacactacacaattttctaatatgtgttaatgctatgtgacaaaacgccctgantcctagtgccaaaggttcaacttaatgtatatacctgaaaacccatgcatttgtgctcttttttttttttt

SEQ ID NO: 20665 - DNA, 222 bp, Homo sapiens
  misc_feature 7, 19, 113, 163, 178, 203: n = A,T,C or G
cctctgncagggaagccangcagagcccacagagcatggtccatccagagtgttccctgagccccctccaccatactggaacccctcttcagtgtaggaagtctgaaatgggngctaattcccttcttctagaaaccagggccctcttccttcatctaatgcngccactcctaggtgnaagaagtgggaataattggaaatanacaacagttctaaaactcc

SEQ ID NO: 20666 - DNA, 283 bp, Homo sapiens
  misc_feature 25, 38, 68, 207, 235: n = A,T,C or G
taaaatggcatggggccagtacaanaacaacacatagnaccattgggaataaaatagcagaacccagnaaataaagctacacacctacagccatctgatctttgacaaaattgacaaaaaattgcaatggggaaaggactccctacttaatcaatggtgctggaatagctagcaatatgcagaagaaggaaactggacccctactgntcactatataaaataaaattaactcaanataagattaaagacttaaatgtaagatgtcaacctataaaaattccct

SEQ ID NO: 20667 - DNA, 450 bp, Homo sapiens
  misc_feature 41, 44, 60: n = A,T,C or G
ttgtctttatacttttcatttctcaaagctaagtaaactgnggnataggcatctctaagnatgttagcatttaaaacatcaattgttttattgatgtttaaacaattgtttaaatcccactgaaaaatttaaatattaaaatatcttgcacagtctaccaaatgagttaaatcgttacagtcgtgtctacctcttatttttctatctgtatttaggctgctgttttggtgagattctaatttctttttcccctggaactactttctgtggaagacaaggaacagactggggacagaggcctgaaaacaaattggaagcactcagagatctattgctgaccagccctattcctcatgagttggcggggggaaagccattgtttttaatttccacttaatatgaaaatgcttggttttaaaaaggttttttcctgctgaacaaatgtatttt

SEQ ID NO: 20668 - DNA, 490 bp, Homo sapiens
  misc_feature 151, 338, 424, 428, 466: n = A,T,C or G
tttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggnaatcatcaccaaactgtgcaccagaatgtaactgccctgaaagctacccaagtgccatgtactgtggatgagctgaaattgaaaagtgtaccaatggtgcctcctggaatcaagtatctttaccttaggaataaccagattgaccatattgatgaaaaggcctttgagaatgtaactgatctgcagnggctcattctagatcacaaccttctagaaaactccaagataaaaggggagagttttctctaaattgaaacaactgaagaagctgcntatnaaccacaacaacctgacagagtctggggggcccacttnccaaatctctggaggatctgcagc

SEQ ID NO: 20669 - DNA, 173 bp, Homo sapiens
  misc_feature 20, 22, 41: n = A,T,C or G
ccctgtttttgtcttcccgngnccttgctcagcatcacagncatctcttcagacacctcctcccatcctggaaggagtcagggtagctctcaacttaatttaacttaggaaaggttttctacgctggaagtggatggtgaggatattaacaagaaaatgctcatgattacatg

SEQ ID NO: 20670 - DNA, 278 bp, Homo sapiens
  misc_feature 15, 16, 208: n = A,T,C or G
ggcgtgccctctggnnaaagccctggttgtgatggtgtccaccttccacaagtactcgggcaaaggagggtgacaagttcaagctcaacaagtcagaactaacggagctgctgacccgggagctgcccagcttcttggggaaaaggacagatgaagctgctttccagaagctgatgagcaacttggacagcaacagggacaacgaggnggacttccaagagtactgtgtcttcctgtcctgcatcgccatgatgtgtaacgaattctttgaaggcttt

SEQ ID NO: 20671 - DNA, 154 bp, Homo sapiens
ttgaaaagtcttatatttaaaacagggatgttttgaatttgcttttagccttttcattcaggaggagttgatccaaggtatccactcagacatggagattggcaactgtcaattactcaggagcttgtctgtgtagtttgtggaaaaaaaaaaa

SEQ ID NO: 20672 - DNA, 400 bp, Homo sapiens
  misc_feature 17, 18, 244: n = A,T,C or G
tggcttctgtttctagnngaggaggttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgntcagcattcttagcctgtggcaataaagagaaactttgtgctacatgacgacaaagctgctaaatctcctatttttttaaaatcactaacattatattgcaatgaaggaaataaaaaaagtctctatttaaattctttttttaaattttcttcagt

SEQ ID NO: 20673 - DNA, 417 bp, Homo sapiens
  misc_feature 11, 14: n = A,T,C or G
caagtccaagnagnaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaggaaaaaaatctctttttttctggaggctggcacctgattttgtatccccctgtagcagcattactgaaatacataggcttatatacaatgcttctttcctgtacattctcttgtctggctgcacccctttttcccgcccccagattgataagtaatgaaagtgcactgcagtgagggtcaaaggagagtcaacatatgtgattgttccataataaacttctggtgtgatactttcaaaaaaaaaaaaa

SEQ ID NO: 20674 - DNA, 392 bp, Homo sapiens
  misc_feature 101, 185, 227, 232, 234, 270, 291, 343, 345, 374: n = A,T,C or G
ggccttttgtcaatcatcattctcttgtttcagggctttggggtatctaatctcccagaacatcaatgatacctaaagtcttctttctacggggctgggtngttcacaacttgccttatttcctttcatcctcataggaacatgggaagtaggcattatttttattttctccatattttaattgnggaaaccaagaatcctctgagaagctaggtagggtagcttgncccananagtaatgggccagggacataagccagcccaggcagntgtcactcaaccatccgcttntttggaggtccatttgccccagcataaagttttgtcacaaagtcacttcagngngcaaagagaaagtttcccctaatactgangggacacttatccccttg

SEQ ID NO: 20675 - DNA, 235 bp, Homo sapiens
  misc_feature 39, 208: n = A,T,C or G
ctttagtaaaatacttatgaaattctagcaataattagnacttaagctaattgctaacataaaaaggcaatgcaaattattaataaaaaatcaagaagaaacaattaagaaaataaagttaattataagccatgtaagaacatttaatactagataataacaaaagcaaaaatcatatatatctccacttttttttgtagaagagatngcgggaaaaaaaaaaaaaaaaaaaaaa

SEQ ID NO: 20676 - DNA, 230 bp, Homo sapiens
  misc_feature 11, 49, 61, 121: n = A,T,C or G
gttctgactcngaggagtgggatcttaaaagatgagtggaatctgagtngtctctgtctgnagggaagatattccagacagaggtaacaacaaaaatcaaggtagagtggtaaaaacagtncagcaggatcaacattctcaaaagagaacaaaggtgacagtatctatctgcctgaactctctgtttacagaaaccaatggctacttgagtgaccattttaaatcttcca

SEQ ID NO: 20677 - DNA, 350 bp, Homo sapiens
  misc_feature 1, 24, 49: n = A,T,C or G
ntcacagttgttattgtttacagnaccatttaattaatatttcctctgnttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcg

SEQ ID NO: 20678 - DNA, 345 bp, Homo sapiens
  misc_feature 53, 55, 140, 202, 296, 299, 324: n = A,T,C or G
ggccggtgtttgtgagttggggggaaaactgtggaaaaccagaattcccaggngnttacaccaaagtggccaattattttgactggattagctaccatgtaggaaggccttttatttctcagtacaatgtataaaattgngatctctctcttcattctattctttttctctcaagagttccatttaatggaaataaaacggnataattaataattctctaggggggaaaaatgaagcaaatctcactggatatttttaaaggtctccacagagtttatgccatattggaattttgntgnataattcccaaataaatattttggngaagcctaaaaaaaaaaaaaa

SEQ ID NO: 20679 - DNA, 253 bp, Homo sapiens
ctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccaaaaaaaaaaaaaaaaaaa

SEQ ID NO: 20680 - DNA, 590 bp, Homo sapiens
  misc_feature 26, 50, 108, 171, 205, 264, 265, 348, 349, 422, 443, 522,543, 555: n = A,T,C or G
agaaacaagcatgtctctctgcctgnatccatctaaactggggtgatgtnagcaggacccagcttaaagttcttctttctttcttaagccctttgctctggaggaagntctccagcttcagctcaactcacagcttctccaagcatcaccctggggagtttcctgaggggntttctcataaatgagggctgcacattgcctgttntgcttcgaagtattcaataccgctcagtattttaaatgaaagtgggtctaagatttggnnttgggatcaataggaaagcatatgcagccaaccaagatgcaaatgttttgaaatgatatgaccaaaattttaagtaggaaagnnacccaaacacttctgctttcacttaagtgtctggcccgcaatactgtaggaacaagcatgatcttggtactgngatattttaaatatccacagnactcactttttccaaatgatcctagtaaattgcctagaaatatctttctcttacctggtatttatcaatttttcccagnatttttataccggaaaattgnattggaaacacnttagtatgcagctgataagaagaatttggataatt

SEQ ID NO: 20681 - DNA, 613 bp, Homo sapiens
  misc_feature 37, 189, 475, 563, 594: n = A,T,C or G
aaaactataatgttgtttttttgccccaccggtgatnttaagtcccttaaagtcctactgagtttcacactactgttgtgcttcttatacctgatgcactttataagccccagtgttcaagtagcttaagttttatatttactaagatgactatccaaattaagggacctgagactcctatttggtggnttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaagggttggccatagaattctcttgtatgatcgntgaccttttataatcttctgtaggccatctttcaaacactggcatcagaatatttttataaaggtttgggttaaacagcttagttggnccccccccactcccaagagacttgggttagntatagctttaataaaattt

SEQ ID NO: 20682 - DNA, 517 bp, Homo sapiens
  misc_feature 18, 355, 361, 478: n = A,T,C or G
ttggagtgcagcaagganatgctgtgcaggaaataattcccaaatctaagaccacccatggacatgggatgagatcactcacagaaagttttgaataatttgagaggagaagatataagacagactcctaggggacaccataaacctttaagttattagaaatggattgctagtttaatcagtggggtaaacacatttgtaagaaagaaatattagctgggcacagtggcccatgcctgtaatcccagtactttgggaggctgaggcgatgagatcacttgaggccaggagtttgagaccagcctggccaacatggcacaaccccatctctagtaaaaagtacataaattagttngggtgngggtggcatgtgcctgtagtcctagctaccttgaaaggctgaggcaggagaatcacttgaacctgggaggcagaggttgcagtgagctaagtgagctgagattgcaccactgcattncaccctgggtgacagtaaaactctgactcaaaaaaaaaa

SEQ ID NO: 20683 - DNA, 382 bp, Homo sapiens
  misc_feature 18, 19, 49, 116: n = A,T,C or G
tgcccaggtgtggtcacnntgttcctctccgcggtcttctttgccaagnagcaagtcaaatgaaacaaagtagtcctcttcgtggaaaagaaaaaaatacgctccctttaaacggnggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattagggcagatatcattgcatcacatttatttatctttctgggtatttttatagcccttaataaaaaatattaaaataaaaaaaaaaaaaaaaaaaaa

SEQ ID NO: 20684 - DNA, 472 bp, Homo sapiens
  misc_feature 150, 151, 169, 363, 387: n = A,T,C or G
acgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagggtgannctcaactccccccaaagngcctgactttagtgaacctagaggtgatgtgagtaatccgcgctgttctttgcagcagtgcttccaagctttttttggtgagccgaatgggcatggctgcgctggatcctgcgcctctggacgtgctagccatttccagggtcccaactactgtcatcgtgagggtttcatcggctgtgccatttcccaacgtnttttggggatttacatctgtctgngttaaaataatcaaacaaaaaatcagtcctgtgttggcagcatgattcatgtatttataataaaatttgattattttaattttcc

SEQ ID NO: 20685 - DNA, 570 bp, Homo sapiens
  misc_feature 309, 449: n = A,T,C or G
ttctctcgcgcgggtgtcgctggcctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggngctattcattcctccattgctaaacagatgaaaagcgaggttgctacactaacagcagctgggaaagaagttatgcttgttggaattggggacaaaatcagaggcatactttataggactcattctgaccagtttctggnggcattcaaagaagtgggaagaaaagccccccacttttggagatgcgtcagtcattgcccttgaattactaaattctggatatgaatttggatgaaggctccatcatctttaataaattca

SEQ ID NO: 20686 - DNA, 344 bp, Homo sapiens
  misc_feature 16, 26, 27: n = A,T,C or G
caccccctccaaaaanattaaaatgnnggatctgtctcaccgtgaattaaggtaaaaaaaattacataaaacataagcacatcaaatctggagatagattaaatgaatcatatacattaagcaaggatgaattaatgcaaagatagtttaatatttagatgtttggggccaaaatttcatactgctaggccagaggagaaaaatacacggatcttcaaagaggatggaaaagaaaggagtacactattaccatctagataaaactcaaagggatacttttttgagatttataaagaaaatttcaaatttataacaaaatcatacaaaaaaaaaaaaaaaaaaaa

SEQ ID NO: 20687 - DNA, 531 bp, Homo sapiens
  misc_feature 25, 491, 503: n = A,T,C or G
acccaccaatggaagcagctggctncactgctcaggtgattaccctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggggggtgtcatcaaagcagtggacaagaaggctgctggagctggcagggtcaccaagtctgcccagaaagctcagaaggctaaatgaatattatccctaatacctgccaccccactcttaatcagtggggggaagaacggtctcagaactgtttgtttcaattggccatttaagtttagtagnaaaagactgggntaatgataacaatgcatcgtaaaacctt

SEQ ID NO: 20688 - DNA, 123 bp, Homo sapiens
aaacgacaatgtaaacatgaaaatagagcatataccccaaaatgtttgctcagtatgttggcattgtttactccctgatgtttttctgaatttaccacacaaaaaaaaaaaaaaaaaaaaaaa

SEQ ID NO: 20689 - DNA, 630 bp, Homo sapiens
  misc_feature 32: n = A,T,C or G
aaccaacttctaatatataaatttaattgagnaaaaagcaaaacacaaaattagaaattttaatggagaataactactgattcttaggatgttttaataaataagtgagaatagcttaactttttttgaaagagaagaccattgagggggctttctctactagatattaaaatgtattataaaactgaaagtaattaagtccctctggcattactgaaaaatcaataatgacagatcaatgaaacctaatggaaaacactgaaataaaccctactatgttagaacccaatatacgagaaagaaaaccaactgggaagcgatagattattcaataaatggtaatggagaaattggaagcttggatgaaaaatcaaattggaaccctagctctcaccagccaccaaaataaattccaggtggattaaaaagtcagatgtaaaaagaagaaaccatgagcaagctccagaaaacaaagtgaatatttaatcagccctgagaggagaaagaactgttaagcataaaatctcagaagaaacatgaaggaaaaactgggggggtttgattacatcatacacacaatttagaatttcagtccctcaaaaaatatgaacttattttaaagagcaaatg

SEQ ID NO: 20690 - DNA, 304 bp, Homo sapiens
  misc_feature 23, 55, 281: n = A,T,C or G
ctttcacatgggaatttaataangcttcttagaagttttctgtgcttgaaagganaggcaaaaaaacgatctaaaggccttaaacatgtaaggaagaagggtgaggagatacttacgaaggaccattaaggaagctgtagctgaacactggccacggaaatttttggccttaattgtgtactttccactgtcgctgactgatgcatttcggatttcaagggagtatacatttctggagcggcttatgctgacatttgaagaaaatagaaatctaagacaanggggaaaaaaaaaaaaaaaaaaa

SEQ ID NO: 20691 - DNA, 440 bp, Homo sapiens
  misc_feature 18, 38, 196, 205: n = A,T,C or G
ctgggtcagctgcagctngttactgcatttctccatgnggcagacaggagcaaagccacaacgctttctctgctggattaaagacggcccacagaccagaacttccactatactacttaaaattacataggtggcttgtcaaattcaattgattagtattgtaaaaggaaaaagaagttccttcttacaacttggnttcaacggnccaaaacaaaaatgcagctgccattaaagtcacagatgaacaaacttctacactgatttttaaaatcaagaataagggcagcaagtttctggattcactgaatcaacagacacaaaaagacatcattttacaacctcatttcaaaatgaagacttttacctggaccctaggtgtgctattcttcctactagtggacactggacattgcaggaggtggacaattcaaaaaaaaaaa

SEQ ID NO: 20692 - DNA, 460 bp, Homo sapiens
gcagtgactatatttcacatcttttaatatcctggtgttcactttgctttgtcatcttttgtaaaataaacctcttggtttaccctctcccaccccctacttcatcccctctctgaactatatgtgggaataccagcagttgccaaactcattctgtaaagggggctggatggtagatactccaggctccgtgagtcattgtttctgtggaagttcttcaactctgctgttatgtcaggaaagcagcttgggcactacgtaaacaagtgagtactgccatgctcctggaatagtttatctgcaaaaacaggaggcagaaaaagtagaaataggccaggcatggtggcttacatgtgtaatcccagcactttacgagtccaaagcgggtggatcgcttgaggtcaggagttagaaaccatcctggccaacatggcaaaaccctttctctactaaaaataca

SEQ ID NO: 20693 - DNA, 590 bp, Homo sapiens
  misc_feature 25, 26, 51, 426, 457, 532, 569, 571: n = A,T,C or G
cttgtatttaacaggtactaccttnnctttacttttaatactatacacaanttggaaagcaaatccttgcatatcgtagggcttaattttttattggaggaataataacatgcagactgatgcagtttgaaacattttcttcccatgtgtgtgtctatgtttgtgtcagtccctgtgtctacatgtgtgtacgtctgtgtgtgggcgggtgtgtgtttttctgtacacctggggggagaggtatctgtaaagtcagttctcttctctcctgtagggtggatatgcagcctacagatatgcacagcctgctactgcaaccgcagccaccgctgctgcagccgctgcagccgcttacagtgacggttatggcaggggtgtacacaagccgacccctaccatgcccttgcccctgccgctagctatggnagttggcgctgtggcgagtttataccgaggnggctacaggccgatttgccccctactgaagtgacgtgagaccccctgcaaatgggacagccccccagttcatgangcctgggtattgcatatttactagtagaggaactctntngcaggatgaagagggaaaa

SEQ ID NO: 20694 - DNA, 532 bp, Homo sapiens
  misc_feature 40, 43, 197, 388, 432: n = A,T,C or G
tacattgggtaaaattttttggcattcatcttcagtatgnagnggctagtagagaatcaatcattttctcctaatacgttacctattagaattgagtattttatttccctcatcctaatctacgataatcactaccagatgagcccaattttaagaacagcccattatttccatagtactatttgtatcctctatgnatgctaaataaggaggccaaaaatctcagtttggaagcttattcaacaaatgaacttgatggctggtctatttattactctgcttttgcagatatagtgctatgactaaactcagatgcaggtaaactacaacactatgtttttcagcttcagggactccagcctattcaaatacatttttataaataaanaagaattttaaaaagtctttagagatatatcttttaaaatttgngatagaatttcttttcctatctgacttactggggacctcattaaaattactggacagaaaagcaattccagtcctagttccgaaaaaaaaaaaaaaaaaa

SEQ ID NO: 20695 - DNA, 367 bp, Homo sapiens
  misc_feature 27: n = A,T,C or G
tgtagccacataattgtaaaattcagnatattcatttataccacattgttttataggtaatttctatcacaaaccagtgacatttcctgaaatcaagcctggtaacacctgatgtttatatgatattcagtaaggacttttaccttactgatttcatggagcttttgaagtttgttttataataattatataaattagtaatgatgtaaaaaagtatttgatattaaaagtttaatattgataatgttgctgattgtaccatttccttagcttcagctgagtcataggccagactgttgaaatgctgaaatgaagaaggttgttgcagtttcaaagtccaaaaaaaaaaaaaaaaaaaaaaaaaaaa

SEQ ID NO: 20696 - DNA, 286 bp, Homo sapiens
  misc_feature 19, 44, 206, 207: n = A,T,C or G
cccaaaaactttttaaaangtccagtaattctattttaacctgnagttgagcacctttaaaacgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgnnttgaccttgtaactatatgttaatctcgtgttaaaataaaatataacttgtggaaaaaaaaaaaaaaaaaaaaaaaaaa

SEQ ID NO: 20697 - DNA, 540 bp, Homo sapiens
  misc_feature 24, 50, 483, 485: n = A,T,C or G
atgggacatttccatcagcccagnatatatccacagtgcccctttgcagncttcctagtcaaccactgttctgattcctgagccagcctttgtaactgctcatgaaaatgacacatgtgcattgttattacagtgtctagcaccttattctttcttattgcaaaatatagcctaatattgagtattttagtggcttttcagcaggtggagagtttgtaaaataattgtttccaatggtacacatcttaaattatgtgtactgttgatcattttgatgttcagacatggttttaaaagcctgcattaaaaaactaatgtcctacagcaaaatggggcatatacaggcaatggactattatacagccttaaaaaggaattacgatatatgctacaatataggcaaaccttgaagacattatgctaagtaaaataagacagacacaaaaagacaactgtcttatggggtgattgcatttatataangnatgcagaacagtcaagtttgtagagatagaaggtagaataagtagttaccagagg

SEQ ID NO: 20698 - DNA, 620 bp, Homo sapiens
  misc_feature 546, 594, 613, 616: n = A,T,C or G
gaagaagtgttttcatctatccaacaaaaatatgatgtctccatcccaagcctcactcttattcttaaatgtatgtatttttatttgtggagaagctgtacaaggtaacttgtgtacatcattctacggactcttcagtagttaacattgtagaagatggatctaatgcaaaagatgaaagtaaaagtaatgatactgtttgtaaggaagactgtgaggaatcatgtgatgttaaaactaaaattacacgagaagaaaaacatttcatgtgtagagaattttggctaggactgaaaaagattttttatatagtaaatcagaaaaataccagttttatgctgtatgtggctttggaatctgaagatgacactcttgcttatgcatcatatgataatttttggctagaggatgaaacgagattttttaaaatgcacttaggacggtattcaggaaatgctggtgatgcattccggggtctcaaaaaagaagataatcaaaatgcaatgccttttagcacatcagatgttgataatgatggggtgtcgncctgcatgcctggtcaatggtcagtctgtgaagagctgcagtcacctncataacaagaccggctggnggntaac

SEQ ID NO: 20699 - DNA, 599 bp, Homo sapiens
  misc_feature 373, 459, 463, 570, 573: n = A,T,C or G
gcagccagcgcagggtttttctgctgagggggcaggcggagcttgaggaaaccgcagaataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggngacttaaacagcttaaagtttagtttaaaagttggaggtgattaaaataatttggaaggcgatcttttaaaaagagattaaaccgnaggngattaaaagaccttgaaatccatgacgcaggggagaattgcgtcatttagagcctagttaacgcatttactaaacgcagacgaaaatggaaagattaattggggagnggnagggatgaaccaatttggagaagaaa

SEQ ID NO: 20700 - DNA, 483 bp, Homo sapiens
  misc_feature 410: n = A,T,C or G
tccgaaaatgttatttgtaactccatttctctgaaatcagggctacttgctttatgttttagtcaacagtgtctcgcattctgattgatcatgtgaaggaatcatttatgggccccgtccctaaggagaaacagaagaggagtcagaaagaaagatgcctgtgttttcctctgtggggcccgtgcacttcctggagagatgctacaatgcaatatacagcgctccatccccactggggaagctgctgtgatgagactagatgagccttcaacacactcagaaaatgcaacagcaatagggggcagacagctcctacctgtgtttctaggagcaaaagagagggaactaattgcccgtgaagacgccagtggaaggatcagcctcattctaagcaaaaacatagtattagngatactcttactgccttatcttaaccaaggactaataggatacctttccattaaacaccagtgacttctcagg

SEQ ID NO: 20701 - DNA, 740 bp, Homo sapiens
  misc_feature 23, 45, 47, 201, 202, 216, 342, 485, 522, 525, 665: n = A,T,C or G
tttcttaaattaatatctttacntattttcaactggctccccagncngataaggaagggataaaagaaaaaagaaatgtattagttgggtggccaaggagtttcctttgtaatgttgagagacttccgctttctgaatttcgctggttctctaaggtaaaagagttaaatagtacccttgttcaccaaggaaagtgatccnnactatatatctagngcagatatttcctttgcattatttagtcttctctggagagaaaatacagtttccccttcctctttctcttcacatttactcttttcaacccaaaataagagacatagaaagcaaaccacagccagnttggcatcttctcagtgctactagtataggcacatacacatacacagtctcagcaagggtataaagaaccctgtcaggtccacttgcaacatggccttgctacttggattagctcctttaagcctgaaaataactttcctggncatggaagaactggacgcatcttttaacttatgaaanagnaagttgaacttgaaaactctttttaaaaaatcctgggtttgcaggacagctacataatgaatgatttatttaagactggagctgaattgcacatgaaatcagaatgccaacttcttgactttcaatggtagacatttatncttaagtgggagcgatatatgtagcatgctgggaaaaggctgtatagctctttaattcatcaggattatacagaa

SEQ ID NO: 20702 - DNA, 303 bp, Homo sapiens
  misc_feature 20, 278, 279: n = A,T,C or G
atgtgcattttccttttggnataaatggtccacagcactaactggtaaggcttattgtacagtatattgtcagtattcttctggttcagcataccttatagttcatatataacctgtattaattgtatagattgtgcattaaaagctgttaccaagttgtcagaacataagagcgaaaacaaggtcatatgtaatattttgtttgtaagtatcctttgtatcatagcaaaggaaatgtttaaaaaaatcaactgtaataaagtaattttagtacaaannaaaaaaaaaaaaaaaaaaaaaaaa

SEQ ID NO: 20703 - DNA, 393 bp, Homo sapiens
  misc_feature 25, 27, 29, 32, 34, 48, 58, 104, 106, 113, 125: n = A,T,C or G
acctcttgggtaacacaggccccanancnttncnttgatggtcgcggngccccagccntttttttgtccttgggacttctttatttgcacagtaaaagtttgtnantatcagntcaagggaggantaatgctaatttgcattcatttatgcaaacagtagctctttaggaaatctagaatgttgaagctggaagagaaggtttactcattcctcatcatttggcatatcaggaaatgaagatggaagcttccgactgcttgccaaaggtcataatggagactgaatgagaatcaaggttgtctgaatcccaaatggttctcttttccccgcatgtgctgcctcctgtttggggatttccatttcttaagaaaaaaatcatcaagaaaaaaaaa

SEQ ID NO: 20704 - DNA, 529 bp, Homo sapiens
  misc_feature 42, 57, 162, 454, 488: n = A,T,C or G
actaatctgtgggtagcagtttattccagtatcacccagggngcagccacaccaggnactgtgttgaagggtgttttttttcttttaaatgtaatacctcctcatcttttcttcttacacagtgtctgagaacatttacattatagataagtagtacatggnggataacttctacttttaggaggactactctcttctgacagtcctagactggtcttctacactaagacaccatgaagggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgaggacaactctctttttccaacaagagagccaagaagccatttttttccatttgatctgtttccaatgngtccatttggatgtcagtgctattcacgagttgnacattgctcagatttagggttgacctcagtcccaaccaaca

SEQ ID NO: 20705 - DNA, 196 bp, Homo sapiens
  misc_feature 13, 27: n = A,T,C or G
tgtatagtaaagnaagtggtcaatagnaaatgaaataggggaatcatattcaaaaattttaaatggcaggcaaggtggctcactccttacaatcccagcactttgggaagctgaggcattaggatcgcttgaggctaggggttggagaccagcctggctaacataacaagaccccttctctacaaaaaaaaaaaaa

SEQ ID NO: 20706 - DNA, 650 bp, Homo sapiens
  misc_feature 23, 25, 49, 575, 595, 625: n = A,T,C or G
gcattgtggcagccagcgcaggntntttctgctgagggggcaggcggancttgaggaaaccgcagaaagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaagattattggggaggggnaaggatgaacaatttcgganagaaagaagtttggagggggaaaactgganacagaagtccggaggcgaaaaaaag

SEQ ID NO: 20707 - DNA, 570 bp, Homo sapiens
  misc_feature 7, 21, 22, 48, 49, 414, 418, 468, 549: n = A,T,C or G
gcattgnggcagccagcgcanntttcttctgctgagggggcaggcggnncttgaggaaaccgcagaaagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgnaggngattaaaataatttgaaggcgatcttttaaaaagagattaaaccgaaggngattaaaagaccttgaaatccatgacgcagggagaattgcgtcatttaaagcctagttaacgcatttactaaacgcagacnaaaatggaagattattgggag

SEQ ID NO: 20708 - DNA, 640 bp, Homo sapiens
  misc_feature 25, 27, 508, 533, 615: n = A,T,C or G
ccgatatattgatattacattttantnatgcttttgtatggcactttatagtgtttcagacaccttttgtaacagccctgtgagacagacaatattatccttattgtacagatgggggggctctggaggctctgaaaagtttttggtgatattcccctaagtttataccacaaaatgatggagccagaatttagttgcagaacttctgactccaagtccagagttctttactagacatctggtttcttactagctttttgctagctttttattttacagtgaaaagtatggaagcaaatcctgataattttggcttattatcaaatatcatttattttttattgcagagacccagcagatgtaactctcattgtagccatcccaaagaaaacccttctttgccctttgcagtgccacttatttaggtaactgaagtgtatttccagtacaatttgattttgaactaagatttgatatagaggtgggaattgcttacataactctttgnaaatgtatcatccctgggttctcangtgaaggaggcaattcaaaagtaaaaaagaatattcgaatacaataaataccctctgttctcacacaaatgctggttcttanctaacttgctttgacaacctactga

SEQ ID NO: 20709 - DNA, 359 bp, Homo sapiens
  misc_feature 25: n = A,T,C or G
atatgaccaaaattttaagtagggncgtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctggtatttatcaatttttcccagtatttttatacggaaaaaattgtattgaaaacacttagtatgcagttgataagaggaatttggtataattatggtgggtgattattttttatactgtatgtgccaaagctttactactgtggaaggacaactgttttaataaaagatttacattccaaa

SEQ ID NO: 20710 - DNA, 600 bp, Homo sapiens
  misc_feature 24, 359, 379, 395, 534, 587, 593: n = A,T,C or G
ttttctgggtataaagtaatgttncaaattgcttttggtatgagtagccagttaaagtttcaaatatcatacttagatgatatttttagaaacatgttgaaaaatagtcatgtggtgcagaatgatgtttcagtcaatgatggactgcatatatgacagcgatcccataagattataatggaactaaaaaattcttattgcctagtgatgtaacatcatagcacaatgcattacgtttttatggtgatggtggtgtaaaccaacctattgcattgccagttttgtacaaaagtgtagcacatacaattatatacagtacatagtacttgataatgataataaatgaccgtgttactggnttatgtatttattatactgntggcatttcagagtgnactctctctgctttattttcttttttaaagggtaactgtaaaacagtctcatgcaggtccttcaggaggtgttacagaaagaaggcgttggtattgggagatggcagccccatgcacattattgcccccaaaagccctncactgggacaagatgtggaggaggacaatgatatttgatgatcctgaccccgngtaggnctaggct

SEQ ID NO: 20711 - DNA, 590 bp, Homo sapiens
  misc_feature 12, 23, 24, 28, 45, 425, 460, 464, 514: n = A,T,C or G
acctctttggtncccagccccanntctntccttatggccggggcnggcattgtggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggngacttaaacagcttaaagtttagtttaaaagttgnaggngattaaaataatttgaaggcgatcttttaaaaagagattaaaccgaaggngattaaaagaccttgaaatccatgacgcagggagaattgcgtcatttaaagcctagttaacgcatttactaaacgc

SEQ ID NO: 20712 - DNA, 152 bp, Homo sapiens
  misc_feature 36, 55: n = A,T,C or G
cttaaaaacataccaactgttcaatgaaaaccttgnaaaactattacctgggggncaatcaacttgagaagtttgacataaagagcttctgcaagatcctggggccattatcctactccaagatcaagcatttgcgtttggatggcaatcgc

SEQ ID NO: 20713 - DNA, 510 bp, Homo sapiens
  misc_feature 16, 114: n = A,T,C or G
ggggatgctaataagnaaaactgaacaatgccttggtggttttatatatccagtggcataaatatttccttatctggcccaccctgtttacaacttaaaattacataaaacggngatgcctttctttcctgggcaagctttatagtttctttactgataaggtgagaaagtcaaagaccgaaatgtctggagtcaaatgtctccaaggcattaagaggaaattttaatttgactagtaatcaaagaaatgcaaattaacataatgcaaatgtttagaaaataccatgccaaggatacaggaaaattcacttgtgcattttatactctgctattaggaatataaattgtcaaaatttttctggatggtataaagagttctttaaaaatagctctgacctagtacttctcttaaggatttatcccaaagaagtaattggagctaagactttagacacaattgtaataatgaaatttttaaaagcaacctaaatgtctagcagtagtgtaagt

SEQ ID NO: 20714 - DNA, 326 bp, Homo sapiens
  misc_feature 45, 231, 238, 278, 298: n = A,T,C or G
cgcggttctattttgttggttttcggaactgaggccatgattaanagggacggccgggggcattcgtattgcgccgctagaggtgaaattcttggaccggcgcaaggacggaccagagcgaaagcatttgccaagaatgttttcattaatcaagaacgaaagtcggaggttcgaagacgatcagataccgtcgtagttccgaccataaacgatgccgaccggcgatgcggnggggttnttcccatgacccgccgggcagcttccgggaaaccaaagtntttgggttccggggggagtntggttgcaaagctgaaaaaaaaaaaaaa

SEQ ID NO: 20715 - DNA, 570 bp, Homo sapiens; identical to SEQ ID NO: 20685
  misc_feature 309, 449: n = A,T,C or G

SEQ ID NO: 20716 - DNA, 605 bp, Homo sapiens
  misc_feature 24, 26, 67, 206: n = A,T,C or G
aatttaagtaatttatcaaagggntntataatgatttagtagtgaagctcgaaattttagcccaggnattatctgatttaaaaccagtgcctttatggaatgatgtttacattgggaatacggaggaagagaacattatatgcttgctcttaaagctctctgtttgattagatgactcattctacaaatactgacaatttgcttgnaggcactaataaggagttcagataaattcacatatttgatatataaaataagattagaaaggtaaataatttactgtaactttgatgtgttctaaagacaaattataaagaattttgagatgaattttgttctggatttctatgccagtgatttctcccattaaaaatgataacttagagctgcagaatttatgacaaattataggaaagattgatagtgtgtcactttagggaaataaacttctttccctatatgtgtaactagtattaatccaaaatactagttacaaatcgaaatgaagaaaacaatacaaaatgaaagaaaacgttggtattttggaaaggtaaacaaaattgacaaacttttagccagactaagaaaaaaaaaaaaaaaaaaaa

SEQ ID NO: 20717 - DNA, 540 bp, Homo sapiens
  misc_feature 16, 264, 344, 460: n = A,T,C or G
tagctccttagtggcnggggtgatgtcttcacctggaactgcctggaacctttgttgcatgattatctgaagcttgatggtctctacgtgagaagaaatgaatttggttaaaagatttaatgggaacttcagggggtgtctacatatgctgtcaggaatgtttgttctagagatttgccggagaaaaacaaaacctggtctgttctaggacctgtgtttccttaaagttttaacacaagcgactccagtttggtttggtttggncttttgaggcctagtgcataagctcaatccaaaacaatggcctcccacaattttgttttttaaaaaattccctttttggncagtttctcacttagatgagagtatgaccaaaacttagggccttagcgacgctctcagttaccatcattttgggttttctggtctcagcctggcattcatcaggtggccttatagncacacatttctttcagctcttgtcattccagttggaagagaaaccatttgaccttctagagatggcttgcatgccaagca

SEQ ID NO: 20718 - DNA, 366 bp, Homo sapiens
taagtatctttttaaatgtgtgtttaaaggaaagtaacaaatatttttagtcaatacctttataaaaatctaggcttgacatggtggcacatgcccataatcccagcacttagggaagccaaggtgggcagattgcttgaggtcaggagtttgagaccagcctgaccaacatggtgaaaccctgtctctactagaaaatacaaaaattagccgggtgtggtggtgcatacctgtagtcctagctactcgggaggctgaggcatgagaatcgcttgaacctgggaggtgaagtttgcagtgagccaagatcatgccactgcactccagcctgagcaacagagtgaactctgtttaaaaaaaaaaaaa

SEQ ID NO: 20719 - DNA, 230 bp, Homo sapiens
  misc_feature 11, 93, 139, 150: n = A,T,C or G
cctttccaagnattgctgtttttgttttggagcttcaagactttgcatttcctagtatttctgtttgtcagttctcaatttcctgtgtttgcnatgttgaaattttttggtgaagtactgaacttgctttttttccggnttctacatgcngagatgaatttatactgccatcttacgactatttcttctttttaatacacttaactcaggccattttttaagttgggtac

SEQ ID NO: 20720 - DNA, 340 bp, Homo sapiens
atttctgactgttcttaaaacagtggggatgcctatattttccttgagtttttgtgactgactttggctatatatatacctttctggggttttgtttgttttttatttttattttgattaccgagggtatttggggtggggttgttttttgagatgtgtaattcttttatggagttttttaaaaagaattttcatattgtttttctaacatggcttcattaaacgtttaagtattttaaaaatatgtaatatttgggccagatgttgtgaataatagtagagataaagctattttattctgtatttttaaaactgttccgtacaaataaaagctctcctg

SEQ ID NO: 20721 - DNA, 400 bp, Homo sapiens
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagt

SEQ ID NO: 20722 - DNA, 520 bp, Homo sapiens
  misc_feature 323, 467: n = A,T,C or G
aggcttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctgaaacaattcggagaagatagaagttttgaagtggaaaactggaagacagaagtacgggaaggcgaagaaaagaatngagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaatngggaagatagaaacaagatagaaaatgaaaatatttgtcaagagttttcagat

SEQ ID NO: 20723 - DNA, 210 bp, Homo sapiens
tggcggcgacgacccattcgaacgtctgccctatcaactttcgatggtagtcgccgtgcctaccatggtgaccacgggtgacggggaatcaaggttcgattccggagagggagcctgagaaacggctaccacatccaaggaaggcagcaggcgcgcaaattacccactcccgacccggggaggtagtgacgaaaaaaaaaaaaaaaaaaa

SEQ ID NO: 20724 - DNA, 440 bp, Homo sapiens
ccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactacccgatggttacttgcttcgtctgttct

SEQ ID NO: 20725 - DNA, 276 bp, Homo sapiens
tataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaaatttaacacccatagtaggcctaaaagcagccaccaattaagaaagcgttcaagctcaacacccactacctaaaaaaaaaaaaaaaaaaaaaaaaa

SEQ ID NO: 20726 - DNA, 400 bp, Homo sapiens
  misc_feature 389: n = A,T,C or G
gcaaatataagctttttcatatgtatttttaactaatgcttagtaattcctagtgtattttgggtttcaaaattgaattgtttatatcctatgttgtggggtccctgaagattatacccctgtaactctacagataatagttttagattcaagatgtgtcacagctctctattaagcaaggagtaaagaaaatcagttacaaccaaatataccattgatggtttttttttaactttcaaatgataccaccaaatagatgaattctggaacaatgaatgatttcaaattagaatcatattaaaaccattttatagtcaattataattccataaaatttgaattgcattaattctgtatttcacaaaattgtaccaataataatttaaggntgattaggcca

SEQ ID NO: 20727 - DNA, 430 bp, Homo sapiens
actgtaaacttttgtgataaaattcaaataagattttatttcttggtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattggatacatgtgggcttttaaaaactccatcctttataaatagt

SEQ ID NO: 20728 - DNA, 376 bp, Homo sapiens
aaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaagttggaagatagaaacaagatagggaaattagaagataaaaacatacttttagaagaaaaaagataaatttaaacctgaaaagtaggaagcagaagaaaaaagacaagctaggaaacaaaaaaaaaaaaaaaaaaaaaaa

SEQ ID NO: 20729 - DNA, 520 bp, Homo sapiens
  misc_feature 56, 507: n = A,T,C or G
atgttaaaacgttgggaacatgtggggaattgtatattgcgctgaattaacttctnccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaaagtttgtgccaacacacggagtcattctggctctctgctgaggcccctgttttctggcaggtgccctccttggaaactggggtttggctctgatcagcggntcttttttgcagc

SEQ ID NO: 20730 - DNA, 330 bp, Homo sapiens
  misc_feature 282: n = A,T,C or G
gcattctcgcttcctggagggtgtccgcaatgttgccagtgtgctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcangaggagtcggacgaggatatggggaatttggcctctttgactaatcac

SEQ ID NO: 20731 - DNA, 490 bp, Homo sapiens
  misc_feature 428: n = A,T,C or G
cgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaaagttggttttccttccactcagacttgtatggaaagaggttatattaaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttataggttaaaggntggtactaaacattgattttttttgatcttctgtaaatggatttataaaatcagttttctat

SEQ ID NO: 20732 - DNA, 100 bp, Homo sapiens
  misc_feature 28, 35, 36, 42, 59, 69, 79, 90, 92: n = A,T,C or G
actaaacttgatcttataggatgatggnagacacnngcgacnaaactggaaggagcaanaagctgactncccatcgccngatgccgcagngncttagcct

SEQ ID NO: 20733 - DNA, 370 bp, Homo sapiens
  misc_feature 10: n = A,T,C or G
cccatacagnaaagagtaatctaggtgcaacataagtaggaaatgctgaaatgagaggaacaagatatcaggtctgcaaaatgacctagaggccggcaagagataaagacttatactggattcatgaaagtggttgataaagatttgagagatattaaaaatgtaaacaaagcaacagataacatgtgaagaatgagaaaagaaagcttgtgttgagatcctgtaagttgtttttgtttgtttgtttttaaagacagggtctcattcagtcacccaggctggagtgcagtggcacgatcacctgaggtcaggagtttgagaccagcctggccaatatagtgaaaccccatctctccaaaaaaaaaaaaaa

SEQ ID NO: 20734 - DNA, 180 bp, Homo sapiens
  misc_feature 15: n = A,T,C or G
aatacaaaaattagnctgggggtggtggtggatgcctgtagtcccggctactctggaggctgaggcacaagaattgcttgaacccggaaggcagaggttgcagtgagccaggatcacaccactgcactacagcctgggtgacagagtgaaactgtctccaaaaaaaaaaaaaaaaaaaaa

SEQ ID NO: 20735 - DNA, 310 bp, Homo sapiens
  misc_feature 206: n = A,T,C or G
agaagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtngagagagtaaaaaatttaacacccatagtaggcctaaaagcagccaccaattaagaaagcgttcaagctcaacacccactacctaaaaaaaaaaaaaaaaaaaa

SEQ ID NO: 20736 - DNA, 460 bp, Homo sapiens
  misc_feature 49: n = A,T,C or G
ttagagagtggggacgtccggcttcggagcgggagtgttcgttgtgccngcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctgggggggaggatacactgatggagtattttgggagaatcccaagaagtacatccctggaacaaaaatgatctttgtcggcattaagaagaaggaaagaaagggcagacttaatagcttatctcaaaaaagctactaatgagtaataattggccactgccttatttattacaaaacagaaatgtctcatgacttttttatgtgtaccatcct

SEQ ID NO: 20737 - DNA, 400 bp, Homo sapiens
  misc_feature 10: n = A,T,C or G
agcaacgagnatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaacctggtttacaaaatccatcaatacttgtgtcattccctgtaaaaggcaggagacatgtgattatgatcaggaaactgcacaaaattattgttttcagcccccgtgttattgtcctt

SEQ ID NO: 20738 - DNA, 416 bp, Homo sapiens
agtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatattttttttcttgaaattgcaattgagtttgtacttttcaaatagattatctactttttcattaaaatgtaaagatgccaaaaaaaaaaaaaaaaaaaa

SEQ ID NO: 20739 - DNA, 334 bp, Homo sapiens
tggaaattctgctcagatagaatgacagtctgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatatttttttctataaaaaaaaaaaaaaaaaaaaaaaaaaaaaaaaaa

SEQ ID NO: 20740 - DNA, 354 bp, Homo sapiens
  misc_feature 9: n = A,T,C or G
atcctaggnagtgacctttatatgtgtggaagattaatggtatatgctccttgtgtcactgtttttgagtaaaatccatttcctttctctgtttcagcctatgacaaaattgatgtttacaggcctgctttttgcttataattgacaacatgtgcaaaaataccaaatttgtgtcctgtgcagtatgaagaattcagtgaatattcattaatgtattagcttgttttgctctctgttcatatatggctctattcttagaaatatgatttgaatgtgatctttcaatagtctgaatattttacaaattatagctatgtcttgtgaaaataacctaaaaaaaaaaaaaaaaaaaaa

SEQ ID NO: 20741 - DNA, 470 bp, Homo sapiens
tgctaagagtaacactgagactgaagaccttaactgtaactgttggaatttgagaaggcttcatgggaagcatatcattttagtaaggcttcataatatgggtggaactggattccccttaaaccaacctccttctgtactagagagtaggaagcttgatcaaagaaatgaagagcaaaagctaggagttatacttagataatagcaaacaatccagaatggcttgagcaaataattcataggtggggcaagggaggacaaatatggctgagacagtacattggtatcagactccattgtattattaggctataggagaagcctcaaaggttttgagggaagggagcagcaaattcatagctatgcacctaccattccactgtccttgagatttgcacttgctgctccgcaagatggactgactttctctgacccagaaagttaatagacaaatttgacattatcttata

SEQ ID NO: 20742 - DNA, 370 bp, Homo sapiens
  misc_feature 311, 359: n = A,T,C or G
cacatacagcagctctattgaataacatgcatctgaattttaagttgcaaaggtatctgaataatttttcatgtgcatcttttgtcgaatgttttggttcaagaaagaatgtttaaagctttttaaaagcacttcagttcttaatgtaactgtacccttctgcatggaaaatcataaccaacatggctgcagtagacttcttagtggtatccagcgccacttgcagagggctgctttatcatattgactttgggtgtaggactctagtgttcttgggtgtattgcatgggctgcattatctacagcattgnacaataacaactagaaaaggcagtatacttcactgatgcttgtctggnaataatcactt

SEQ ID NO: 20743 - DNA, 340 bp, Homo sapiens
attcctgaccttttttctaggtcctagtaattagtatgtaagaaatagaacttggtcggagaacttggccgggtgcagtgactcatggcctgtaatcccagcacttcaggagcccaaggtgggtggattgcttgagttcaggagtttgagaccatcctggatgacatgacaaagccccgtctttacagaaaatacaaaaattagccaggcgcggttgcacgtgcctgtggtcccagctacttgggaggctgaggtgggaggatcgcttgagcctgggaggttaaggctgcagtgagccatgattgcactgctgcactccagcctgggtgacagagtgaga

SEQ ID NO: 20744 - DNA, 530 bp, Homo sapiens
  misc_feature 17, 139: n = A,T,C or G
gtgggcatccacacggnacagaaagagtgctccaggagaagccctctagtccagcttaagaagcagggctgacagtgcagaagttggggaatcctcaagtgcccttaaactgcgaaggaagaaaccttcctctccagtntggagggtgctgtggtttcaaaggggttgggtatttgtttttccctttcctgttgtttttccctttgtctgtcatcccattacttggtcccagccatgaatgccatcattataaaagtggcaaggtagggaaataaaagccgcagcgtttttgccagaggactgaaaaaggtagccccagaaaactggaaagtactggggaaacctgggagggtgaatcttgggacagcaactccataaagttacttatgaactcctgagctcccccaagttgaaggaatctgtgtaatctgatctaaattgtattgacaataccatttataatagctcctctcaaattgaaagactttagtataaatctactaaaacattagagaattttgcatgctgaa

SEQ ID NO: 20745 - DNA, 380 bp, Homo sapiens
  misc_feature 330: n = A,T,C or G
tttgagacaacatatggaaaatgttcacatttgtagattaagctggaattataatgagagcaataagaacaaatttattttgcttaccacagtgttatagctggttctagaaatttgaagtctttataacttaattatgtttaataaaaaatagagtctgccccgtactacagatgtaactcatttgtatattgcagacagacccaaagtggcactgaattttcttgctcaccttttaaaaacttgttccttaattttagccagaaagcaaaaaaacaatagtaatgataaatgtgaacatttttgcttattcattgaatatttttctgnaattttcagcacttatgtatacactttttctgtacttactaggttaaggc

SEQ ID NO: 20746 - DNA, 220 bp, Homo sapiens
  misc_feature 42: n = A,T,C or G
taccaaacctgcattaaaaatttcggttggggcgacctcggntcagaacccaacctccgagcagtacatgctaagacttcaccagtcaaagcgaactactatactcaattgatccaataacttgaccaacggaacaagttaccctagggataacagcgcaatcctattctagagtccatatcaacaataggggtttacgacctcaaaaaaaaaaaaaaaa

SEQ ID NO: 20747 - DNA, 480 bp, Homo sapiens
aaagctgttgagcccggcaaaaaacccttcagtcagcacgtgagaaaactgcgagccagcattacccccgggaccattctgatcatcctcactggacgccacaggggcaaggagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatattgagattacgggagcagcgcaagattgatcagaaagctggggactcacaaattttaccaaaaatcaaagctattcctcagctccagggctacctgcgatctgtgtttgctctgacgaatgggaattta

SEQ ID NO: 20748 - DNA, 500 bp, Homo sapiens
  misc_feature 417: n = A,T,C or G
atataaataaataatttaaattttattggtgttattggaagaaaaatgctattaatgggctaataaaaaacatgtgtttctcttatggattttaataagctccagtattattcaaatgatcaaaaatatagttataattttttgaattttaaaaacgtgattgctctaataaagaataaaatctatgctttttaacaaacatagttttggtgcctaattctgtaatatgttttattgaaattagattcatttctctaatgtgagaaaaatatatccagtaatagtattgactgtttaaaaaattgagctcatcaaaaatattgtcatcaaatacaggtggttaatctgacatacattgcagttacatgcattatttttatttacaacatttgctccttaatgatgaatttatcctgnggtaccctggtttttctacctggaactccatagaatggatggttgcaaaccaacatgtgctcttttcagtcattcactgtttt

SEQ ID NO: 20749 - DNA, 397 bp, Homo sapiens
atagttttgggtggagaaattttgctattatatcgactccttaaaatagtctagtgggattaacttggtttcaattcacagagatctggaagcgaggatcttttaaaaatcctgaaatatacactgcaataaaagaacaaagcatacacctcagccttaaatgactgaagaagtatgtcaagtagcagcaggtggggaaagtggctttggttttcagtttgtgagctctgaatccacacagaaacaggactgcattctgacaacctgaattaattattgtccttaccacaatgaggcagaaaagtataataaaaatcattagtattttcagtcacaattaatgccaagatgaagttttgtcaagtatagccatatcctggaacttatttttgtgagc

SEQ ID NO: 20750 - DNA, 358 bp, Homo sapiens
gctaaaggaaatttatgtttgggggaaaaaggccctctgttcactttaaaattcagtgtggacttatgccaaagggggctgtttaagttgaaagaagccaagttaagtttggcctcttgcctggaatcacttgaattctgaaatttcactgcgacggacatgtgccttgtcacattttccattgcttaatcctgaagtttggtgcaagtctctctgcacctattaaaaagtgatgtatatacttccttcttattctgttggagttgatagaattgtcttttgtatttaacactttgtaattttcacaatattttttaatttaaataaataaacacattttttccctcctgggaaggcc

SEQ ID NO: 20751 - DNA, 200 bp, Homo sapiens
  misc_feature 181: n = A,T,C or G
aggcattgaggcagccagcgcaggggcttctgctgagggggcaggcggagcttgaggaaaccgcagataagtttttttctctttgaaagatagggaaattagaagataaaaacatacttttagaagaaaaaagataaatttaaacctgaaaagtaggaagcagaagaaaaaagacaagctnggaaacaaaaaaaaaaaaa

SEQ ID NO: 20752 - DNA, 300 bp, Homo sapiens
acttaaaaaatatagtcataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaagttttagtt

SEQ ID NO: 20753 - DNA, 264 bp, Homo sapiens
  misc_feature 13: n = A,T,C or G
caccctctaaatnccacgatcaaaagggacaagcatcaagcacgcaacaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttttagatcaccccctccccaaaaaaaaaaaaaaaaaaa

SEQ ID NO: 20754 - DNA, 915 bp, Homo sapiens
  misc_feature 3, 5, 15, 38, 364, 411, 460, 491, 592, 608, 613, 627, 631,643, 673, 681, 691, 693, 696, 703, 712, 715, 720, 744, 749,759, 760, 761, 766, 768, 769, 770, 771, 772, 775, 779, 780,782, 799, 807, 810, 819, 854, 855, 856, 863, 868, 869: n = A,T,C or G
  misc_feature 872, 877, 878, 879, 880, 881, 882, 887, 888, 889, 890, 892,895, 898, 906, 907: n = A,T,C or G
ttncncccccggganctcggcctctctggccggggtantactacctctggaacagatgttggtcaaaatatgtgttatgaaatatattccctttgaaatcttatatgggtgattaccttcccccaacatcagtttattttatcaaagtataaaaagcaagtggcttatgactttgtgaagctcttatacatgtcagccatctaatatgactaggattctttggtatagagtacttgccagtatgttatttgatatctggataacttaataggtaatagcaaacttttttatttatattctctatttttagatttaactacctcattttgacgagctactttaatgcctataatttttttttggngggggttttttctttttctattataaagagcaaattgccctacaggntcttttagaaataaatggaattgactaacttcatgagttattttttgcntcaccaaattggactctggtattcctaaaantttattctttcaacaaatgattgaattgcctggaatggggctaaggcgctctgctaaggctctgggagataacaagatggataccgggcctctttcacagngctcacaggcaagggnaaaangtggggggcggggntaanttctcccccttngaggaacaggtgggcatggaaaaaaaattngggaaaantttttggggntnaancccgggnaaagggccnccnggggnttcccccaaaaagggaatggcctnaatcnctggaaaaannnaatgngnnnnnggnaaanntncccctaaaccattgggnaagccttncanaattattcnggccaaaaaaaaaaaaaaaaaaaaaaaaaaaaaannngggggcngcccnnggnccccnnnnnnttttnnnncnganaantttttccnngggccatg

SEQ ID NO: 20755 - DNA, 430 bp, Homo sapiens
  misc_feature 10: n = A,T,C or G
actcttaatnatgaaacttgattttctcaattggccagtcttctgatctttagtatctctttagttcagtaatttttacctacctacttgatttattttcctttaaaaggtgaaatgacatttaaagaaaaacaaacacccatcattcctcagtcccaacacagcagttcttttcactcttgcttgtaactttcaggccttacccacatgtgttcctatagagttgcatgtagctaaaattatagtgtgctgcctaactttgtgctaataacgaaggacacacattatcattgcctcacagtggatggcacctgaccccatttttccaaggattctattttccagtgaatttttgtcaccgagttaatttcccaagtctgatagcatgaatgctttatttggggctggggaaaagcagagcagcctgact

SEQ ID NO: 20756 - DNA, 430 bp, Homo sapiens
  misc_feature 28: n = A,T,C or G
agttgacccatctctcagcctctctgancttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcagggggtctgttatcccagttaggaggctgaggcaaagagaatctcttgaacctgagaggcggaggttgcagtgagccaagatcgcgccattgcactccagcctgggggacaagagtgagact

SEQ ID NO: 20757 - DNA, 460 bp, Homo sapiens
  misc_feature 10: n = A,T,C or G
actgaaccgnatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttacccagagtaccttggtgggcttggcagagcataagtacatcccaggttgtctaccttcataacaacaatatctctgtagttggatcaagtgacttctgcccacctggacacaacaccaaaaaggcttccta

SEQ ID NO: 20758 - DNA, 410 bp, Homo sapiens
  misc_feature 120, 131, 165, 259, 299, 345: n = A,T,C or G
aatttagtggttgaaggactgcgatgtgtagttttgccagaagatctttgccacaaatttctgcaactggcagaatctaatacagtgagaggaatagaaacctgtggaatactctgtggnaaactgacacntaatgaatttactattacccatgtaattgtgccnaagcagtctgcgggaccagactattgtgacatggagaatgtagaggaattattcaatgttcaggatcaacatgatctcctcactctaggatggntccatacacatcccactcaaactgcatttttatccagcgntgatcttcacacttcactgttcctatcaactcatgttgccagaggncattgccatttgtttgctcaccaaagcataaaagacactgggatcttcaggctcaccaatgctgg

SEQ ID NO: 20759 - DNA, 207 bp, Homo sapiens
cgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaagtaaaaaaaaaaaaaaaaaaaa

SEQ ID NO: 20760 - DNA, 430 bp, Homo sapiens
atttgtaatattatgaagtattcgacttttggtcatttttaccctgcagaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatattgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaaggaaagcataaggacacttactcaacagaa

SEQ ID NO: 20761 - DNA, 392 bp, Homo sapiens
attgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagct

SEQ ID NO: 20762 - DNA, 220 bp, Homo sapiens
aacactcaactttgtgaacccctgagactttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttatatattatttttgttttataaccacttctaaatattctcagtt

SEQ ID NO: 20763 - DNA, 340 bp, Homo sapiens
ataggtttggtcctagcctttctattagctcctagtaagattacacatgcaagcatccccattccagtgagttcaccctctaaatcaccacgatcaaaagggacaagcatcaagcacgcaacaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaaaaaaaaaaaaaaaaaaaaaaa

SEQ ID NO: 20764 - DNA, 500 bp, Homo sapiens
  misc_feature 53, 429: n = A,T,C or G
catctgggagcagaaaacagcaggcagctgttaacagataagtttaacttgcntctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctcctgaaggctctatgaaaggaatagcattgatggtgctgttagaatccagatgttactgctaaaatttacatgttgtgatgtaaaattgtgnaagaaaaccattaaatcattcaaaataataaactattttattagaagaatggtataccttttagaaaaggc

SEQ ID NO: 20765 - DNA, 500 bp, Homo sapiens
  misc_feature 9, 448: n = A,T,C or G
aattcggcnttatggccgggatttcatgaacaggacatacatcttactacattgtgttgagattttagaactcaccctcttcaaaaattatatatatatgaaggaatattacatttaaaggaatattattgacattaaaatttcatcaatggcaatgaatactcaaagaaaatgaagcaatgtcttcaaagttaggaagaaaaaagatacttacctgcactttatattatgcaaaggctacttccagtcattcagaaacttagtttacttactatttagtctctcagtatgaaaagaatattcaagggcttcaccagtaaaacaaacaaacaaaaaaagaatcatagaaaagaatatatgaaatgcaagtgctaaaaaaactcattatggccatacgaagataacgaattcatgcccataatctccgcactttgggaggccagctgangcagggaggttcacttgaggccaggagtctgagagcatcctgggcaatatag

SEQ ID NO: 20766 - DNA, 130 bp, Homo sapiens
  misc_feature 18, 33, 50, 67, 72: n = A,T,C or G
gatgtggggaaggtgtangatgacatgctagangtgaacacgggtagganggcctatttatacttancgcanggagcaactgtgggcaatgccgctgtatgaggacaccatgttatgctgcccgagcgat

SEQ ID NO: 20767 - DNA, 430 bp, Homo sapiens
acgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgtttgcagatccgcaggcagaagctctgcccttctgtatcctatgtatgcagtgtgcttttttcttgccagcttgggccattcttgcttagacagtcagcatttgtctcctcctttaactgagtcatcatcttagtccaactaatgcagtcgatac

SEQ ID NO: 20768 - DNA, 400 bp, Homo sapiens
tttgctttctgacacaactgtgttcacttagcaacctcaaacagacaccatggtgcacctgactcctgaaggagaagtctgccgttactgccctgtggggcaaggtgaacgtggatgaagttggtggtgaggccctgggcaggctgctggtggtctacccttggacccagaggttctttgagtcctttgggggatctgtccactcctgatgctgttatgggcaaccctaagggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcc

SEQ ID NO: 20769 - DNA, 372 bp, Homo sapiens
  misc_feature 11, 16, 30, 343: n = A,T,C or G
cagaacaaatnagccntccttgctaatttnaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggctcctgcttgtcatccacacaacaccaggacttaagacaaatgggactgatgtcatcttgagctcttcatttattttgactgtgatttatttgggagtggaggcattgtttttaagaaaaacatgtcacgtagggntgtctaaaaataaaatgcatttaaactcc

SEQ ID NO: 20770 - DNA, 270 bp, Homo sapiens
gcaaatgttttgaaatgacactgaccaaaattttaagtaggaaagtcacccaaacactttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtatttgaaaacacttagtatggcagttga

SEQ ID NO: 20771 - DNA, 400 bp, Homo sapiens
  misc_feature 24: n = A,T,C or G
cacctaaaccctctgaggttttcntttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaagtgctctcatagttctatcctctaattccattaaatccatactaggagcgtcagtgaggggttttcatagcttttggaaatacctttggtctctgaactgtaattagcaagaagtaaaaacagaaacgtcaaacgtcaaatgtttgctttgttaccttggaggac

SEQ ID NO: 20772 - DNA, 232 bp, Homo sapiens
attagaaaaatttcaactgtaggtgcctttgcaacctactcctgggagaccctaaaacctatttagttttagtgcctagagattttcactcctctaacatctctggatacagtgtccctggtcaacatgaagaagttacagaagaacgctttctgatcctggcccctaaagaatttacttgtgctaagtaataaaattcctattgatctaaaaaaaaaaaaaaaaaaaaaaa

SEQ ID NO: 20773 - DNA, 430 bp, Homo sapiens
catgactggctatattactatgcttacaaggactttctctggtttttctccaagagattcaaatctgctgccatgttagctgtctttgctgtatctgctgtagtacacgaatatgccttggctgtttgcttgagctttttctatcccgtgctcttcgtgctcttcatgttctttggaatggctttcaacttcattgtcaatgatagtcggaaaaagccgatttggaatgttctgatgtggacttctcttttcttgggcaatggagtcttactctgcttttattctcaagaatggtatgcacgtcagcactgtcctctgaaaaatcccacatttttggattatgtccggccacgttcctggacttgtcgttacgtgttttagaagcttggactttggttcctccttgtcactgaagattgggtagctccct

SEQ ID NO: 20774 - DNA, 280 bp, Homo sapiens
  misc_feature 34, 35, 46, 169, 232: n = A,T,C or G
tgcccgcccgaagtttcgacccccaaacgaaganncaaagtcgtanacccttgaggtgcacccggagggtgaaagtcggcgccactttctgcccttggcccccaagatcggccccctgggtctgtctccaaaaaaagttggtgatgacattgccaaggcaacgggtgcntggaagggcctgaggattacagtgaaactgaccattcagaacagacaggcccagattgagggnggtgccttctgcctctgccctgatcatcaaagccctcaaggaaccacc

SEQ ID NO: 20775 - DNA, 400 bp, Homo sapiens
  misc_feature 6: n = A,T,C or G
aggccntgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagctcaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaag

SEQ ID NO: 20776 - DNA, 410 bp, Homo sapiens
  misc_feature 23, 49, 63, 81: n = A,T,C or G
actggagcaaaacagtctttgantctcgaacacgcaaggctgtgagacnacctacttgtaganacttgcaccctactgacnttggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttattttttttaccaattccaatttcaaaatgtctcaatggtgctataataaataaacttcaacactca

SEQ ID NO: 20777 - DNA, 347 bp, Homo sapiens
tctgaaactactctggtgatcaccagggtcagtttctttaatgatggtttccaactggcctaatacattaagtaagactggctgataacatgaccagacagacataaagaccctgttgggaatgacattgaactctcaaagtcaagatttcttacacaaatctatcagctggagaaaatgaaggcagtgtggtatatgtgtgcaaataaggacattatgaagcttaaatatggaatgtctcttggacccccgatgtcatctgtattctctttttcttcttgtactatatcctttgcctgtaaataaaaggtttatttgaaaaaaaaaaaaaaaaaaaaaaaaaaaaa

SEQ ID NO: 20778 - DNA, 500 bp, Homo sapiens
  misc_feature 10, 24: n = A,T,C or G
ctttaaaccntttgtggaaagctntcagataatttgcaagtaccttttgagtgaagaagaggaccacttcagtgaggaacagtacttggctgcagtcagaaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcgaaggactcattacaacaaacagggaagtaaaaggaagagacacatcctctcatactccctgagactctgagaacagtggacgcagagggaaagagatgatcattgggaagcaatcagtttact

SEQ ID NO: 20779 - DNA, 270 bp, Homo sapiens
  misc_feature 9: n = A,T,C or G
aatgaagantggcgccgctggagatcctttcctgcttttggtttccctggcaggggttgaactgtggagtgtgtggtgctggcattacagccagtgccttcctaagtctgagtgcagccatggctgtttcataagaatgatgtaacgttgtcccatgagggatgaaagtcatctgtcacctactgtagcaggacaagccacagacaaaactcctcagacaccggattaaagaagggaagaggtttattcggccaaaaaaaaaaaaaaaaa

SEQ ID NO: 20780 - DNA, 360 bp, Homo sapiens
atcttattagggtaaaatccattagtgataattactagtgcaagaagtaataaagccagtgctgtttccaatacagaaacacaaatacactaaaagtaaggatcctgacaccgatgaagtttccatcaacatttaatttatgttaattgctagcagaaaggcctccatttaccatatttaatgcccttgaaataattcattcagtttggtgtgtggtgttactttataacttaaaacagctgtgcctccacctctcccctccaactcacacttttcttggcctagataaaaaatgtatttgcgttcagaaaattcaggtaggaaagtcattatgtgaaccccaaaaaaaaaaaaaaaaaa

SEQ ID NO: 20781 - DNA, 480 bp, Homo sapiens
  misc_feature 27: n = A,T,C or G
taatgccacctttcctctgtctgccantggaccaacaagcaatatattgctgagttaaacttacccacagactcaggcccagaaagttcttcaccttcatctctttcctcgggatgtctgtcagggttcaccttggcatcaatttgccctgaaacttagctgtgctgggattattctccttgtctttggttgttactgggttggagtggtttcagtgacatccttaatacagaaatcatcaatagaaaaatgcagtgtggacattcaacagagcaggaataaaacaacagagagaccgggtctcttaaactgcccaatatattggcagcaactccgagagaaatgcttgttattttctcacactgtcaacccttggaataacagtctagctgattgttccaccaaagaatccagcctgctgcttattcgagataagggatgaatttgatacacacacagaacctggatacgtgacaaagc

SEQ ID NO: 20782 - DNA, 298 bp, Homo sapiens
  misc_feature 23: n = A,T,C or G
atagttggaaaacttgtgccctntgtatagtgtccccatgggctcccactgcagcctcgagtgcccctgtcccacctggctccccctgctggtgtctagtgtttttttcccttctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttatgaaaaaaaaaaaaaaaaaaaaaaaa

SEQ ID NO: 20783 - DNA, 310 bp, Homo sapiens
aggagctgttcaagcgcatctccgagcagttctcagccatgttccggcgcaaggccttcctgcactggttcacgggtgagggcatggatgaaatggagttcaccgaggcggagagcaacatgaacgacctggtatccgagtaccagcagtaccaggatgccaccgccaatgacggggaggaagcttttgaggatgaggaggaggagatcgatggatagtcggaatagagccgccccaactcagatcctacaacacgcaagttccttcttgaaccctggtgcctcctaccctatggccctgaatggtgcac

SEQ ID NO: 20784 - DNA, 390 bp, Homo sapiens
  misc_feature 45, 72, 74, 171, 220, 254, 287, 335: n = A,T,C or G
cattcctgaagctgacagcattcgggccgagatgtctcgctccgnggccttagctgtgctcgcgctactctntntttctggcctggaggctatccagcgtactccaaagattcaggtttactcacgtcatccagcagagaatggaaagtcaaatttcctgaattgctatgngtctgggtttcatccatccgacattgaagttgacttactgaagaatggngagagaattaaaaaaggggagcattcagacttgnctttcagcaaggactgggctttctatctcttgnactacactgaattcacccccactggaaaaagatgagtatgcctgccgngtgaaccatgtgactttgtcacagcccaagatagttaagtgggatcgagacatgt

SEQ ID NO: 20785 - DNA, 450 bp, Homo sapiens
caagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgaccctcgatgttggatcaggacatcccgatggtgcagccgctattaaaggttcgtttgttcaacgattaaagtcctacgtgatctgagttcagaccggagtaatccaggtcgggtttctatctacttcaaattcctccctgtacgaaaggacaagagaaataaggcctacttcacaaag

SEQ ID NO: 20786 - DNA, 380 bp, Homo sapiens
  misc_feature 18, 43, 254, 261, 300, 306, 308: n = A,T,C or G
agtgtgaaatcttcaganaagaatttctctttagttctttgcnagaaggtagagataaagacactttttcaaaaatggcaatggtatcaagaattcctcaagcaggcctggtttattgaaaatgaagagcaggaatatgttcaaactgtgaagtcatccaaaggtggtcccgggtcagcggtgagcccctatcctaccttcaatccatcctcggatgtcgctgccttgcataaggccataatggttaaaggtgnggctgangcaaccatcattgacattctaactaagcgaaacaatgcncagcgncnacagatcaaagcagcatatctccaggaaacaggaaagcccctggatgaaacactgaagaaagcccttacagg

SEQ ID NO: 20787 - DNA, 370 bp, Homo sapiens
  misc_feature 26: n = A,T,C or G
gaggactctggaacagaaaagaaacntcaggcctaaactagagaaatctgggtaatgtatggactttagttaataataatgtatcattattgattcattgattgcgacaaatgtaccatatttatgtaagacgttaatgataggggcagctgggtttagaggatattggaactctctgtactatctttgcaccttttctgtaaatctaaaactattctaaggttaaaagtttatttgcccatttgtgatggctgacacctgtaatcccagaactttgggagaccaaggctggcatattaccttgaggtcagggagtttgagaccagcctggacaacatggtgaaatcacgtctctactaaaaatacaaaa

SEQ ID NO: 20788 - DNA, 233 bp, Homo sapiens
aaaatcagcagtctcctggaggagcagttccagcagggcaagcttctttgcgtgcatcgctttcaaggccgggacagtgtggccgagcagatggctatgtgctagagggcaaagagttggagttctatcttaggaaaatcaaggcccgcaaaggcaaataaatccttgttttgtcttcacccatgtaataaaaggtgtttattgttttgttcccaaaaaaaaaaaaaaaaaaa

SEQ ID NO: 20789 - DNA, 430 bp, Homo sapiens
  misc_feature 8, 9, 33, 262, 291, 365: n = A,T,C or G
atctgttnnactttagtaggaaacacattttcntatgttgttttaaacaatatctaaaatctgtagagaattagtcaacattcaatagatataaccacttctgtttttgcatttgatatgagttactgtagctacccaaagacttaagaaattcatacattcacttactgtttttgtcttcttctgaagtatgttggaaaagatgaaagatgaactctataatttctttactcatcctcactctgcagtctcttagaaaggntaaatggaagaaggcttgacttcgattgnttttcggatttgaattttggaaaagaaaatgatgctgggagaataaagcagcatatttaggaaagactttcagngataaaaatctggaggatccctggtttctataccttgcttctatgccctattttacttattataa

SEQ ID NO: 20790 - DNA, 440 bp, Homo sapiens
  misc_feature 30: n = A,T,C or G
tgctgagaacagtatcttagggtgcaagantggaagaagggagagcagctgggagccttttgttgtaattcagatgagagataatgagggcttgggccagcatgggaaccatggaggtggtaagggaatgggccgttttctggatatattttaaaatagagccaataaaaattattaatggacaagacgaggggtgtaagagaaaaaagaggagtcaagaatgacctcagagcaaactggaaggatgaagatgcaatcaactgtacagggaagacagaggtggagcggctttggcagcggaggccaggggtctgtctttgacatgttaagctcagctatacattagaccccaggtgatgatgtcacagcagattgctgttccaaatatgactttaccatcagggagaacagggagcaggtaccagtttgcttcttggacc

SEQ ID NO: 20791 - DNA, 420 bp, Homo sapiens
caggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcattggaggttcctgggggacagtgtgtgatgactcttgggacttggacgatgctcaggtggtgtgtcaacaacttggctgtggtccagcttttgaaagcattcaaagaagcagagtttggtcaggggactggaccgatatggctcaatgaagtgaagtgcaaagggaatgagtct

SEQ ID NO: 20792 - DNA, 420 bp, Homo sapiens
tagagacagggtttcaccatgttgtccaggcttgtcgaacttctgacctcacgtgatccacctgcctcagcctcccaaagtgctagattataggcgtgaaccactgcgcccggccagcatgcattttaaaagtggcttagatttagttttaaatattttggggtgaaaggcaggaacagttctgtttttgacatacaggttttctttgggattgttttcattttcaagtatagattcatgtcagaatggccaacttaacgtgggtttctgtattccctggtgttgctcttaacctgaactcataatcagttgccatactgaggcaagagcactcagggtgaacatagtcaagttactttaaaagtgataaaagtgtttttccatggtgaaaccttcagtatttggctgaatgtaaagtat

SEQ ID NO: 20793 - DNA, 370 bp, Homo sapiens
tgacaagactcttctcttcaaaatcctctggcaaatctagcagcggcagcagtaaaacaggcaaaagtggggctggcaaaaggaggtagtcaggccgtccagagctggcatttgcacaaacacggcaacacttgggtggcatccaagtcttggaaaaccgtgtgaagctactactataaacttgagtcatccccgacgttgatctcttacaactgtgtatgttaactttttagcacatgttttgtacttggtacacgagaaaacccagctttcatcttttgtctgtatgaggtcaatatttgatgtcacttgaattaattacagtgtcctatagaaaatgccattaataaattatatgaactactataca

SEQ ID NO: 20794 - DNA, 340 bp, Homo sapiens
  misc_feature 24, 40, 48, 60, 91, 104: n = A,T,C or G
taaaaccctcaaacttcaaaagcntctactttaactttanctactgcnacttcttggaantttttcaggaactaacttctaaaagaaacantcttcttgattcntaaaggagccctcgtacattttagttctttcctagagatggggaataagaaatgttgttcttacaaatttttagaagaatatgtagatataaacaagatgtaaaatcctattactttctaattcatgcactaaatctgaggtttgactagatgacttgtaagggatcttaaattctgttacagttggcccttgatttctttatctgtgaattcaaccaacctcagctcaaaaatat

SEQ ID NO: 20795 - DNA, 370 bp, Homo sapiens
aggctttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaagatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagatt

SEQ ID NO: 20796 - DNA, 209 bp, Homo sapiens
  misc_feature 74, 79, 103: n = A,T,C or G
ccagtgacacatgtttaacggcccgcggtaccccttaacccgtgcaaaggtagcataaatcactttgttccttnaattnagggaccctgatttgaaatggctncaccgagggttcaagctgtctctttacttttaaccagtgaaattgaccttgcccgtgaagaggcggggcatgacacagcaaaacaaaaaaaaaaaaaaaaaaaaaa

SEQ ID NO: 20797 - DNA, 130 bp, Homo sapiens
  misc_feature 14, 105, 120, 122: n = A,T,C or G
cctaagcacagagnaactccagagatgagtgtctggagcgcttcagttcagctttaaaggccaggacgggccacacgtggctggcggcctcgttccagtggcggnacgtccttgggcgtntntaatgtct

SEQ ID NO: 20798 - DNA, 200 bp, Homo sapiens
  misc_feature 143, 166, 173: n = A,T,C or G
gaggaaaccgcagataagtttttttctctttgaaagatagagattaatacaactacttaaaaaatatagtcaataggttactaagatattgcttagcgttaagtttttaacgtaattttaatacgcttaagattttaagaganaatatgaagacttaccaagagtnccttgangaaggaaaagataaaagggttctaaaa

SEQ ID NO: 20799 - DNA, 250 bp, Homo sapiens
  misc_feature 21, 189, 234: n = A,T,C or G
ctgctgagggggcaggcggancttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaggacttagaagagtancatgaggaaggaaaagataaaaggtttctaaaacatgacggaggntgagatgaagcttctt

SEQ ID NO: 20800 - DNA, 320 bp, Homo sapiens
  misc_feature 19, 45, 96, 130, 279: n = A,T,C or G
atatataatttgccaaatntaattaatttattctttttttcttanagaagaaaaagacattggttgttgttacaaaaagtctaaattactgttggntgaaacacagcagctgtggagttcagtccaggcntgaagactaaatctgctttaccaagtaaggtgtaaggttgcatgtttcagtcctctaccatcctgcgctgtgagcagcactatacctgtgcgttgtctgaaagccttccgtatattctccagctaaatggtcgtctggtagcctttgcntttaacaaactagcatgaggctttttatatctaaatgctac

SEQ ID NO: 20801 - DNA, 400 bp, Homo sapiens
  misc_feature 53, 204, 393: n = A,T,C or G
tatttaaatgaatgctggtcagtgggacattttgtcaactatgggtattgggngcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgnacctgatcaagtttattgcagcctttcttttcctatttcttttttttaagggttagtattaacaaatggcaatgagtagaaaagttaacatgaagattttagaaggagagaacttacaggagacagatttgtgattctttgactgtgacactattggatgtgattctaaaagcttttattgagcattgncaaattt

SEQ ID NO: 20802 - DNA, 260 bp, Homo sapiens
cagtaccaggcacatagtaagtgttcaagaaatttcagtcatctttctaaacatttgtatgtgtctataaacattgttttgtgggtttaaaaatgtctataaatgggattaatatctttaaaatttatatattttaaagtcagaaacacatgtatgtagtttaaagaatgaagtagttctagaaggcttgttataaaaaacagcagttccctgattctagaaccctccttctccaaaaaaaaaaaaaaaaaaaaaaaaaa

SEQ ID NO: 20803 - DNA, 150 bp, Homo sapiens
ggtctaagcttaagtgcttaggaagtcagtagcaaaggtaagtgttatggaggtgaacaaaatagctcagtctgagtgtaaaagtaaagagaacaggaatcttgcagaaaagctaacattgaagccatgtgaacaaaaaaaaaaaaaaaa

SEQ ID NO: 20804 - DNA, 100 bp, Homo sapiens
  misc_feature 52: n = A,T,C or G
ccgaaggtgattaaaagaccttgaaatccatgacgcggggagaattgcgtcntttaaagcctagttaacgcatttactaaacgcggacgaaattgggaag

SEQ ID NO: 20805 - DNA, 140 bp, Homo sapiens
gaatgaagaacaccagacatgggccgggcactgtggctcatgcctgtaatctcaacgctttgagaggccaagatgggaggatcacttgagtccaggagtctgagaccagcctagacaacatgacgaaaccctgtttctac

SEQ ID NO: 20806 - DNA, 210 bp, Homo sapiens
cttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccgagaaaaaaaaaaaaaaaaaa

SEQ ID NO: 20807 - DNA, 265 bp, Homo sapiens
  misc_feature 58, 207, 244, 245: n = A,T,C or G
atgccaatatttagtaaagcttttcttttttaatttccaggaaaaaataaaaagagtntgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgncattattttgaaaaaataaatttaaaaatacattccnnttaaaaaaaaaaaaaaaaaa

SEQ ID NO: 20808 - DNA, 247 bp, Homo sapiens
aggatttgatttattttatataggcctagaatataggggatgagaaggatataggacatcatatttggatttcattatggaaatttttttcctgtggaaagataagagaatgtggccaggcacaatagctcacacctgtaatcccagctctttgggaggctaaggtgggaaggttgcttaaagccaggagtttgagaccagcctgggcaacaaagtgagaccctgtttctccaaaaaaaaaaaaaaa

SEQ ID NO: 20809 - DNA, 390 bp, Homo sapiens
  misc_feature 51, 59, 207: n = A,T,C or G
cacccgagaaaattactccgttatcgtcatgttcactgctctccaactgcntagacagngtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagntccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggc

SEQ ID NO: 20810 - DNA, 490 bp, Homo sapiens
  misc_feature 5, 51, 58: n = A,T,C or G
gtacngtgctaataattgatattaatattatgttaaaataacctaactggnggagganatagaaaaatctacaaaatcaattaaaaatcattaatagagttagatataggaaagtgagtcatactcttaagtctgtaaagcctatagcataacatctggcacataactggatttcagtaaatatccgccatatttgttcctaccctgaatgtcctctatactttagcattttatctgtataatgatctactaaaggcagccaggaagaatgactgatacaaaagtggatgtgggcagaagtttctcagagaagtcaaaaacattttggaataagcagatctaagcgtattaaagatcaaaacctggaattggctgggcacgttggcccacatctgtaatgccagcactttgggaggccaaggcgggtggatcacctgaggtcaggagtttgagaccagcctggccaacatggtgaaaccccctttctact

SEQ ID NO: 20811 - DNA, 260 bp, Homo sapiens
  misc_feature 113, 116: n = A,T,C or G
atttttcattaaagcatctgagatctaagaacacaattattattctaacaatgattattagctcattcacttattttgataactaatgatcacagctattatactactttctnggnattttgtgtgcatgcctcatttccctgacttaaacctcactgagagcgcaaaatgcagctttatactttttactttcaattgcctagcacaatagtgagtacatttgaattgaatatataataaatattgcgaaataaaatcca

SEQ ID NO: 20812 - DNA, 360 bp, Homo sapiens
  misc_feature 147, 217: n = A,T,C or G
taaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgntctccaaactggccaaggactccaacactatcctactgccctccaaccctggcgatgtcaccagcatggnggctcaggccatgggtgtatatggagccctcaccaaagccccagtgccagggactccagactcactctccagtgggagcagcagagatgtccaggggtacagatgcaagtcttgatgaggaacttgatcgagtcaagatgagt

SEQ ID NO: 20813 - DNA, 400 bp, Homo sapiens
  misc_feature 151, 154, 375: n = A,T,C or G
tcgacaaactgatcagagaaaataagcagttactaccctgataggcaccttcccaatcctgttgcttttgaccattgtctgtccaacggacacacctcaaacaaacaaaactaccaaatagatgacagatcagaataaaggtgagagggcnggnccccattgaaggctgctacagtcttcaaagaggtgaaggagttcataagagaacaacagtaggaaagttgagagccaagggtaggagagttgcccaaaggacttcccctactactttagggtactgaaaactcaaaggatcagctacagctttatctaagtatttactaaatgctacatgagggtgtccctgtccagctttctggcacatgagtcctgtgnggagagttacctcctcttccaggga

SEQ ID NO: 20814 - DNA, 500 bp, Homo sapiens
  misc_feature 21, 24, 175, 424: n = A,T,C or G
ccatccagagaacaagcatgnctntctgccaagatccatctaaactggagtgatgttagcagacccagcttagagttcttctttctttcttaagccctttgctctggaggaagttctccagcttcagctcaactcacagcttctccaagcatcaccctgggagtttcctgagagntttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgngatattttaaatatccacagtactcacttcttccaaatgatcctagtaattgcctagaaatatctttctcttacct

SEQ ID NO: 20815 - DNA, 290 bp, Homo sapiens
  misc_feature 140, 143: n = A,T,C or G
ttattagaccaataagaaggaataattccaatgtttaataattggggtttggtgtacatttttcttcttaagactaacttaattaaagccttatagtgtgatcagaggtaaaggcctatgaaggtactcagccttattgntgntatcaaaatgcaaaactttggggccaggcacggtggctcatgcctgtaatcccgtcactttgggaggctgaggcgtatggatcacttgaagttaggaattcgagaccagcctgaccaacacggggaaactctggctctactaaaaaa

SEQ ID NO: 20816 - DNA, 350 bp, Homo sapiens
tcagaggtacagcagccttttaccatcatctcccagctgccagtgggtgcaagcagacctctactaaacgcaaagtagaggaaatggaagtggatgacttctatgatggaatcaaacggctctataatgaagataatgtctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatgcaaaatcaggaaaggctgtagaaggaaatataccttagcaggctgatttggag

SEQ ID NO: 20817 - DNA, 420 bp, Homo sapiens
  misc_feature 291, 390: n = A,T,C or G
cccggattaaaaggttccctgggtgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgncacaactctgctagacctgcgaaacaacaaaatatccgaaatcaaagatggagactttaagaacctgaagaaccttcacgcattgattcttgtcaacantaaaattagcaaagttagtccttggagcat

SEQ ID NO: 20818 - DNA, 400 bp, Homo sapiens
  misc_feature 55, 391: n = A,T,C or G
tatgcaaatgtcccgtttctgcttaaacttttgctcattttactatccattggcngatcttgcttgtggcaagttactactgtggtgttctaatggtgattttctatttctctcaatccttctacatttattattggaattcttctgtaaggaagagttgtcagttctggatttatatttttaactataataagatattcaggataagtatagatttagaacttaaagatgttaaatcatgttaaaattattccaaataccaatatcaaagaaaactaagttggtaatctatctcagaaaatatatgaacttaagaaggaaaatagtatttatgatttgtagaattggttcaacttttgacttaatactgactttggactgaattcaaagntttcttgaa

SEQ ID NO: 20819 - DNA, 400 bp, Homo sapiens
  misc_feature 374, 377: n = A,T,C or G
gacagtcttacaatcttttcagtgtttacatgcctaatttactgcaagacttggaatgaaacttcttagctttgcttggtctatataatatgcttcatcttaagcaagctctacattactagtgatgttaaatttcagtaaatggaaaaattccttgagaatactatattctctttcattatccaaatacctctaattttacaatttgatcagtgttcctgcccgtgtacaacccaattgaattacattggatgtaattgccagtttttaaaatatatctttggattaaaagataaatattatgaaggaccctgtctcattgtgccatcagtatatcatggctgagactatctcagataagataatgtattagncgnctgcttcctagggaaaatgaaca

SEQ ID NO: 20820 - DNA, 440 bp, Homo sapiens
  misc_feature 13, 272: n = A,T,C or G
tctacattgaggntacctcaaataacctgcttccagcccatcagactgttcttaagcaccaaagaagtcttgctccatagagctggattagaatttcagcaaggaattttagattattttaagaaaacttagaaaatcaagggattaagttagggtgattgcatgattgtatcaaagaaaatggaagtgcctttgatcaatttattagttgtctgttcctcagagcctcagcttgcagacagtccattctctccagatgcattctgtgtggnggctttccaggttcagttccatccctgagggcaatggcacttgcaattcaaattcagggaggagagactctgattcctcctttgtaatgcaggcacaactaatgaactcattacagctggcccatatgtgcattgcctattccttggtaaagtgggcaagggagactg

SEQ ID NO: 20821 - DNA, 240 bp, Homo sapiens
  misc_feature 144, 145, 146: n = A,T,C or G
tggctttagaatgttttacaagaaaactaattcttaactgatcaagtccttgctactaaaatgcttgtgtttttcatcatgacgtcgtgtgcttctaaattaatcattttcgttgtagaaaaatggagtgaatttatattaggnnnggaaactaataatagcattgtaaatttatgagatgattttaacagaaaaaatatagaagaatatagttattttaattgtaatattactaactgt

SEQ ID NO: 20822 - DNA, 129 bp, Homo sapiens
  misc_feature 4, 12, 38: n = A,T,C or G
aggnattaaagnttgccatataaaacagctggttcatnaaggggcattgagttggagaaggttgaaaacccctgaattttcctttaaactggagctacgaggggaaaaaaaaaaaaaaaaaaaaaaaaa

SEQ ID NO: 20823 - DNA, 400 bp, Homo sapiens
  misc_feature 48, 200: n = A,T,C or G
ttcgggcttgttcgctggtggtttcggagccgagccggactgggaggntgatcacggacgtgcagctcgccatcttcgccaacatgctgggcgtgtcgctcttcttgcttgtcgttctctaccactacgtggccgtcaacaatcccaagaagcaggaatgaaagtggcgctttctccgccccagggttccaggacatagnctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaat

SEQ ID NO: 20824 - DNA, 230 bp, Homo sapiens
  misc_feature 29: n = A,T,C or G
atatcaaaatgctgttccatacccagctnatctgcagcttactaagcctctcttggcctcagctttctcactggcaaatagaaataacagaattccctgcatcacatacaggatgaaaaaaatttaatgacgtcagctacgtgactgtagtttatgagtgaaaaagtgagaccgaatattttagttactggtctgatagctctaaaaaaaaaaaaaaaaaaaaaaaaaaa

SEQ ID NO: 20825 - DNA, 500 bp, Homo sapiens
  misc_feature 23, 33, 53, 439, 467: n = A,T,C or G
caaactgaggagacctgagtttntttcccaagnaaatgaatctaaaatagccncacttcaaaaacccaggtgctgtggaaagtcacaagacttaggataaggagaaaaaaaatgtctgcaatgaaaaagattttcaggtaacagcagagtagagaaacaattaatgaagcctcggagcaatcaagccaattgtttcccaaggtccaacttcaccctgcctttgggttctatgaagtccaacaatccagaaggctaatgaccacctcgtctccccgtacgatttactgaaaaacgttgttgtgaaccaacaagaaatcctgaaagcagctaagttacatgtgaaaagtcattctaggtctcagttgtctagctgttatattcctacctctaaataaaacagaaatataacgtaaggaaaatgagaaaacatctgtgaagngcttatactactaagaatatagatatangggtaatttcatggaaattactaaactcctggt

SEQ ID NO: 20826 - DNA, 235 bp, Homo sapiens
gatgcccatagatctggacaccctgtctcctgaggagcgccgggccaggctgcggaagcgtgaggctcagcttccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgca

SEQ ID NO: 20827 - DNA, 360 bp, Homo sapiens
  misc_feature 135, 141: n = A,T,C or G
ccatatttgtagatattgtgtgaactacagtatataatgacaataattaagaggatattatgtggctgtcacatacattttgagatgatagaactatattagctttgtgtcatgtttgcataggtcattaacgtncacggnttaaataccattaaatgttatgcgattagcaatgaggaagaacccttccttaaatctgggagtttcccaccgctctttccctgatgcattatgatcctggacgcctgtctatctcaaaactcttaacacgtgcagaccaataggttctgtgttccttttaaataccaggttgtgacagtttgttgttggccagatccaccatctcattcatatttattg

SEQ ID NO: 20828 - DNA, 260 bp, Homo sapiens
gagaggctgaagcgggcagatcacctgaagttgggagtttgagaccagcctgaccaacatggagaaaccctgtctctactaaaaatacaaaattagccaggcgtggtagcacattcctgtaatcctatctacttgggatgctgaggcaggagaatcgcttgaacccaggaggcggaggttgcagtgagctgagatcgcgccactgcactccagcctaggcaacaagagtgaaactcggtctgaaaaaaaaaaaaaaaaaa

SEQ ID NO: 20829 - DNA, 400 bp, Homo sapiens
  misc_feature 18: n = A,T,C or G
agcacaactcatgccganaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtaagtgtgtggttctcttttggaatttttttcaggtgatttaataataatttaaaactactatagaaactgcagagca

SEQ ID NO: 20830 - DNA, 317 bp, Homo sapiens
taaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctctgcataagcctgcgtcagattaaaaaaaaaaaaa

SEQ ID NO: 20831 - DNA, 420 bp, Homo sapiens
atttattttaatggctgccttttcattttctcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagggatctgcttttactt

SEQ ID NO: 20832 - DNA, 410 bp, Homo sapiens
aatcttgtgtgtttaattttatgtacttaaaaacatttttcttagaagggctccaaaagcttccgcagcttgccaaggggatcctggcatgaaaaatgatgaaaagaaaacacactatccttgattttatgccagctttgcacctcctgacccagcccatataatgtaacagtgaccccctgtaagagggttgcacttctccaaataggaggaccacaggatttctcttccaaacagggacatttgagtatagatagagtgatactagcataacaagagtaaactggaacatatggccacccctctcaaatatcaggtattctggaaactgaagaattagataagaaaatgccaatgtaatttacaagaatcaacatagaaacaccctatctgtaaatatgctactgata

SEQ ID NO: 20833 - DNA, 360 bp, Homo sapiens
agcagtaacagaacatgcagcctccaccacgtccccagtaaacagccgcaggacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccatt

SEQ ID NO: 20834 - DNA, 337 bp, Homo sapiens
  misc_feature 48, 294: n = A,T,C or G
atgcaaatgttttgaaatgatatgaccaaaattttaagtaggaaagtnacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggngggtgggtattttttatactgtatgtgccaaagctttactact

SEQ ID NO: 20835 - DNA, 340 bp, Homo sapiens
ttcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttag

SEQ ID NO: 20836 - DNA, 170 bp, Homo sapiens
  misc_feature 152, 161: n = A,T,C or G
ccatcattaatggctaacaacacgtcagggacttcatgtcatgtcaaagatagctctttgcaagtgccttgattaaaccagaaaactgtcatcgtttaacccaaatatctgaatggtcatctggtaactcatgggtttttggcctcataagnatgggcccnacttctggt

SEQ ID NO: 20837 - DNA, 390 bp, Homo sapiens
  misc_feature 20, 387: n = A,T,C or G
ggactctctgtagcagattnggcaccagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagntag

SEQ ID NO: 20838 - DNA, 350 bp, Homo sapiens
  misc_feature 171, 218: n = A,T,C or G
accctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggnctaccccaagatggcacccaagtgtttggcttctggctacctaaggntaacatgtcactagagtatttttattgagagacaaacattataaaaaatctgatggcaaaagcaaaacaaaatggaaagtaggggaggtggatgtgacaacaacttccaaattggctctttggaggcgagaa

SEQ ID NO: 20839 - DNA, 269 bp, Homo sapiens
  misc_feature 208: n = A,T,C or G
ctagcacaaaggtacacagttgcccggttgtgaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagnaaacattttaaataaacaacaacattgtctactgtgaaaaaaaaaaaaaaaaaaaaaaaaa

SEQ ID NO: 20840 - DNA, 360 bp, Homo sapiens
  misc_feature 28, 30, 53, 89, 208, 232, 262: n = A,T,C or G
cttctcgatccgccatctgcggtggagntngccaccaaaatgcagattttcgngaaaacccttacggggaagaccatcaccctcgaggntgaaccctcggatacgatagaaaatgtaaaggccaagatccaggataaggaaggaattcctcctgatcagcagagactgatctttgctggcaagcagctggaagatggacgtactttgnctgactacaatattcaaaaggagnctactcttcatcttgtgttgagacttcgtnggtggtgctaagaaaaggaagaagaagtcttacaccactccccaggaagaataagcacaagagaaaagaagggttaagctggctgtccctgaaatatt

SEQ ID NO: 20841 - DNA, 240 bp, Homo sapiens
  misc_feature 47, 83, 120, 145: n = A,T,C or G
gcttagcaggagaggagagccagagaagtgacagggaagctacaggntacaacagatttgtgaactcagccaagcacagtggnggcagggcctagctgctacaaagaagacatgttttanacaaatactcatgtgtatgggcaanaaactcgaggactgtatttgtgactaattgtataacaggttatttttagtttctgttctgtggaaagtgtaaagcattccaacaaagggttttaa

SEQ ID NO: 20842 - DNA, 150 bp, Homo sapiens
  misc_feature 80, 106, 122, 147: n = A,T,C or G
cttaaatattttacaagttacatatagcatcattctaaaataagaattttttttgttttctgtctgcttttttcttatgnctcttgctgagttttatattttcagngggattttttgcttgngttagatcattattaaaaatatatncca

SEQ ID NO: 20843 - DNA, 410 bp, Homo sapiens
  misc_feature 48, 53, 297: n = A,T,C or G
ataggatgtttttctgtgtaatttagaagacagtatttctgaaaaagnatganacgaccccaaatccaaaagttatggtgcacaatgaaaatgtatgcttttaataatgctggcttctgcagtaggtgtagaccatgtttcaaataaccacagactaatcagaaactccacctgtgaaaggaacttgaaattgtgctattcctccaagcttataacaccagcaaattgggtcaataggttattcctttaaaataggactatgagcctacagaggctcactctgaagaactcagccgnggagttagttctgtactatatccatcacaacagacatgcttcatcccatagacttcttgacatagcttgaaatgagtgaacccatccttgatttatatacatatatgttctca

SEQ ID NO: 20844 - DNA, 260 bp, Homo sapiens
  misc_feature 79, 99, 111, 174, 178: n = A,T,C or G
ataatgttaacatttgaattttttttaaaagcacaatattctcataagagctaagcatttctagttcgacggaaatggnttgtttctcttctgataggnaagacaaaaggngctgatatccttctgcagtaaaagctaccttgcaagttaaggcactgttgaaaatgttatttngggnctccatttctctgaaatcagggctacttgctttatgttttagtcaacagtgtctcgcattctgattgatcatgtgggaggaa

SEQ ID NO: 20845 - DNA, 400 bp, Homo sapiens
  misc_feature 2, 24: n = A,T,C or G
cntgtggagtggatgctttggcantatggcggggagcggcgtccgccaagttacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgccggttcttccatgaaacagaagcgccaaggccaaaggatttcctatccaagttctatgttgg

SEQ ID NO: 20846 - DNA, 280 bp, Homo sapiens
gatgactttgagaccatgctcaacagcaacatcaatgaccttttgatggtgacctacctggccaacctcacacagtcacagattgcactcaatgaaaaacttgtaaacctgtgaatggaccccaagcagtacgcttgctggtctaggtattaaccccaggactcagaagtgaaggagaaatgggttttttgtggtcttgagtcacactgagatagtcagttgtgtgtgactctaataaacggagcctaccttttgtaaactaaaaaaaaaaaaaaaaaaa

SEQ ID NO: 20847 - DNA, 130 bp, Homo sapiens
tttgtaactgaaagctgaatccttccatttcttctgcacatctacttgcttaacttgtgggcaccagagtatatgaaggattgatcagagcattgtgcaaatacagtttcattaactccttcccccgctc

SEQ ID NO: 20848 - DNA, 380 bp, Homo sapiens
  misc_feature 20: n = A,T,C or G
ctgagggggcaggcggagcncgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaag

SEQ ID NO: 20849 - DNA, 440 bp, Homo sapiens
  misc_feature 26: n = A,T,C or G
aaaattagttgatttattaaaatatncactgtttgctcttagcatccaacaggaaaagaagaaaaagtaataatgtgtagtcatagtcaggcgtctgccttcaaacccccagtgctaatgcatcagactgggttcaaatcccgttaccttggaaacagcttctttggagcaatgtgtgattaaaaaaatttttttgtagaaacatgtggctatgagtgctacattaaaaaaaattcttgtaatattgaaaaactaaatcatgtaaaatttaattccagtgaacattgtattgacatgacaatgtgaaaccattgtgtaacacatcaagaactattaataattcagttattagggaggtacaaagattttatttcctaattacaaatatacagatctaacttactgggttttctttatattctttaaaaaatcgaggtctc

SEQ ID NO: 20850 - DNA, 310 bp, Homo sapiens
  misc_feature 28: n = A,T,C or G
gagcaacatgcctctcgcaaaggatctncttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacatt

SEQ ID NO: 20851 - DNA, 360 bp, Homo sapiens
  misc_feature 52, 55, 81, 172: n = A,T,C or G
gatccagctcatcaataatatgctggacaaagtcaatgagatgattattggnggnggaatggcttttaccttccttaaggngctcaacaacatggagattggcacttctctgtttgatgaagagggagccaagattgtcaaagacctaatgtccaaagctgagaagaatggngggaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgt

SEQ ID NO: 20852 - DNA, 240 bp, Homo sapiens
  misc_feature 2, 14: n = A,T,C or G
anaatgtttaatgntttttttctttatataaaccagttggtataattatacctcttttcctatttaagtttgtatgtgtatatgtgattctatagagtagaaaaatgccatcagtttgaaatgatggcacaatcttagtcacttggtttaaataaatagaaaattctaaagccttaaaattaagataatgctctttggcaaactcaaaataaaagccaaaaaaaaaaaaaaaaaaaaaaa

SEQ ID NO: 20853 - DNA, 250 bp, Homo sapiens
  misc_feature 34, 97, 116, 125, 129: n = A,T,C or G
aatgcagcataatgagtatgatctatttcttttnaataatctttgagatcccaggaaaaaaaaaatgctctgctccattgagccataatgtaaatgngtttgtttaaaaaacaggngaggcaagngagngatttattgttcctgaggaagtatatctgattttttttctcatactccaaaagctagtccctactctttaataaaaataatgggtaacctttttgtttttcactagcgaacttccatgaca

SEQ ID NO: 20854 - DNA, 410 bp, Homo sapiens
  misc_feature 50: n = A,T,C or G
ttgcttgtgcctttttatttttgtttttaatgctttgatatttcaatggnagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtg

SEQ ID NO: 20855 - DNA, 198 bp, Homo sapiens
  misc_feature 188: n = A,T,C or G
aaccgcactgtccctaggaggcagtgaaaagacaactggttctggccagtggctcacgcctgtaatcccagcactttgggaggtcgaggtgggcatatcacctgaggtcaggagtttgagaccagcctgaccaacatggtaaaacttcatctctactaaaaatacaaaaattagtcgggtgtggtggngtgcacctgc

SEQ ID NO: 20856 - DNA, 180 bp, Homo sapiens
  misc_feature 103, 107, 171, 179: n = A,T,C or G
tagcctatttacctgcaggctgagccactctcttccctttccccagcatcactccccaaggaagagccaatgttttccacccataatcctttctgccgacccntagntccctctgctcagccaagcttgttatcagctttcagggccatggttcacattagaataaaaggnagtaattnc

SEQ ID NO: 20857 - DNA, 322 bp, Homo sapiens
  misc_feature 2, 11, 21, 23, 24, 25, 26, 28, 31, 32, 33, 36, 40, 45, 46,64, 69, 89, 92, 101, 110, 111, 112, 113, 115, 125, 126,129, 130, 134, 145, 146, 147, 148, 178, 181, 182, 188, 189,190, 191, 193, 198, 219, 222, 232, 236, 237, 238, 243, 244: n = A,T,C or G
  misc_feature 250, 251, 252, 255, 256, 264, 296, 316, 317, 318: n = A,T,C or G
antctttggtntcccggctcntnnnngngtnnntgntggncggtnngcctcgaattgcggccgnatgcntttagcttgctcgagtctanagnacgactggnccgaggcgnnnnanaaaaaaaatnngannaaanttaattttttnnnnaaaaaaaaaaaaaaaaaaaaaaaaaaaatnttnntggggnnnncncccgncccccccttttttttttttcnggntttttttttncccnnngccgnntttttnnngtnntttttttncccccccccggggggggggggggacccccccncggggggggggggggggggnnngggg

SEQ ID NO: 20858 - DNA, 400 bp, Homo sapiens
  misc_feature 23, 386: n = A,T,C or G
tacaaatggtgtatattaaaganttttctatttcagatgtactttaaagagaaatattagcttaactcttttgacatctgctattgtgacacatcccattgctggcaatgtggtgcacacctccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggnattggtttagagac

SEQ ID NO: 20859 - DNA, 400 bp, Homo sapiens
  misc_feature 29, 33: n = A,T,C or G
ttgcggatggggacaaagcaaatagcaantagnatgagaaacaacagtaaacttttttctctaaaggactggttaaatcaattctgatacagccttacaatacaatagtatgcagctaaaaaataattgtatgtctttatatactaatatgtaataatcttcaggtgaaaaaggcaagccacagaaatgtgtatagcgcacttcccatttgtgtttcagaaaggagtagaatataaacacataattgcttatgtatgcctattcagaataaatgggtaacactgattacttttgggaggggaaccagtaggttgaggacaggagagggaagggtcttaacacttacacccttttgtacattttgaattttgaaccatgtgactgtattacctattcaaaa

SEQ ID NO: 20860 - DNA, 470 bp, Homo sapiens
atactttacttgaattattgctgttgtcacatatttttgcctctgtgagttcatctgatgattgagcagtagcatttgccttttgggttttttgtttgttattatagaagagatgacttctgctgattttgctttagaatggttaccttagaagaatttgggtggctcatgttgaatttcacttctgcaatagctttcattttctcataggctttataagagatgggttcagtggtatgagcagaggaagagatcccagatagtagccagttaaccaagactcattcatatagcacgtagtttatgttcctgaggcagcacttttagatcctttgtgagcaagttctatttgttcattgcttgccagagatgaacacagaatgttctgtttcattttacaagaactatcctgagtttctgtggatggaaacattacatgtaatgcagatatagtgaacactggaaagatt

SEQ ID NO: 20861 - DNA, 400 bp, Homo sapiens
  misc_feature 22, 42, 55, 64, 202, 221, 316, 326, 370: n = A,T,C or G
aaaacaatattactttgtcttnttaatcttctacttttaacnaataacaagaagnggattttgnattttaagatccagaaatacttaacacgtgaatattttgctaaaaaagcatatataactattttaaatatccatttatcttttgtatatctaagactcatcctgatttttactatcacacatgaataaagcctttggntctttctttctctaatgtngtatcatactcttctaaaacttgagtggctgtcttaaaagatataaggggaaagataatattggctgtctctatattgcttagtatttccatagncaatgatggnttaataggtaaaccaaaccctataaacctgacctcctttatggntaatactattaagcaagaatgcagtacaga

SEQ ID NO: 20862 - DNA, 470 bp, Homo sapiens
  misc_feature 4, 110, 130, 334: n = A,T,C or G
cagngctcatttcagcagcctaaatctcctccttggataatgttaatattattattattattaacaaaaaatatatatttttaaaaagttcccttaatctatgacatggnaacaatgatttccctttggngtcttaatggcatgttagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctgnaggaataaccttgctgataagaaaaaaagggacaatattggagaaactacctcttgtttaattgatctgtccaactctgagatcacttggtaactggtttcatgtgtatccaaaaatcagcatttggatttaagct

SEQ ID NO: 20863 - DNA, 280 bp, Homo sapiens
  misc_feature 30, 51, 83, 84: n = A,T,C or G
ataataaacaccctcaccactacaatcttnctaggaacaacatatgacgcnctctcccctgaactctacacaacatattttgnnaccaagaccctacttctaacctccctgttcttatgaattcgaacagcatacccccgattccgctacgaccaactcatacacctcctatgaaaaaaacttcctaccactcaccctagcattacttatatgatatgtctccatacccattacaatctccagcattccccctcaaacctaaaaaaaaaaaaaaaaaaaa

SEQ ID NO: 20864 - DNA, 380 bp, Homo sapiens
  misc_feature 25, 27, 335: n = A,T,C or G
gtaggaagaattacaatttctttanancatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgngttactaatttgtataacccatatctgtgcaatggaatataaata

SEQ ID NO: 20865 - DNA, 310 bp, Homo sapiens
  misc_feature 25: n = A,T,C or G
aacaacctttgattatagaagtttnattatagacacatgtaataattttatcactacagtataagtcttgtaggctgagtactaaacctttactcacctgcctacagccatgacatctttacaggtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaaaaaagaaatgattgcccagcagcg

SEQ ID NO: 20866 - DNA, 400 bp, Homo sapiens
  misc_feature 48, 54, 110: n = A,T,C or G
gctgcgttccaaggcatctgtgagcccgcggagtatacaccatgagcnaagctnaccctcccgagttgaaaaaatttatggacaagaagttatcattgaaattaaatggnggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttggtaaataaacttttgtaatagtcaaa

SEQ ID NO: 20867 - DNA, 500 bp, Homo sapiens
  misc_feature 202: n = A,T,C or G
ccttcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagntgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcaca

SEQ ID NO: 20868 - DNA, 324 bp, Homo sapiens
  misc_feature 42, 50: n = A,T,C or G
caagcatcaagcatttgcgtttggatggcaatcgcatctcanaaaccagncttccaccggatatgtatgaatgtctacgtgttgctaacgaagtcactcttaattaatatctgtatcctggaacaatattttatggttatgtttttctgtgtgtcagttttcatagtatccatattttattactgtgttattacttccatgaattttaaaatctgagggaaatgttttgtaaacatttatttttttttaaagaaaagatgaaaggcaggcctatttcatcacaagaacacacacatatacacgaatagacatcaaactcaatgc

SEQ ID NO: 20869 - DNA, 130 bp, Homo sapiens
  misc_feature 45: n = A,T,C or G
gaaatgaaaggatgagatgatatgatgatatgagatgagatgaancgagatgaaacgagatgaacatgatgaaatgatgagatgagacgagaagaaatgatgagatgaaatgagatgagataaaatgaga

SEQ ID NO: 20870 - DNA, 420 bp, Homo sapiens
  misc_feature 18, 54: n = A,T,C or G
gaaaacagcagcagcacncaactttacaacctgcaaatttatatctctcttagnaagcaacatcaattcatttttccttcgcaatgtaattgctttctaaacttcgaaaatttcaccttgccctgttcagaggtgtgaacagaatgatatggagatatatactattagatccataaatttatatgttaaatagtataaatcatatactgctttcagagagtctgtacccccaaatggacatgggtcctaatgaatttggaatgcccaagaaacactacattgaaactatcttctctctctcttactctctccggctctctctccctcatgtaaacgtgcgcatacaaatattcctcaccttctttgcaaatgtttctaaagttaatatatgtactatagagtccactcaagtaatataac

SEQ ID NO: 20871 - DNA, 400 bp, Homo sapiens
  misc_feature 5, 56, 361, 393: n = A,T,C or G
attgntggaaacccttccggccctgtgcgcctttctcatcagcttcttccgagggngacaggtgaaagacccctacagatctgacctctccctgacagacaaccatctctttttatattatgccgctttcaatccaacgttctcacactggaagaagagagtttctaatcagatgcaacggcccaaattcttgatctgcagcttctctgaagtttggaaaagaaaccttcctttctggagtttgcagagttcagcaatatgatagggaacaggtgctgatgggcccaagagtgacaagcatacacaactacttattatctgtagaagttttgctttgttgatctgagccttctatgaaagnttaaatatgtaacgcattcatgaatttccagngttcagt

SEQ ID NO: 20872 - DNA, 359 bp, Homo sapiens
  misc_feature 30: n = A,T,C or G
ccaaagtaatggaagtcagtattccaaagngtagaagtttagtatcatttttatagacaaagtttagggaagtttaacagaatttcaacacctctttctatataaggcttaatgcttagttacagtaatctgacattggttggggtggtcttattcttttgggaaaggtatatttaacattttatactgaggatttaatactcatggggtcttttgcaccatctagtcttaggtacaggacaataaaggatgtagttaatatataacaaatatcagtaattggaagggggaggcagtctggtgtctggtctctcctagtcatttacagaacaagaaaatgaggaagagaattaaccacc

SEQ ID NO: 20873 - DNA, 430 bp, Homo sapiens
  misc_feature 12: n = A,T,C or G
ataccaactgtnaatgaaaaccttgaaaactattacctggaggtcaatcaacttgagaagtttgacataaagagcctctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatgggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgct

SEQ ID NO: 20874 - DNA, 400 bp, Homo sapiens
  misc_feature 47, 48, 54, 256, 323: n = A,T,C or G
taggagggcccgagcaggaattcggtgtggacatagggccggtctgnntcttgnaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggngttctatttattttattggcttcctgtaagaccttcgggtcaaggcagaggcaggaaactaactggngtgagtcaaatgccccctgagtgactgcccccagcccaggccagaagacctcccttcaggtgccgggcgcaggaact

SEQ ID NO: 20875 - DNA, 310 bp, Homo sapiens
  misc_feature 57, 144, 209, 247, 272, 281, 301: n = A,T,C or G
ctttctgggctcggtacctatgttcgcggcgacatggccaaacgtaccaaggaaagncgggatcgtcggtaaatacgggacccgctatggggcctccctccggaaaatggtgaagaaaattgaaatcagccagcacgccaagtncacttgctctttctgtggtaaaaccaagatgaagagacgagctgtggggatctggcacttgtggntcctgcatgaagacagtggcttggcggggcctggacgnacaataccacttccgctgtcacggnaaagtccgncatcagaagactgaaggagntgaaagacc

SEQ ID NO: 20876 - DNA, 300 bp, Homo sapiens
  misc_feature 89, 100, 151, 173, 259: n = A,T,C or G
gagatgtctcgctccgtggacttagctgtgctcgcgctactctctctttctggcctggaggctatccagcgtactccaaagattcaggnttactcacgtnatccagcagagaatggaaagtcaaatttcctgaattgctatgtgtctgggnttcatccatccgacattgaagntgacttactgaagaatggagagagaattgaaaaagtggagcattcagacttgtctttcagcaaggactgggctttctatctcttgnactacactgaattcacccccactgaaaaagatgagtatgcc

SEQ ID NO: 20877 - DNA, 320 bp, Homo sapiens
cgacttatgaaatcatgatccagctaagggaaagcctgtaatatcactgaacagaacagagagtttagtcaaggaagaaaatgctccgcctcatgatcattctaccatgtggtttcattttgttgttgtgtttttttcacttgcaaccagtctagggggtcacccagaaagaaaaaagtcctaccaagaaccctggctactcagccaaaaccatctccaggctgtggtagtaactgaagtgaagaggacttttgtttctggtgaaccttgtatctgtcttacaaagagaaatgaaggggaaggaaaaaaggggttagcct

SEQ ID NO: 20878 - DNA, 299 bp, Homo sapiens
  misc_feature 9, 52: n = A,T,C or G
ctgccaagnatccatctaaactggagtgatgttagcagacccagcttagagntcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatga

SEQ ID NO: 20879 - DNA, 400 bp, Homo sapiens
  misc_feature 385: n = A,T,C or G
ccgtgggaatgatatccttattgtatcaaaacaatatttgtcaacctaaaattctttacctattaatatctttaaaaagtgaggtaaaataaagctattttcattgaagcaaaattgaagagaatcctgaaggatatttaggcagaagaatggtgatgccaaaatgggaattctgacatgtagaaggaataaagagcaaagaaagtggtacatgttttgtataaatcagtaatataatttattggaattaaaaaacggctaaagcacatagtaatagtaccatctaaagtgagtaggacataaatgagctactcttttaaggttcttgtttgctctaagagaaaggtctatgttaatttaccaagacatttggatgtgtaatggnttatttctaagatca

SEQ ID NO: 20880 - DNA, 430 bp, Homo sapiens
  misc_feature 45: n = A,T,C or G
gcagtcatttccctctcttcctgagacacaagaatcaaagccttngacaagctccgtacctgttcctcagccaccgtggcttggctaggcactcaggaaaggaacaagttttgcatctacaaaaaagaagtggatgataactacaatgaagaccagaagaaaagagagcaaaaccaatgtctaggaccagatataagggaagaagtcagaaaaggtcctctgtaaatatttccacagtcaaaacctgcagaaagcagtgaccacagaaacaattaaaggtcttcagcctggcaaatcttacctgctggatgtttatgtcataggacatggggggcactctgtaaagtatcagagtaaggttgtgaaaactagaaagttctgttagttaccttcttatagagatatattatgtagaactccaggagggaca

SEQ ID NO: 20881 - DNA, 210 bp, Homo sapiens
  misc_feature 92: n = A,T,C or G
aatatgtaaccaaactttgtctgtgtcaaaagaatacaactgaagatgtcattatgaaacaaaccatggtgagaattttgactagtttacangaaaagatgcatgatgaaaaactcaatgaacttagaaaaggactaaactttctacagcattagtcatcgaatacaaataaaataagtgatgctgctgtgaaatgcagttacataataa

SEQ ID NO: 20882 - DNA, 400 bp, Homo sapiens
  misc_feature 55, 277, 390: n = A,T,C or G
tataattaaaatgatttaaaataaactcatcccttcaattatttctttccaaggnccattgcaccctcattcttctaggcaaagagaggaagttatctacctcagttacattctgatatttctcctccttctagaacacttctccaagagaggagagtatggcctagcagttggtggtgtatcttaagcaaaaaggaaaaaaacaaactatatattgttcaatctgttagcactgtgttgctcagaaaaatgaaagttaatattaaatggtaaccgnaactaaatccaacttcaagtttcaattgttcatgccctccatgagataggcaagatattattgtaaggtgctttcacagggatcataaacttaagtaacttctgggtccaggnagtataagcc

SEQ ID NO: 20883 - DNA, 340 bp, Homo sapiens
tagaatgtatgactaaaaagtcactttgagatcgactttttaaaaaagttattaccttctgctgttgcaaagtgcaaaactgtgagtggaattgttttattctgacttaatgtgttagaaattagagaatacagtgggaggatttttagacattgctgctgctgttacccaaggtattttagataaaaaatttttaataaacatccctttggtatttaaagtggaacatttagcctgttcattttaatctaaagcaaaaagtaatttgggtcaaaatattggtatatttgtaaagcgccttaatatatccctttgtggaaggcactacacagtttacttt

SEQ ID NO: 20884 - DNA, 430 bp, Homo sapiens
  misc_feature 203: n = A,T,C or G
tctgacaaaaccttctgaatagcaagcttctgggctgtcttccctttcataaggaacaataacggtcttaaatccaaccaaaacaaatggatttaagatacctatctgagtgataattgctacacgtttaaaaaataaaaatgcatccatgattcttagctcataatcttcatgattaagggtagacagcacaagggtatggntgaatggctctgttataggtacatcctggcagggcccatttttactgcctccatctagttgggaagttccggaagtactagaagggagatacaagccaagaacctggcacatgctcacatcacccagagatttcaaattcatcagttaaggctacactcctacagaccctaccctcctatgcatcaagggctgaaatcactcaccgaaaaaggtttggtttggctgg

SEQ ID NO: 20885 - DNA, 194 bp, Homo sapiens
  misc_feature 50: n = A,T,C or G
ccagcaagtcttctttagctggcttataaactaacacttttactaactgnggaataggccttctgtgtgatttctgagacttggctagctatcagtaacttgttgcagcatactagccaataaagtgggatggaaaaggtagatgaggggtggggtaggtagggaaatagtgggctaggctggcagagaatgct

SEQ ID NO: 20886 - DNA, 250 bp, Homo sapiens
  misc_feature 87, 122, 149, 157, 175, 176, 209, 220: n = A,T,C or G
tatagttgctattgctctttaaaaggggcttctaattgtaatggacatgcttatcattttaatttatcattgaaattgtcttaatgntgattaagatgttttgaacaaaaattctaattcgnacttttttttcttttcttttatagtgngaagcagnatgcagatgttgaaggannctaatgcaagatattttttcttttttatagtgngaagcagtatnctggaaagtttttctaagactagtgaagaa

SEQ ID NO: 20887 - DNA, 420 bp, Homo sapiens
  misc_feature 51, 54: n = A,T,C or G
cgggatgacagagaatgaagtggaagacaggctcacgagcttcatcacagnggncaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattatttta

SEQ ID NO: 20888 - DNA, 260 bp, Homo sapiens
  misc_feature 109, 112, 139: n = A,T,C or G
agatggaaaaattggactcaggcttaaatcaatagataatggtatatttgttcagctagtccaggctaattctccagcctcattggttggtctgagatttggggaccangtncttcagatcaatggtgaaaactgtgcnggggggagctctgataaagcgcacaaggtgctcaaacaggcttttggagagaagattaccatgaccattcgtgacaggccctttgaacggacgattaccatgcataaggatatgcactgga

SEQ ID NO: 20889 - DNA, 160 bp, Homo sapiens
  misc_feature 24: n = A,T,C or G
ccaaaatgaaaggaacaggtatgnttcctgtccttttgaagcttgactgctagtgagagaatccaataaccaagaaaaagtaaggatgtaaataaaataagtatatgcctagcactgggaagaaagtataataaaaaaaaaaaaaaaaaaaaaaaaaaaa

SEQ ID NO: 20890 - DNA, 248 bp, Homo sapiens
gcgccttttcgaaagccagaggctcgagttacccctcttaccaccgtcatggcagtcccaggttgcaacaaggacagtgtcagagcaggctgtaaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacagg

SEQ ID NO: 20891 - DNA, 450 bp, Homo sapiens
  misc_feature 19, 129, 229, 311, 319, 357, 364, 369, 427, 439, 443: n = A,T,C or G
aaaaaatctttgcttgttnatttctgagaaagaactgtatttagtgattattttagatagtgatattatagcattcatctgtgtgtaaattatttcatatagggaagagttctgatctgtacctatggntcttattgaaaacaacattggatgtgcatttctgtgatgttatgaatacatttctactttattttgaaacatttgccaaactaaatactgtaacactgtntaacatttaaaaatgttaaagaactgcttagtattagaagcagatcatttcccaaaattctaagagcagcagcatatgttgntgcttgtntaaagcctagcgataatttttagactaacttccatggngccctgntggcnttagcactaccattgtaccctgctgtataataaacaatcttagacatttatcaactgntgatacaaatgntagnccctaac

SEQ ID NO: 20892 - DNA, 330 bp, Homo sapiens
  misc_feature 3, 28, 55, 57: n = A,T,C or G
atncagtatcttggactggttttaaacnttgctttgtaccggatctgctgaagcntntgtccagctggtatcctgtgaaagtttgttattttctgagtagacattcttatagagtattgtctttaaaatcagattgtctcttctatattgaaagcatttttatgttttctaatttaaaaattaatattttcttatagatattgtgcaataaagctgaagtagaatgtgtggtttttgcaaatgctttaacagctgataaaaattttacatttgtaaaattaatatattgtactggtacaaaatagttttaaattatattttaaaaagctt

SEQ ID NO: 20893 - DNA, 371 bp, Homo sapiens
  misc_feature 18, 39, 40, 50: n = A,T,C or G
tctggtggccacagcttncaagcctagagccctccggannccatccaggngcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttaggatttgtctagcaggctttccagtttttaccagaaaacccctataaattaaaaattttttacttaaatttaagaattaaaaaatacaaaaaagaaaaaatgaaaataaaggaataaggaagttaccct

SEQ ID NO: 20894 - DNA, 350 bp, Homo sapiens
  misc_feature 147, 341, 349: n = A,T,C or G
atgtgagagttcagcttatttcatcttgcaccgaggatttctcttcctgttatatagccttttgcttccccctttcctcattccagctgataccccgagaaaaaactcagccataacatgattatgttgcttaagtaagtccatggnctttttcagtctcttaagttcctgtctacacagttttttcacaggatgcacttgatatgggtgtgtgttacaggtttattcatatcagctactgaaatacatgctgtgtgtacatataataggtacattgtctctgcttattgaacttataaaataataataaacagctgaataaggaaagtaatggaaagtgntgttaagna

SEQ ID NO: 20895 - DNA, 290 bp, Homo sapiens
  misc_feature 92, 99, 101, 143, 156, 221, 256, 278: n = A,T,C or G
aaactgtagcagtattccaggggagagggagatgtgacttggattagaggaaactggaagaaatgaatggattaaagatacattttgaaggnaaaatgngnctaacctgctgataaattagatgaaagacttgagagggaggnaaatataaagggntattcctaagcacctgacttgaaaaactgcttggccaaaagtctttttttctgagctgaggaagncaggaggaaatttggaggggggaatgatcaagagntcaggtttagaaatattaaggntgataaataaag

SEQ ID NO: 20896 - DNA, 400 bp, Homo sapiens
gagtttagtgatccaccttctcctagtgttcttccaaagcctcctagtcactggatgggaagcactgttgaaaattccaaccaaaacagggagctgatggcagtacacttaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgc

SEQ ID NO: 20897 - DNA, 374 bp, Homo sapiens
gaataatgtgctatgttgcatattattagataatttacttgaaaatatcttatacatagaaaagatgtattgtggttattatttgagaaacttagaggttaattgattgcatttttcttttacaatgaagtgttttggttaaagattataaggtgtcatcaaacagtaatggaaggatattgtcattttaactggataaacaacctgcatcactcaatcattgcaagcacaacagactcatctcacagtgttgatataagtgtgaaatattacactgtaattttaaaccactgaagattatgttttatagtcatgtaacataaattacgttttcctattatacaagaaatttttaaacgaattttataaaactg

SEQ ID NO: 20898 - DNA, 360 bp, Homo sapiens
  misc_feature 26, 56, 171, 194, 199, 212, 229, 348: n = A,T,C or G
ttcgagaagcccttgacctgtttcanttgaaaattacaaaaacttttagaattganttcttttgcccatgttatttatataatcaaactatcaactctagcctgggaattcactactgtggagtcgaggatgaaatgagaggatgcttttgaaaacactttaacatgatgntggtatttattttatatatttgntttgnatatttcaggtgntatgagcccatccttgntggggaggggctataaatactaatctttaatgaaacataggtgtaataaggcagacattaagaaaaatataaataccaacacttgaaaaaagctcgggattatagatttttaaaaaggncttcaataaatt

SEQ ID NO: 20899 - DNA, 250 bp, Homo sapiens
  misc_feature 22, 216: n = A,T,C or G
gatgaaaaattataaccaagcntaatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtaagaggcgacaaacctaccgagcctggngatagctggttgtccaagatagaatcttagttca

SEQ ID NO: 20900 - DNA, 380 bp, Homo sapiens
  misc_feature 41, 114: n = A,T,C or G
atccccgtaggagcctctctccctactgctgctacacaagnaccctgagactgacctgcgggacgaaaccatgaagagcctgatccttcttgccatcctggccgccttagcggnagtaactttgtgttatgaatcgcatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaat

SEQ ID NO: 20901 - DNA, 270 bp, Homo sapiens
  misc_feature 11, 49, 159: n = A,T,C or G
cttaaaagatnctctggcagcattgtggaggatggaattcaggagaggnagtcaaaggcaggagagccagctagagatcattacagtgtttgggggaagaagctggcttgaggtggggatggcaatggaaagaaggagacagattataccctatgtggntcttaaacttccccagggttgtgagccactcccatcatcagatgaaaacctttgacctctacagagagaagagtgcatatgggcatgaaaaaaaaaaaaaaaaaaaaaaaa

SEQ ID NO: 20902 - DNA, 193 bp, Homo sapiens
  misc_feature 21, 50: n = A,T,C or G
gaagctgacagcattcgggcntagatgtctcgctccgtggccttagctgngctcgcgctactctctctttctggcctggaggctatccagcgtactccaaagattcaggtttactcacgtcatccagcagagaatggaaagtcaaatttcctgaattgctatgtgtctgggtttcatccatccgacattgaag

SEQ ID NO: 20903 - DNA, 440 bp, Homo sapiens
  misc_feature 20: n = A,T,C or G
tgaggcagccagcgcagggntttctgctgagggggcaggcggagcttgaggaaaccgcagataagtttttttctctttgaaagatagagattaatacagctacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatctt

SEQ ID NO: 20904 - DNA, 450 bp, Homo sapiens
  misc_feature 7, 111, 385: n = A,T,C or G
cacaagnaacacacacatatacacgaatagacatcaaactcaatgctttatttgtaaatttagtgtttttttatttctactgtcaaatgatgtgcaaaaccttttactggntgcatggaaatcagccaagttttataatccttaaatcttaatgttcctcaaagcttggattaaatacatatggatgttacctctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttttcactctaagtcatgtatgnttctctttgattatttgcatgttatgtttaataagctactagcaaaataaaacatagcaaatgac

SEQ ID NO: 20905 - DNA, 420 bp, Homo sapiens
  misc_feature 31, 324: n = A,T,C or G
agtacatgactcaataaataatgtcaggtanggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagnggtccaggtggaagtgattttatcttctgctctttcttcttccacacatgcaagggatgaattgtaaaagcaacatcagcttgaccagtataaaat

SEQ ID NO: 20906 - DNA, 500 bp, Homo sapiens
  misc_feature 8, 59: n = A,T,C or G
attgcagnataatttttagcttagggcctggtggctaggtcggttctctcctttccagncggagacctctgctgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgactaaatcaataaataactgaaa

SEQ ID NO: 20907 - DNA, 400 bp, Homo sapiens
acttcctccttatgtgagttagtataaagtctacagtgatcaaggcactgtgttattggcatagggcatagggctaggcaaatagatcattaaaatagaggagtgatttcagaaacaggctcatatatataatgtcatgtgatctttacaaaggcaccaaaacaactacatggggaaaggaaagtctttccacaaaaggaaatggaacagcaattagtgaatgtatgggaagaaaaggaaacttgtcccctacctacaccttaacacaaaaactaattcaaaattaaggagtttaagacaaaacctaaaactataaagatcttagaggaaaacgcaagagaagatctctctaatctcgggggtaggtaaatatttcttagagaagacacataaagcatta

SEQ ID NO: 20908 - DNA, 440 bp, Homo sapiens
  misc_feature 23, 30: n = A,T,C or G
tcctgaacttcctgaagatggcnttgatgngcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaacagcaaattcacctacacagttctggaggatggttgcacgaaacacactggggaatggagcaaaacagtctttgaatattgaacacgcaaggctgtgagactacctattgtagatattgcaccctatgacattggtggtcctgatcaagaatttgatgtggacgttggccctgtttgctttttataaaccaaactctatctgaaatcccaacaaaaaaaatttaactccatatgtggtcctcttgttctaa

SEQ ID NO: 20909 - DNA, 460 bp, Homo sapiens
  misc_feature 4, 28: n = A,T,C or G
aaanatgagctaccgctgatttggtaanggtgttctgcatccactgatagaccttgaacaatttactgttgttcttttggtttgcactaggatgcaaaagaaagaaatccctgcgctttctgtctgtctttgtggcggcccagattgaattggggaatacatctttagcctggaaatgtaggctgcatgttaatggtaatgtaacttttgcagtgtaatgtttgaaaaatattaatgtagtttttgcttttacagtaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcattt

SEQ ID NO: 20910 - DNA, 400 bp, Homo sapiens
  misc_feature 22, 355: n = A,T,C or G
ggatgacttgcttgggtaaggncttgaagacagttcctgtcataccttttaaaggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgnctccaattttaataaatttttgcaatccaaaaaaaaaaaaaaaaa

SEQ ID NO: 20911 - DNA, 350 bp, Homo sapiens
  misc_feature 12, 202, 309, 324: n = A,T,C or G
aattctttattngctgtactcactaacatttcccatgtgcttataattttcataattacaattttagtggaaaagtaatttcttttaaaaattttatacaattttatgtaattagtgtgagcttcaaacagtatggaagtgtctaacacaaaacatgaaggatccctcccctcaccttcaggaaggtaaccttccagagggnttaatttgtattattccagatttttttttcttgcttttgcatgtgtcaaaattggtttattagatattgaatagataaacagagcatgtgtaaatcacacataaggnagaaagattcatggnacaatgaacacccatgtacctaatac

SEQ ID NO: 20912 - DNA, 360 bp, Homo sapiens
  misc_feature 5, 6, 55, 56, 58, 189: n = A,T,C or G
aacgnnttggtgctataagctgcttcagatataaaattggtttatctataatggnngntcatttaatagcttctaaaaggcctttttgttatacagtgctttttttctagttttatggacttgattactgtaataatgtcttgtttttagccatgtaactacaaacagatattctcttgatgtcttggnaaatttgcatttgatatatcacttgatgagattttgttgttatgtaatattctttggctacgcatctgtccagcatcttattaaccataatactgtgatcattatttggaaatatgtcctatggaaagaataaaagcatgtaccttcacagctagcatgttcacagatttg

SEQ ID NO: 20913 - DNA, 450 bp, Homo sapiens
  misc_feature 317, 320, 355, 376: n = A,T,C or G
tccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagntgntattaagagcatattcctaaaccatacacttttgnttcaataaagttttattttgntgagatgaataaaataacaaagttataagctgcataagacaaaagttcaattgttcaaaaaaaatttactggga

SEQ ID NO: 20914 - DNA, 139 bp, Homo sapiens
  misc_feature 24, 25: n = A,T,C or G
ctgtccttagtactgatgagcaanngaggagtcaactaatgaagaaatgaataataaattttgacactgaaaaacattttattaataaagaatattgacatgagtaaaaaaaaaaaaaaaaaaaaaaaaaaaaaaaaaa

SEQ ID NO: 20915 - DNA, 400 bp, Homo sapiens
  misc_feature 16, 30, 53, 367, 381: n = A,T,C or G
cgcacggtagcgcagnaagcttctcaatgnccagcgccagctgcagccccggnggcgcactcgcctcacctgagcctgggaggaaaattcttccaaggatgatctcccactcagagctgaggaagcttttctactcagcagatgctgtgtgttttgatgttgacagcacggtcatcagtgaagaaggaatcggatgctttcattggctttggaggaaatgtgatcaggcaacaagtcaaggataacgccaaatggtatatcactgattttgtagagctgctgggagaaccggaagaataacatccattgtcatacagctccaaacaacttcagatgaatttttacaagttacacagattgatactgnttgcttacaattgnctattacaacttgctatag

SEQ ID NO: 20916 - DNA, 290 bp, Homo sapiens
  misc_feature 6, 31, 207: n = A,T,C or G
acagcntgttgatttggtcctaaaaagtaanaaaaggactaacaagcttcactttaatggagtaatggtacttttattctttcttgatagaaacctgcttacatttaaccaagcttctattatgcctttttctaacacagactttcttcactgtctttcatttaaaaagaaattaatgctcttaagatgtatattttacgtagtgcngacaggacccactctttcattgaaaggtgatgaaaatcaaataaagaatctcttcacatgaaaaaaaaaaaaaaaaaaaaaaa

SEQ ID NO: 20917 - DNA, 370 bp, Homo sapiens
  misc_feature 29, 133: n = A,T,C or G
tgtgggggctttgttctccacagggtcangtaagagatggccttcttggctgccacaatcagaaatcacgcaggcattttgggtaggcggcctccagttttcctttgagtcgcgaacgctgtgcgtttgtcangaatgaagtatacaagtcaatgtttttccccctttttatataataattatataacttatgcatttatacactacgagttgatctcggccagccaaagacacacgacaaaagagacaaccgatataatgtggccttgaattttaactctgtatgcttaatgtttacaatatgaagttattagttcttagaatgcagaatgtatgtaataaaataagcttggcctagcatggcaaatca

SEQ ID NO: 20918 - DNA, 440 bp, Homo sapiens
  misc_feature 203: n = A,T,C or G
ttctcaccaatgggattaagagcataggtgcagaatacaaactgcaattgatttttaattttttatttaaagtcaaattattacctttaaaaaaaggtcagcctccatttggattctgccatagaggcttacacagtctttctgcattcaaacctatcacattgacatgattatatttttaaaaaattaagtttagtttaagncaaaatctaaccttaggcactgtctctaagatgaaaaagtatttttaaaggaaaatttagattcctcattctcttataaaatcccagttccctcaaatttaaaatactaactgcttaggcagtacttaacatgtcataaggtgggagttacttcattttataacaatgtctaactcttagtgacttatcagacagaagtaaaccttgcacaagctatttgatagcttttatttcctg

SEQ ID NO: 20919 - DNA, 380 bp, Homo sapiens
  misc_feature 9: n = A,T,C or G
ctgtgccanaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcgggatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggccttcgattaacatgctgaggattggagagccat

SEQ ID NO: 20920 - DNA, 390 bp, Homo sapiens
  misc_feature 153: n = A,T,C or G
ttcgcttttcctccgcaaccacgtctgacaaacccgatatggctgagatcgagaaattcgataagtcgaaactgaagaagacagagacgcaagagaaaaatccactgccttccaaagaaacgattgaacaggagaagcaagcaggcgaatcgnaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggagggaaggaaagaacttgcatgttggtgaaggaagaag

SEQ ID NO: 20921 - DNA, 400 bp, Homo sapiens
  misc_feature 26: n = A,T,C or G
ccaaagaggctgctgctttgtttatnactttatatagtttctgattataaaaataatacagtgctccaaagtagatgaagcaaaatctgatagaaatgaaaggcacaatcaacaaattacaattatagctggaaatttcaatacttctttctcagtaattcttaaataggaaatcaacaaggatataaaagattctaacactatcaaccaatttgacctgattgacatctgtagaatattccttgcattaacagcataaaatacgttatttgcaagtacatatgagacatttaccaaggtacaacaggtgctaggccataaagcaggtcttaataacttaaggattgaaatcatacagagtatattctctaaccactatgaaattaaattagaaatcagt

SEQ ID NO: 20922 - DNA, 410 bp, Homo sapiens
  misc_feature 6, 25, 208, 210, 211, 354: n = A,T,C or G
aaatanaagaagatctaaataaatnaagtaattataccatgttcatgattaggactcagctcaatgtggtaagatgtcaactctccccagttgacatataggtttcaagaaattcctatcaggatttctttttgtagatgtagacaaaattactctaaaatttatatggaaaggctaaagaactaaaataacgtttttaaaaagcagngnntgaaaatgaagcataaaatgggaaaaagtagcctcttacctcaagcttttatatagctacagtagtcaaagctatgtggtattagattagtagaagagaatagaggactcagaagtagaaccacacaaatattcccaagtggnttttcatgaaagtgaaaaagcaatttaatggaagaaaggttgcattttcaacaaat

SEQ ID NO: 20923 - DNA, 337 bp, Homo sapiens
  misc_feature 149, 155, 203, 236: n = A,T,C or G
tcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcngaaagntgcatagccacaacgaagatctagttggatatagtttttgatttaagntgcagttatagccaatttaggctaatgcttggntttggagcttttatacacaacgtttttgttaggcatcacagttttgcaacctctgctccaaagagaaaaatagaatgagttttctttcttttttttttttt

SEQ ID NO: 20924 - DNA, 400 bp, Homo sapiens
  misc_feature 24, 25, 284, 375: n = A,T,C or G
cagctgatcttaacaaaattcgtnncagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgngttgattcccttccttgctatttttattcagtagatttttgtttggcatcatgttgaagcaccgaaagataaatgatttttaaaaggctgnagagtccaaaggaatattcttttac

SEQ ID NO: 20925 - DNA, 360 bp, Homo sapiens
  misc_feature 72, 75, 205, 230: n = A,T,C or G
agcacttcattcctgttttagttcgtgtaaattctctgagaatgttctggagatagataactcatttacagnggnttctattaactaattaaagtacccatgattttttccttttctgctcagggatgatggagatttccttttaccttctgaggtagaattttttaatggggaaaataggccttttaaatattattgccagggnctgcaatataacttaaaattcctgnacatactgcaaatatttctttaaattgcacaggaaaatgagcgaactttttatttcttaatatctttggcaaaaaactttaaccagtaagcaattttataaccctgagggatcatcaaagatactatcct

SEQ ID NO: 20926 - DNA, 360 bp, Homo sapiens
  misc_feature 233, 258, 308: n = A,T,C or G
aattttttggtgtctgaaatttacaaaagaatgaaattgaaattgtaaaacactaaatgctttgggtttattttgaagtaatctgttactttaaaatgtcaacattaggaagccataaaacaagatattatgaaacccagtattataaatgttatctacatctaaagtattttaaaataacttattggcagctttattctttttttccttacaagatttagaatctttttggntatatgtctatttttcaattttgtnatatttttaatttaagtggccaatgtggttatgaacaagatttgtatggncagcttctgttctttcctaaaacttcagataaatatcattttagctataacc

SEQ ID NO: 20927 - DNA, 250 bp, Homo sapiens
  misc_feature 116, 125, 182: n = A,T,C or G
caagtaaaccgctagcttgttgcaccgtggaggccacaggagcagaaacatggaatgccagacgctggggatgctggtacaagttgtgggactgcatgctactgtctagagcttgnctcaatggntctagaacttcatcgccctctgatcgccgatcacctctgagacccaccttgctcatnaacaaaatgcccatgttgggcctctgccctggacctgtgacattctggactatttctgtggttatttg

SEQ ID NO: 20928 - DNA, 440 bp, Homo sapiens
  misc_feature 6, 30, 31: n = A,T,C or G
ataaantagttatcttttatttaaacttannttatgcctgggttgtaaaacagaaattcactagtttcatttcttcatccattggctttataaatttgtaatcttatatggataaagttttgattcataggtattataatatttcttcatttcatagccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccggtaagagattttaaaaataattttgaaggcttttcacttaaacaattattgattttt

SEQ ID NO: 20929 - DNA, 389 bp, Homo sapiens
  misc_feature 91, 310: n = A,T,C or G
atgccaaactactttaaagtaagtagcatgcttgatgttacttgtcccttaaatatttcaacacatgcctccaaaaacaacatttttaggntaatttcatactgatgaagattcatttcttgaaatcgaagagtccacctcttatgtagcccagcatggaaacatttcattctaagcaaatcatataattcaatgaattgggagtagtcttatactttacaagatcattttgtttccagcagctttcattactgaagtttaaaaattaaaatcatttttctctgttcactttacatgtttttctggtggngtaaaatgaagtatgtctgccatttcctaagtgagtatccatcagttaatttatggactggactctggggaaaaaaaaa

SEQ ID NO: 20930 - DNA, 400 bp, Homo sapiens
  misc_feature 29, 57, 335: n = A,T,C or G
cagcacctgggggtgaacccagtcccgangcactactggccagtcctacatccagtnttctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttgagccctttgctctggaggaagttctccagcttcagctcaactcacagcttctccaagcatcaccctgggagnttcctgagggttttctcataaatggggggctgcacactgcctgttctgcttcgaagtattcaata

SEQ ID NO: 20931 - DNA, 490 bp, Homo sapiens
  misc_feature 259: n = A,T,C or G
taagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgnttttagtaaagtgcctgtgttcattgtggacaaagttattattttgcaacatctaagctttacgaatggggtgacaacttatgataaaaactagagctagtgaattagcctatttgtaaataccttttgttataattgataggatacatcttggacatgggaattgttaagccacctctgagcagtgtatgtcaggaccttggtcattaaggttggcaagcagaggggcag

SEQ ID NO: 20932 - DNA, 227 bp, Homo sapiens
  misc_feature 14: n = A,T,C or G
aaataaaactaagnctctttgagaactgcttctaagatgccagcatatactgaagtcttttctgtcaccaaatttgtacctctaagtacatatgtagatattgttttctgtaaataacctatttttttctctattctctgcaatttgtttaaagaataaatgcagttttaagaattgtttttgaatttaaataaagttacttgaatttcaaaaaaaaaaaaaaaaaa

SEQ ID NO: 20933 - DNA, 490 bp, Homo sapiens
  misc_feature 4, 369: n = A,T,C or G
agtnggtccaagtgtcccggcctgaggtgtcggccggatccctccttctcccggcgcctcaagcggaagaccgttcctcaagaattttgtacccaaggcccaaaagtttgtcacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaangggattgacacccttctgttttatggaattgctgctgatcatttttttctttaaaacttggatagattccaaaagttacagtacctttgtggcttcattgaatatttatgaagataaatgt

SEQ ID NO: 20934 - DNA, 420 bp, Homo sapiens
  misc_feature 7, 58, 368: n = A,T,C or G
agccagnaggagtaccatgagggttgctatttgttgtttttaacaactaatcgagagngagtgaacaactatttataaactagatctcctatttttcagaatgctcttctacgtataaatatgaaatgataaagatgtcaaatatctcagaggctatagctgggaacccgactgtgaaagtatgtgatatctgaacacatactagaaagctctgcatgtgtgttgtccttcggcataattcggaagggaaaacagtcgatcaagggatgtattggaacatgtcggagtagaaattgttcctgatgtgccagaacttcgaccctttctctgagagagatgatcgtgcctataaatagtaggaccaatgntgtgattaacatcatcaggcttggaatgaattctctctaaaaataaaatgat

SEQ ID NO: 20935 - DNA, 400 bp, Homo sapiens
  misc_feature 27, 28, 49, 164, 173, 234, 249, 251, 261, 348: n = A,T,C or G
ttcttggagatgaagtctgtcacccanntctggagttcagtggcctgantgatcactgcagcctcgacctccagctcacataatcctcctgcttcagcctcctgagtagctgggactacgggtgtgtgccaccatgcctggctttttaaaaaaaaaaattttgnggagttggngtctcgctatgttgcccaagctgatgtcaaacttctggattcaagcacttctgcccaaagngctaggattataggngngagccactgngcccaagctagtgactgtttttgaaaaaaagaagcacattaccctcccttgttaatcacttatgtacaaaaatgcatgttttgctgntgatctgttttaactctttctacataaataacacatttgtacatgtatatgt

SEQ ID NO: 20936 - DNA, 400 bp, Homo sapiens
  misc_feature 17, 207, 343, 367, 378, 391: n = A,T,C or G
aaacttaaaaaattatnaaaaggaattttggtatcatcttcagagaaaaaataaagcaagaaatactaacatcaaaaggacgggtatgatgatgcgataataataaacatctgcgtttgtctcttcactaagagtaaactgggaaattgtaggccaaagtccagttgaactttctaagtctgtgatccccgtgctgactgtggaagngtatttataccaagatggagatcttgacttcttgaatatatctggactggtaaaatcttgatgaggctcataaaatgagtttgggaattgtgtatagctgattttttgtgggaaactgtttacttcattcaaaggntcttgagactcttgatatttctgncttctccttgngctttcctatggnaaaaataca

SEQ ID NO: 20937 - DNA, 400 bp, Homo sapiens
  misc_feature 24, 117: n = A,T,C or G
attcctgaagctgacagcattcgngccgaggatgtctcgctccgggggcttagctgtgctcgcgctactctctctttctggcctggaggctatccagcgtactccaaagattcaggnttactcacgtcatccagcagagaatggaaagtcaaatttcctgaattgctatgtgtctgggtttcatccatccgacattgaaggtgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatca

SEQ ID NO: 20938 - DNA, 460 bp, Homo sapiens
  misc_feature 405: n = A,T,C or G
ttcacatccaatttcaatggccgtttttactatctgatccaccccaccaaactgacctatgatgaagcggtgcaagcttgtctcagtgatggtgctcagattgcaaaagtgggccagatatttgctgcctggaaaattctcggatatgaccgctgtgatgcgggcttggttggcggatggcagcgtccgctaccccatctctaggccaagaaggcgctgcagtcctactgaggctgcagtgcgcttcgtgggtttcccagataaaaagcataagctgtatggtgtctactgcttcagagcatacaactgaatgtgcccttagagcgcatcagttttaaagtcattaagaacatgtgaaaggtgtttttttttccaatatgaactcatgcaagttaccaaaactgngataacccttttttacttactgtaaagagtcattttcataaagatcaattcattg

SEQ ID NO: 20939 - DNA, 450 bp, Homo sapiens
  misc_feature 5, 29: n = A,T,C or G
atgancagagtgtgaaatacccggtacantagttcctatttactgattgagtgaaagaatatgggtaattcagagttgaatctgatttcattaggaagagtacacttttcaggaagcctttactacctaagaagaatgcagccttcagaggctcggaaggatttgtcacaagtataactaagtgaatttaaatacttaggaattaatttaacgccaggcacacgaaacttattcaaggaaaattataaaactctaatgggagaaataatatgaataaatgcatagtgtatactttgctttaatttaggaagactgaatatagtaatgattacaattctccctaaatttaatgtgtagacataatgtactccaattgtagtcaccatgggatactttataaaatttgtcaaatttatagtaaaatttatctggaagaataagtaagtgggc

SEQ ID NO: 20940 - DNA, 440 bp, Homo sapiens
  misc_feature 23, 24, 26: n = A,T,C or G
cagaaggatttgtaaaccccggnntngaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttatttttttttcttttccctcaatccttttttatttt

SEQ ID NO: 20941 - DNA, 440 bp, Homo sapiens
  misc_feature 49, 341, 346, 401: n = A,T,C or G
ctgaatttttaattttatttaattgtaattaaattaaactgggataagnagctcccatatagaatagcacagtactgtagagcgtgtgtgtgcgtgtatgcatgtgttcacatgcatatacatgctgagtgtggagtggggtggcagaagtaaaggagaggagtggtagaccattattttggatgatgggatgccatttatactttactgctcaggatgtacatgaagtggaatttaacccactccaagaaccattttctacttttgctttttttctgcattacattatatattatgatagtcactatgtgtactagacaacatattggttatattattgnatggnttttctaattaacctatagttttaaagctacatatccccagtatattaagcatgntgcaccagttaaattttatcatcttacccatccttaaaa

SEQ ID NO: 20942 - DNA, 460 bp, Homo sapiens
  misc_feature 27, 200, 430: n = A,T,C or G
ttggtgatacagagaatcaaatttttnttaattcttttaattgggtattactgaacgtgaaaaagtaatgtttgtattgaaatcttgagtctggccatgtttctattttaaattcataaagaattctaacaagaggaattccaagaatgtcataaatggatgtttctccatggatgaaggaactgttttattcacttgcngataattcagcctaatccagtttgacatcatatagataagtagttgaattatggatttaaaatacatatcattttctaactccaaaggtaatacttatttaaatggttttgaaaatatagaaaggcacaatttctttttaaatctggattctccaccaccactcaatctgtctatcatctatctctccattcattcttccatttgtttatatctgttaatctttgtatgngttcatgtatagcttttacatgattggaat

SEQ ID NO: 20943 - DNA, 390 bp, Homo sapiens
aagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagt

SEQ ID NO: 20944 - DNA, 500 bp, Homo sapiens
  misc_feature 401, 490: n = A,T,C or G
atactaatggaacattttggcaaatgtatattcagatgtacactaatatattatctattaaaatattagaatttgtgttgtggcttttaatgccagaagaaaagttaccagaatttataatttatagtaattttttgatctttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacataggatatgacatttgctgcctcagtgtagcaattggaaatatttataagttatatgaaagcctgntttgggctgaaagaatgatttagaaaactagtgataccaaataagatattcagttcaataattattttcaatgatgaatcacttagggngaaagacttg

SEQ ID NO: 20945 - DNA, 480 bp, Homo sapiens
  misc_feature 27, 48, 272, 353: n = A,T,C or G
atccctgaagctgacagcattcgggcngaggatgtctcgctccgtggncttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggnctttctatctcttgtactacactgaattcacccccactgaaaaagatgagtatgcctgccgtgtgaaccatgtgactttgncacagcccaagatagttaagtgggatcgagacatgtaagcagcatcatgggaggtttgaagatgccgcatttggattggatgaattccaaattctgcttgcttgcttttttaatattgatatgctta

SEQ ID NO: 20946 - DNA, 400 bp, Homo sapiens
  misc_feature 372: n = A,T,C or G
ttgcatggcagcaggagagagagagcaagcaagggggaaatgccacactttaaaaccatcggctctcaatgagaactcactatcatgagaacagcatggggaaaaccacccccatgatccaatcacctcccaccaggtccttccctcaacacatggagattacaatttgagatgacatttgtgtggggacagagccaaaacaaatcaatggtgttttattttaaaatattaaccaatacctaagtatcactagatatttaagaaatataacacaaaaggaaacgaccaaggtaaagaaaagtagaaagctgaaatcaggaagaatcacaaataacacagggagctgaaaaccaaccaaccaaagaaaaaggnacttcttgaattataatttatatcttta

SEQ ID NO: 20947 - DNA, 420 bp, Homo sapiens
  misc_feature 18: n = A,T,C or G
atgttccactccaattcncaaatacaaaatttgtgatacctgggtatgtactcagtgctaaaagctctaaaggatttggagaataagatagttactcttctgtgggacctactctctgggaagggaggtatctattcacaagcaactatagtgcaaggcaacatgtggtattatatatgtgttacaggagaacctgatgggtaaggggagcataaattggttcagacgaggatgatttgaaaagatatacctggggtactacaggggaaaaatatacataagttaaacttcctgcaaattcctccaaggtgaccttgaacaagtcatttaattcttcctctgtcagattcaccatctgcaaaaaaaggaatattggccttaaagatttttcactgggcaaagaaccactcaatccatctc

SEQ ID NO: 20948 - DNA, 230 bp, Homo sapiens
acacaggatccggagctggtgctgataacagcggaaatcccccgtctacctctctccttggtcctggaacagcgctactgatcaccaagtagccacaaaatataataaaccctcagcacttgctcagtagttttgtgaaagtctcaagtataagagacacaaacaaaaaattctttttcgtgaagaactccaaaaataaaattctctaaaaaaaaaaaaaaaaaaaaaaa

SEQ ID NO: 20949 - DNA, 400 bp, Homo sapiens
ggtttgaagatgccgcatttggattggatgaattccaaattctgcttgcttgctttttaatattgatatgcttatacacttacactttatgcacaaaatgtagggttataataatgttaacatggacatgatcttcttcataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggatta

SEQ ID NO: 20950 - DNA, 325 bp, Homo sapiens
  misc_feature 2: n = A,T,C or G
cncagtgagccatgattgcactactgcagtgcaacctgggtgacagagtgagaccctgactcagaaagaaccacttgcccacagtccagacagatggattgtaggtgggttttctggagattagtagatactgtatagagttgtatacataaaattgtgtcagtagtacaaagtgtatataggctgtttactcttatatttcctactgtaagatacagatttatggtactgatacctttaaattatatcatattttgaaaatgtaattactgatattcaaaataaattaaaggacttaaaagcaaaaaaaaaaaaaaaaaaaaaa

SEQ ID NO: 20951 - DNA, 470 bp, Homo sapiens
gaagattctgtggtctcactcttaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctg

SEQ ID NO: 20952 - DNA, 361 bp, Homo sapiens
  misc_feature 26, 80: n = A,T,C or G
actgcgataggaatcatgtctggtcncggcaaaggcggaaaaggcttggggaagggtggtgctaagcgccatcgtaaggngctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctgaaacgtcaggggcgcacctctgtatggcttcggcggctgaatctaagaatacgcggtctcctaaaaaaaaaaa

SEQ ID NO: 20953 - DNA, 400 bp, Homo sapiens
  misc_feature 48, 111: n = A,T,C or G
aacacggtgactgtctctccagatggatccctctgtgcttctggaggntaggatggccaggccatgttatgggatctcaacgaaggcaaacacctttacacgctagatggnggggacatcatcaacgccctgtgcttcagccctaaccgctactggctgtgtgctgctacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtggccattggcacacgctagaagtttatggcagagctttacaaataaaaaa

SEQ ID NO: 20954 - DNA, 430 bp, Homo sapiens
  misc_feature 48, 53: n = A,T,C or G
gcgttatatttatttttcttgcctggctgctctgctaggattcgcggnacagngttgacgaagaatggcaaggataggcattcttgtcttgttcctggttaagggggaagagactttttttaaacatgtatgttgcgttatatgtactgatatatttctgtaactgtacaaaactcacttctgcataatggaatttcttaaagattggaaatatttttgcatatgaatagtagttgactttgtgtgatgagtttgaatgagtttgaatagtctactttttctttattttgaactttttcaataacgaagatatatttttaagcttgaaagtgactatattaaaagaagaaaaagaggaatactggtgaacaacaaactgtaatctgccaataagttcataaattgcctttgaggaggcctcataaaaatg

SEQ ID NO: 20955 - DNA, 440 bp, Homo sapiens
  misc_feature 207: n = A,T,C or G
catccctcagaattagttttagttcttagaattttataaaaatatgccaaaataccaaaaagttcatgggattgctaatttaaaaaaaccaagagagagagagaaatacataatggaaagggagaaaagccaagatttttttcaagttcatttttcataatgaccagtacttttaatacctgaactggtggtcccaactcctgaggnggggcatgaatggtcagtcttgggggaagtggatgtggtgggcgtctcggtgactgaggtgctcgaggggcctgtctttcagatgctgatgatggctgttgttctctagaaacctcctgagaaaaagaagattctgcagcacctgtatttccttcacctgtaggaaaagagaaatttacttttgaactgctaaatttaccacaaaaaaacttggacaatccctagaagtataa

SEQ ID NO: 20956 - DNA, 420 bp, Homo sapiens
  misc_feature 2, 17, 120, 265: n = A,T,C or G
anggcaatgcttttagnattaaaatgaaggtgacttaaacagcttaaagtttagtttaaaagttgtaggtgattaaaataatttgaaggcgatcttttaaaaagagattaaaccgaaggngattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagnggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagc

SEQ ID NO: 20957 - DNA, 460 bp, Homo sapiens
  misc_feature 24: n = A,T,C or G
gaccagaagatctcaatcgggctngtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttggtaagctcaggattttaaattacacagttcacaaacagtaaaggccatgtgaagagaattattacatctttattaacctcagcatttactttgtttcttttgcttaggaaattgctcataatctgggat

SEQ ID NO: 20958 - DNA, 400 bp, Homo sapiens
  misc_feature 25, 217, 273, 357, 371, 385: n = A,T,C or G
gaaaattgaccacctgaaggaacanctgcagccccttgaacaggtgaaagctggaatagaagctcattcggaagccaaaaccagtggactcctgtgggctggattggcactgctgtccattcagggtggggcactggcctggctcacgtggtgggtgtacctcctgggatatcatggagccagttacatacttcatcacatttgcaaattctatggncttttttgcatactttatagtcactcgacaggtgagtagtttgttaggaaaatggnaagttagaacatctttgcaaagaatgtcttatctaaacaatgagcaaaaaagcctttttatttactgaattactgccatctggnttttatgagctggnaaattttttattgnttttcacaagactga

SEQ ID NO: 20959 - DNA, 290 bp, Homo sapiens
  misc_feature 160, 195, 246, 285: n = A,T,C or G
aagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgnggggtcttacaaggcaggcctttcctacagggggnggagagaccagcctttcttcctttggtaggaatggcctgagttggcgttgngggcaggctactggtttgtatgatgtattagtagagcancccat

SEQ ID NO: 20960 - DNA, 400 bp, Homo sapiens
  misc_feature 390: n = A,T,C or G
ccgaaaactctggagttaaggccaatgaagtaatctctaaactttatgcagtacatcaagaaggaaataaaaacgttggattagatattgaggctgaagtccctgctgtaaaggacatgctggaagctggtattctagatacttacctgggaaaatattgggctatcaaactcgctactaatgctgtagtcactgtacttagagtggatcagatcatcatggcaaaaccagctggtgggcccaagcctccaagtgggaagaaagactgggatgatgaccaaaatgattgaaattggcttaatttttactgtaggtgaaggctgtatttgtagtagtactcaagaatcacctgatgttttcttattctccttaaattaagagttattttgngtttgtattc

SEQ ID NO: 20961 - DNA, 440 bp, Homo sapiens
  misc_feature 55, 209, 396: n = A,T,C or G
cagcaacggttctaataattaaattggatgctatatgtaaagcacttagcacagngctcaatatactgtaagatgtaattgctcattcattattttctcttttcttgcaaggatgatactaatggctaggcactctctaaagagatgtaagacactgttggtaagactccttgatcaacacatgatttcaggttcaagaaaaagttgtnttattaagttactaatgcagcaaattatccagaatttgcttcactatcttcttttatacttaacaaaagacttaaaatataatcaggactgtagtctgcatgctactttggattcaaatctttggcaatttttgcctttgaaatttagaactagtctatggtaacctatatgaggctataatgaggnaagtcatggcaatgtaattgaaatgcggggtatcataattgaat

SEQ ID NO: 20962 - DNA, 241 bp, Homo sapiens
  misc_feature 23: n = A,T,C or G
aaagaagtggagaagctgtagcntgctcttgctttatgagttgcagtcagctgtgtctgaagagaacaagaaactaagccttactcaattgatagaccactatgggttagatgataaattactacactataacagaagtgaagaagaatttatagatgtttaattcctgatttttgctccagaatatctttgagaatgacaacttaattaaaagatacttaggcacttttttttttttttt

SEQ ID NO: 20963 - DNA, 360 bp, Homo sapiens
  misc_feature 24, 64, 143, 278: n = A,T,C or G
aataaagctaaaactcacctgagntgtaaaaaactccagttgacacaaaatagactacgaaagnggctttaacatatctgaacacacaatagctaagacccaaactgggattagataccccactatgcttagccctaaacctnaacaggaaatcaacaaaactgctcgccagaacactacgagccacagcttaaaactcaaaggacctggcggggcttcatatccctctagaggagcctgttctgtaatcgataaaccccgatcaacctcaccacctnttgctcagcctatataccggcatcttcagcaaaccctgatgaaggctacaaagtaagcgcaagtacccacgtaaagacgtta

SEQ ID NO: 20964 - DNA, 298 bp, Homo sapiens
aatacaaactttgtatttatttggatccattaaattttatcatgtaaatatgtatttactaagtactaaaaagtaccattttcttgataaactataatgatctgtttgcatatggttaaatggagattttcaaaatgtgtatcagcttggtgtggtttgcagaaatctccagagaatttcctttttctacatgttgtgtggtatgtacttgtaaagattatttatgcttcatgtttttgacattagcgtgttttgtttgttttgaaatagatttatttagttgaggtattttaggatg

SEQ ID NO: 20965 - DNA, 375 bp, Homo sapiens
aacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaaagaatcacaactgtaaacatgagaataa

SEQ ID NO: 20966 - DNA, 371 bp, Homo sapiens
gttggttttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagatttttttttaatcatgaagagaaaattagtagcattttctttctctccccattatttat

SEQ ID NO: 20967 - DNA, 307 bp, Homo sapiens
aacagcgtgaaaatgaatggaagtggctggatgggacatctccagactacaaaaattggaaagctggacagccggataactggggtcatggccatgggccaggagaagactgtgctgggttgatttatgctgggcagtggaacgatttccaatgtgaagacgtcaataacttcatttgcgaaaaagacagggagacagtactgtcatctgcattataacggactgtgatgggatcacatgagcaaattttcagctctcaaaggcaaaggacactcctttctaattgcatcaccttctcatcggattg

SEQ ID NO: 20968 - DNA, 317 bp, Homo sapiens
  misc_feature 25: n = A,T,C or G
atgtgatggcccggggaaaccatgnagggcattaagctgggcacagtggctcacgcctgtaatcccagcactttgggaggccaaggccggcggatcacgaggtcaggagatcgagaccatcctggctaacacggtgaaaccccatctctactaaaaatagaaaaaaatcagccgggtgtggtggcgggcgcctgtagtcctagctactcaggaggctgaggcaggagaatggtgtaaacccgtgaggctgagcttgcagtcagccaagattgtgccactacactccagcctgggtgacaaagcgagactccatctca

SEQ ID NO: 20969 - DNA, 271 bp, Homo sapiens
tgcggtggctcacgcctttaatcccagcactttgggaggctgaggcgggtgcatcacgaggtcaggagatcaagaccatcctggctagcatggtgaaaccccgtctctactaaaaatacaaaaaaaaaattagccaggcatggtggtgggtgcctgtagtcccagctactcaggaggctgaggcaggagaatggtgtgaacctgggaggcagagcttgcagtaagctgagatcgcaccactgcactccagcctgggctactgagcaagact

SEQ ID NO: 20970 - DNA, 382 bp, Homo sapiens
gcctttcggccggaaaccgccatcttccagtaattcgccaaaatgacgaacacaaagggaaagaggagaggcacccgatatatgttctctaggccttttagaaaacatgggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgat

SEQ ID NO: 20971 - DNA, 135 bp, Homo sapiens
  misc_feature 103, 118, 131: n = A,T,C or G
ggtcctgaagaggcggcctccagcagtcgcgaggtgctgcggcgctgcgtagaaagtatcaatcagccggtttgctttttgtgaagaaagaattccctttggnacctgcggggcggtnccgaagttccagncctt

SEQ ID NO: 20972 - DNA, 370 bp, Homo sapiens
gataccggaaccgataaaaactcagtgagtgttgcttcccccgttacacacctgctcatgatgacttgtgggatgcttgttttaaaggagagctgagtgcctctgatagaaaatctgatttcatgaaatgcttattaggagttaagtacccctttttcttgaagcttgaacagactttatcattaatgtgactgactggagcaaagtgaagagtttgatacctgccactctgtctctgaagatttacgtagagaaattttccccataggaatggacaaactaaagggatccttaagaaatagtatgtcacccaaatatattctgtggtaaggcttctcaacacctgttcttcattaggacggagcactct

SEQ ID NO: 20973 - DNA, 366 bp, Homo sapiens
gtagactgagtggggtaacccagcaaggcctgtctgttcagattttgtcttggtcttcctgtgcaatatttcttcctccaaggtatggggcaggaccctctctggactgagggtcttacaacccacaatcaaattagagtcctgccttgagtaggtgaaaggagttcaggagaataccagagagattctgtttccttacaccaacattataacaaaagactgtaaaaaggattattagagttataagccagggaccatggatatatatgtcatgtcacagtaagtaacactttttttacagtaccagttaatattcattgagtattttgtgccaatctctgttcatgcatgaacttgttttatcca

SEQ ID NO: 20974 - DNA, 369 bp, Homo sapiens
  misc_feature 9: n = A,T,C or G
gatacaagnataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaaggtgttgtacatgtctctggtttcag

SEQ ID NO: 20975 - DNA, 253 bp, Homo sapiens
gattagtgatgtaattgattttcattctggcacaagcctctttcattctggacagctcacaaatagttaatggaccatgctttgaatagccttcctctaagcaacatttataaatactgatattttagaactgtttacatttcttctgtttatttttgaattttcagtttgatatcttgtccttattcattgttgtataaacaactgtactttaatttcaagtagtattaaaagtatttcacttcaaaaaaaa

SEQ ID NO: 20976 - DNA, 195 bp, Homo sapiens
ctccgcggcggcgacgattcattcgaatgtctgccctatcaactttcgatggtactttaggcgcctaccatggtgaccacgggtaacggggaatcagggttcgattccggagagggagcctgagaaacggctaccacatccaaggaaggcagcaggcgcgcaaattacccattcccgacacggggaggtagtgac

SEQ ID NO: 20977 - DNA, 380 bp, Homo sapiens
gatgagatgttctccgacatctacaagtatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattg

SEQ ID NO: 20978 - DNA, 308 bp, Homo sapiens
aacaggcaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaga

SEQ ID NO: 20979 - DNA, 381 bp, Homo sapiens
aactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgatttgcagtaataataagcattcaagcaactctgtattttccccatatt

SEQ ID NO: 20980 - DNA, 383 bp, Homo sapiens
  misc_feature 355, 381: n = A,T,C or G
ggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgnattatgaaataaaaactaaataacantt

SEQ ID NO: 20981 - DNA, 400 bp, Homo sapiens
  misc_feature 373: n = A,T,C or G
cttatgggccggggaaggtttaccacctaagggaggaatagtaaaactgggagaggatttatgatgcaggaaagaaaagagatgtatgccaggtgcagtggctcacgcctgtaatcccagcattttgggaggccaaggcgggaggattacttgagcccaggaggttgaggctgcagtgagccatgatctcgccactgccctccagcctggatgaccatgtctcaaaaaaaatagaaagaaaagaaaacgaatctataagaaatgctgaagagaggcctggcgcgatggctcacacctgtaatcccagcatttgggaggccaaggcgggcagatcacgagatcaggagatcaagagcattctgactagcatggngaaaccctgtctctactaaaaatacaa

SEQ ID NO: 20982 - DNA, 386 bp, Homo sapiens
  misc_feature 33: n = A,T,C or G
gcggtctgcttcttgtaaaaacctgaacccagnaaacaacacaatccgttgcaaacccaaaggacccaagtactttccaatctcagtcactctaggactctgcactgaatggctgacctgacctgatgtccattcatcccaccctctcacagttcgggcttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgct

SEQ ID NO: 20983 - DNA, 374 bp, Homo sapiens
gcttctttttttaggcggccgggaagtatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctg

SEQ ID NO: 20984 - DNA, 376 bp, Homo sapiens
gctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgct

SEQ ID NO: 20985 - DNA, 134 bp, Homo sapiens
  misc_feature 6, 24, 25, 26, 28, 29, 31, 50, 68, 74, 79, 80: n = A,T,C or G
gacgtngacttcgaaaagcccgcnnngnngntccgaaggacctccacctncgccctcaccatcatcgngggcgncatgnncttcgagcgcgccttcgatcaaggcgcggacgctatctacgaccacggcaacga

SEQ ID NO: 20986 - DNA, 120 bp, Homo sapiens
  misc_feature 7: n = A,T,C or G
tgaaggnccgggggccgctcccgttctctttggttacgctcgtcagccggtcggccgccgcctccagccgtgtgccgctatgggagtcccggcgttcttccgctggctcagccgcaagta

SEQ ID NO: 20987 - DNA, 349 bp, Homo sapiens
  misc_feature 23, 348: n = A,T,C or G
aagaactaagggcgactaccagnaaagcgctgctgtacctgtgtggtggagatgactgaagcccgacacggcctgagcgtccagaaatggtgctcaccatgcttccagctaacaggtctagaaaaccagcttgcgaataacagtccccgtgaccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtnc

SEQ ID NO: 20988 - DNA, 217 bp, Homo sapiens
caaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttcaaa

SEQ ID NO: 20989 - DNA, 372 bp, Homo sapiens
  misc_feature 44: n = A,T,C or G
aattaataaacaggaacatgatattattaaacaaaaaacacagnatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcacctggaagaacaattgaggaggttgcaagaagaacgaacttgtaaagtgtgtatggacaaaagaagtttctgttgtatttattcctttgtggtcatctggtagtatgccaggaatgtgccccttctctaagaaaatgccctatttgcaggggtataatca

SEQ ID NO: 20990 - DNA, 365 bp, Homo sapiens
  misc_feature 335: n = A,T,C or G
taatgtctggtgttttatgttatccttcactcaaactaagttggttgtataacacttttatgtaattaaccgttacgtagaaacttatttcctgttttataatatgggggaagatagctgtctaaaattactgattaccactatatattgtatttatgtaatttaaaggaaaggatatatggcagaagttcccagactttcttggttcactttacctgtgtctcagtaattttaacatggtgttatccctgcgccagaataaatacctaacagatcggtttattaaaaggccaggagcacacctataatcccataactgggaggctgaggcaggnaggattgctttgagtccaagagcttgaggc

SEQ ID NO: 20991 - DNA, 381 bp, Homo sapiens
gaatgtgttcatgaggactgactgagcatgataccatgcccccgtccccatggctctatttccagttggtataaagattaaatgaggaaaactgacttcctgtgcctgcagatgccagatactcagtaaatatttagttattctgccttctaggatatgcacaaggaagagtgaggaggtcacataggaagtagagaggcagaaaaaagagcaataaaagaggataacttttgctttagctagctttggctgatggttctttaacattaaaaatgtaaattagtatacgaaattttactctgtgctgctcctctgtataatatgattttatcatgaaagcaaagagaaagagcaaagagaggaggcggggaagagaggggg

SEQ ID NO: 20992 - DNA, 149 bp, Homo sapiens
actttgaagtttatttcaggatgtttgaattagataactagtaaaatgttgggaggaaactgagtctttaaaggactcctattcactgtcatattattgaacccagcacagtgtcaggatactcatttaatccattatagtacctaata

SEQ ID NO: 20993 - DNA, 133 bp, Homo sapiens
  misc_feature 8, 13: n = A,T,C or G
taaaacanaaccngaattaaaaaaagaagcagagaaaagaaacagcataatacatgatagaaatcgtctaaagaataatagaaataaattttcagaataaatacaaagacctacacttatctactaaaaaaaa

SEQ ID NO: 20994 - DNA, 365 bp, Homo sapiens
gattcctgtaattaggctgttttgatgttattgatatcctcttttctggttttggagtggatactttccctgctgtgacctctgtgctctgtagtggttctcctagggaattatattccagtaattctgggtatttctttaaggtgctttgtatttcttgaagtgccattttgatactttcagtgttctgaactgtgcctagaacgtactttttataaaaaggaagcagagtccatccaggcagagagagtactgtgtgcctgtagtcttgtctattcgcaaggctgaggccagaggatcccttgagcccaggagttcaagtccaggctgggcaacacactgggaccatgtttcttaaaaaaaaa

SEQ ID NO: 20995 - DNA, 330 bp, Homo sapiens
tagtaagattacacatgcaagcatccccattccagtgagttcaccctctaaatcaccacgatcaaaagggacaagcatcaagcacgcaacaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactaaaaaaaaaa

SEQ ID NO: 20996 - DNA, 248 bp, Homo sapiens
  misc_feature 27: n = A,T,C or G
cttcaggagcatctcaaacctcaaatnacaaccaaacgttcacccaaaccaccaaacaagaagaagactaagaaagttatagaatcagaggaaataacagaagaacattctgtttctgaaaatcaagagtcctcctcccccccctcttcctcttcttcttcaacaattcggaaaatcaagtcttccaaaaattcagctgctaatagagaattacagaagaaactcaaagtaaaagataacaaaaaaaa

SEQ ID NO: 20997 - DNA, 269 bp, Homo sapiens
tgcagtggctcacgcctgtaatcccagtactttgggaggccaaggtgggcggatcacgaggtcaagagatcaagaccatcccaggcaacatggtgaaaccctgtctctactaaaaatacaaaattagctgggcaagggggcacgtgccttgtagtaccctactcaggaggctgaggcaggagaatcgcttgaacctggaagcagaggttgcagtgagctgagatcatgccactgtactccagcctggcaacagagtgagactccatctc

SEQ ID NO: 20998 - DNA, 387 bp, Homo sapiens
ggggtcaaatgaaggtgaattcaaggctgaaggaaatagcaaattcacctacacagttctggaggatggttgcaccgaaacacactggggaatggagcaaaacagtctttgaatatcgaacacgcaaggctgtgagactacctattgtagatattgcaccctatgacattggtggtcctgatcaagaatttggtgtggacgtcggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctt

SEQ ID NO: 20999 - DNA, 322 bp, Homo sapiens
  misc_feature 178: n = A,T,C or G
aagctctgtttggtgctttggatccatttccatcggtccttacagccgctcgtcagactccagcagccaagatggtgaagcagatcgagagcaagactgcttttcaggaagccttggacgctgcaggtgataaacttgtagtaagttgacttctcagccacgtggtgtgggccttgcnaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggac

SEQ ID NO: 21000 - DNA, 182 bp, Homo sapiens
  misc_feature 10, 12: n = A,T,C or G
agcagaagcncnaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaag

SEQ ID NO: 21001 - DNA, 344 bp, Homo sapiens
gggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtac

SEQ ID NO: 21002 - DNA, 372 bp, Homo sapiens
catggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaacttttggaagaacttttaacagaagcctcaatgatg

SEQ ID NO: 21003 - DNA, 361 bp, Homo sapiens
  misc_feature 19, 97, 135, 148, 158, 312, 352: n = A,T,C or G
ggttttaacaaattaagantattaaacgctcagtcactgcttctatctggtacaaggatgaagtaaatttttgaggaactgtctcaatcttctgagnagagttaattggcaatatactcattgataagaaggggncagagaagaccanaaggagaagncacatactataattattttggcatccttcttttttctttcacatattccactatagagtgggcgagtagaggcaatgcccgcatagagtcttgtcttttgtcatgcatgctttatggctatgacatagagccatctcaccaaattttcagtggnacttaaaattcactttggctttgggaagctcattactatnaaaaggaag

SEQ ID NO: 21004 - DNA, 380 bp, Homo sapiens
agaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctg

SEQ ID NO: 21005 - DNA, 399 bp, Homo sapiens
  misc_feature 16: n = A,T,C or G
gtgtggccggggaagncattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgactt

SEQ ID NO: 21006 - DNA, 187 bp, Homo sapiens
aagccacgcatagaagagattcagcacaaactgtaagtagcaggtttaggttaccccatcctcccacgctcacacttcggatactgacttcagatactggaaaatcatcagatacagaattataaaataagttaatgcttaacaaaataatatttaaaaggaaaaataagcaaccaaaaagtgaccg

SEQ ID NO: 21007 - DNA, 373 bp, Homo sapiens
ctgcactatagaagcaataatttcaacagtcggcagttaaaatttgacaggttgctgtaagagccaggaattgtcaggcatctggaggaagcaagccactagaggtattgcggggatgctgctgcagtacagctaaaatgcagtcgtcagaagatttttgttgtcctttcttatgagaattgtgtgaaggtgagatacttatctttgtacctcagattgctgggtttgataaactaaaagccagattattttaatggcaaataaaacacaattacattagtacatgtattacctgtttatagactttatttatgacatttatattatataatgtcatctaaaacactattttatttattttttaggttaccgt

SEQ ID NO: 21008 - DNA, 253 bp, Homo sapiens
  misc_feature 7: n = A,T,C or G
gtgagancattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaatc

SEQ ID NO: 21009 - DNA, 365 bp, Homo sapiens
  misc_feature 191: n = A,T,C or G
gttctgatatgtccagtactcactggaaaattggatctataactgatgggtttagtaatctgctcatttcttgctctgaaaattgtagtcagcaaaagagatcatggaagaaatcactgtaatggtagtaatagtaacacatgccatttgtattgtgccttaggtttaccaggtgtttccaaatacattangcatatttgatatgtgcaggactagataccttgggacctgccacactccactttcaagatatgtattagcttcattagaattaaagggacttgaactcaggacctgcagcctattctttatccacatgtctctggtagggctacatccagatcacaccatgacttcttatagag

SEQ ID NO: 21010 - DNA, 352 bp, Homo sapiens
  misc_feature 3, 348: n = A,T,C or G
ganctaaaaaaaaagtatttgacaaaagtccacatccacacacattcatggtaaaaacattcaacaaactaggaaaagaaagcttccccaacgcgataaaggacatctgtgaaaaaactcttggttaccatcgtacttaatgggaaaagattgaatgttttcccccctatgatcaggaacaagaccaagaaatccactatctccacttttatttaacattacagttaaagtgttagcccagaaattagacaagaaaacaaaatcaactggatgcagattggaaagaaagaagtaataagtatttaccttgcagatcttgtatacaggaaattctaaggattctgcccnaaaa

SEQ ID NO: 21011 - DNA, 223 bp, Homo sapiens
gatcacctgagtcaggagttcaagataagtctggccaacatggtgaaaccctgtctctgctaaaagtacaaaaattagctgggcacggtggcgcacacctgtagttccagctactggggaggctgaggcaggagagtcatttgaacccagcagtgggaggttgcagtgagccgagattgcgccactgcactccagcctgggcaacagagcaagactcttgtct

SEQ ID NO: 21012 - DNA, 155 bp, Homo sapiens
  misc_feature 4, 12, 14, 17: n = A,T,C or G
gaancctagggnantanaacgtagtcaccctcggtgcttcctctgtctcctctttctccctggcctgtggttgtcccccagcctctgccaccctccacctcctcggtcagccccagccccaggttgataaatctattgattgattgtgataataa

SEQ ID NO: 21013 - DNA, 278 bp, Homo sapiens
  misc_feature 12, 14, 43, 44: n = A,T,C or G
tggttggccggnanaccccaaataaagtctattcaaagttagnnttctaccagatgaaacattttataatgccacgtataattttgatataaaatattttaaatacatactcaaaaaggagtatttatttcatatagtattaacttgtcttaggaacaactctgcaactgtaagataagatgagcagcaacaaaatgtaatacacctggatttaagaggctagctattcataacagcaaaagccaacaaaaagttgtttcaaaggcaatcaggcacca

SEQ ID NO: 21014 - DNA, 388 bp, Homo sapiens
gggggaacctcaggctctagcagatccttcagtgccaggtgtggaagaaatgtatcagtccctttctttaccttggaatccttcagagttcctgggcctggataatcgggtggatggttgtcataggcctgaagggcttggttatgatcattggtgatctcatgaggttttagagcagtactgttaagataggtgtcttggctggactcctaccccagtaatgaaccattgtgcttcttacatgttttccaagagtttaagctcaaaccaagggctagaggatctggagcctagtgcattaaagcctgacacctgagtttttatgaaactgcccattggtcattccagaaatgcactggtccctgctaatgtgactgctttgctaata

SEQ ID NO: 21015 - DNA, 400 bp, Homo sapiens
  misc_feature 3, 5, 377: n = A,T,C or G
ctnanctagtttttttaaattaggtagagttttaacagaggagcaacatggaaaatgtttatgtgtatgaggataaaaatgcaagtcttgagaatattagtttagtaatgttctgattagtgtttgtagcctttgtaaaaaatgtaaatttaccttctagatgactacttgaaactgttgtttttggatgcttgccagataaaagccctgtgggattaagttctggtaaatcgcttgcaaatttgtgagggatatcagtgactttgagtgtttaactgtccaagctgtcatccacatgcgtcctatcactgcattgggtgaaaaaattaagtttctcagccagttagaattaaaggtgacatctgctttaattgggnggttttatttttcttccaagtca

SEQ ID NO: 21016 - DNA, 388 bp, Homo sapiens
  misc_feature 33: n = A,T,C or G
gactcctgaagctgacagcattcgggccgagangtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagggaattgaaaaagtggagtattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacat

SEQ ID NO: 21017 - DNA, 129 bp, Homo sapiens
  misc_feature 2, 3, 4, 5, 7, 8, 12, 13, 18, 26, 30, 35, 37, 59, 100: n = A,T,C or G
annnnanngtannggttncctgggcntggnggctnanaccctgtaatcccaacactganaggctgaggtgggaaggattgcctgagcccaggagttctanaccatcttgggcaacataacaagaaccct

SEQ ID NO: 21018 - DNA, 398 bp, Homo sapiens
  misc_feature 2, 14, 26, 30, 46, 56, 67, 79, 80, 81, 82, 83, 101, 261: n = A,T,C or G
antaaaacttgttntcactcttaccnctcnaaacctgttatggttnttaaatcgcnaaaacttgtanaatcatgttgtnnnnntaaacccatatgcaaagnaccatgcgccgggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgcnggtggtgttaagaagcagaagaagcctctggtgggaaaaaaggcagcagctaccaagaaaccagcccctgaaaagaagcctgcagagaagaaacctactacagaggagaagaagcctgctgcataaactcttaaatt

SEQ ID NO: 21019 - DNA, 234 bp, Homo sapiens
  misc_feature 6, 15, 30, 31, 34, 37, 40, 41, 43, 45, 49: n = A,T,C or G
aacccntgggtcttngatatttagctaaannggnganganntntnaaanaatccccctaccacaatgtatgggtaagagagatgagaggaggtcaggacaccctcaggggatgtcagcactgaagagaaagcagaggaagcggggctacagaatctaaagtgagctatggactggagatggttgttctggcattcaaaaaggagcaatcagccatagtcacactactgggagag

SEQ ID NO: 21020 - DNA, 312 bp, Homo sapiens
  misc_feature 9, 14, 26, 29: n = A,T,C or G
tacctcacnttccntgtcacagaacntantcagcctcaagaaggatttggtggaggtggatttaccactggttttacaaaggaccgtgtaaagtcattgaagttgtgaaagtctatttttttcctgtaaatctattttttacagaatataagaaacatcaatgacctgatctgtccttcctcctccttcccgcttcccccaaaatcacattccagtttttattgtctttgtgtccaaagtaaactaggtgacttatttgtataaaatgttattttgccacatgagacagtaataaaagaaagattttcacag

SEQ ID NO: 21021 - DNA, 399 bp, Homo sapiens
  misc_feature 24, 26, 27, 30, 55, 60, 61, 75, 94, 95, 97, 99: n = A,T,C or G
ctttttggtccccgggacctcggncnntcnggccgggaaccgggaaccagtgganctttnntaaccctctagatncaaatggacctaacagatnntntntagaatactcccttcaacagcagcagattacactttcttctctagcacacatgaaatagtctccaggatagatcatatgttaggccacaaaacaagtttcaataaatttcagaagattaaaattatatcaggtaactgttctgaccataatggaatgaaactggaaatcaacaacaggaagaattttgggagaattcccaaatgcaaataaattaaacaacatgctcctcagtaaccagtgagtcaaattaagaagttaaacaagaaattgaaaaaacatcttgagacaaatgaaactgg

SEQ ID NO: 21022 - DNA, 400 bp, Homo sapiens
  misc_feature 2, 13: n = A,T,C or G
tnttggccggganagacagcaggacggtggccatggaagtcggaatccgctaaggagtgtgtaacaactcacctgccgaatcaactgccctgacccagggagttagttggatccccggatacccatctggggccgacactggcagtctcagagcaggctttttgcaaacacccctcagtgctggggagatggtgaaagatcacgcctgccggattccgaatcctttctctccttaagccaaattttagccacttccaattacaaagcacagtatgtatacttcaaacttaagtggtgaacttaggctccgctccttatggggttttctaatgttaatttttagaaatctgggtccattagctgtttagagcaaatattgttatccctgtagtccaaggag

SEQ ID NO: 21023 - DNA, 398 bp, Homo sapiens
  misc_feature 16, 17, 28, 30, 32, 34, 35, 36, 37, 41, 50, 52, 78, 84, 92,97, 121, 140, 147, 379, 383, 387: n = A,T,C or G
tgccctgtaacctgannctgtaccctcncncnannnnctcncctcagacncntggtcccacaactgcaccgtgccttntgcccntgggtacnagccnagagccccctttcaacccccaccnctggaccttgaggaccctnaccctgntgggaccgtttccacgtgtctcctagagaaaggattccttggatctagctggtcacgacgaatgttttcaccaaggtcacaggagcatttgcgtcgctgatggggttgaaagttttgggttttgggttccttggtttcagcccaatatgtagagaacatttgaaacagtctgcaccttttgatacggtatttgcatttccaaagccaccaatccattttggggattttatgngggnctgnggcttaataat

SEQ ID NO: 21024 - DNA, 258 bp, Homo sapiens
cagtattttacaaaaggtgtagcttttataagagtgcagaaaagggaaggatgtgttttttctctcactatagtataagaatctattttggagaaaaaaagaaaatatgagggtctcgaagcatgatttttatataactagtttcagttttatctaataacttactttttaaatcaatatttatcaacaatctttccttgtatgcagtgctttcaaaagatggttttgagtgtccagtgaaacttatgacttggatat

SEQ ID NO: 21025 - DNA, 366 bp, Homo sapiens
  misc_feature 2, 12: n = A,T,C or G
ancctaatggantagaaaacttaatattgttaagatgttactactacctaagcaatcccacatttaatgcagtccctataatcatgaatccgataagcagtcatcatccaggatatatagagaactcctgaaattcaacaacagaacaaccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtattggtagactgttaaagacaattttatgactatttatgcacattataat

SEQ ID NO: 21026 - DNA, 368 bp, Homo sapiens
cagcagcagccgctaggaaatcttcagtgtagtgtctgtgctaacccagtggtaaatcccttagatcccctgctggtctctggcagtctccttgattttgggtaccatgtatattttccgctttgactttaacgctttctaggatagggtaagcacccttaattcaggcactgtccattagcttcctttgcaaaggctacttatggccggtcacaatccagcactcagacagagccaaggcaatatcctcttgcccatggctatgatgtcagacagtggatgggctccagcaacaagagacaaaataactaaaggcctttgctctcctctgacattgaggcctggggcttacagtttggaatacaaca

SEQ ID NO: 21027 - DNA, 353 bp, Homo sapiens
  misc_feature 22, 350: n = A,T,C or G
gcattttaatgatccgctattntaagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttgnagc

SEQ ID NO: 21028 - DNA, 361 bp, Homo sapiens
actaaccttgttgtttacctttcctgatttcttatatggtataaattaaagttcaggcatttatggggagaaaaggccctccccaccgacccgccacctgccacctctgacggagtgggagaagttagtctgtgctaagatagtactgagtccccagatgttgtatactgtaaattacagtataatgccaaatgcagcaaaatcttccagctgtacgttacaagtttggtcattttgaagcttgacattttagtttgccattatgttaaaaacatctaaataggtgttagtttctcaggagtagattgttaagtggttgactttttcctgtaaagcagacatcgttcttggcctgccctgc

SEQ ID NO: 21029 - DNA, 400 bp, Homo sapiens
  misc_feature 10, 14, 36, 39, 40, 48, 50: n = A,T,C or G
gatggcccgngtancagtcaagttagaacgacttcnccnngtgttaantnttgttagtattcgaaaagaggttgatgttttaaaatttaaaaaatgttcagtcttagtaaaggtttttaaaagttaaatagttaactatgataagaaaagtaatttatgaaactaaatgagtttgattaaaaagttgctcttaatgaacagaaagaaaattttttaaattatttacttctgttatggttactcacaatacacatggtattttatgatctgcataattatgttgagaaactaatatgacttaaactttttcatgtaaaatctgacattttctttccaaagaaatgtactgatatacttccagcatcatctttttttctgtctatacgtggtgatattagca

SEQ ID NO: 21030 - DNA, 201 bp, Homo sapiens
  misc_feature 3, 56: n = A,T,C or G
gtnacctcccgtgatgctgtaccccctactttgaagggtctttctcaagaaatctnaagcttgttttgttgctcagtgtttttgtgaattgcttggttgtaattaaaattctgagcctgatattgatatggttttaaagaagcagttgtaccaagtgaaaattattttggagattataataaatatatacattcaatctgg

SEQ ID NO: 21031 - DNA, 400 bp, Homo sapiens
  misc_feature 9, 14, 32, 110, 153: n = A,T,C or G
agtcttccnctaantaagtttttgggcagaantaggggttagaaggagagagttgttacttttacacctactccctactgtaagtcgtttagcacaatgactacagaacnttagagtacatttagtgggcttgccatagaaaatggcttctantacctttggttaccaactctgccttttactttcctgcatatttgtatatatttttacttattcagaagttttgtacattttaatttttattgggaaacagggttatatatattttttccttgtggagacaggctcttgctgtgttgccctggctggtcttaaatgcctcacctcaagcgattttgccttggcctcccaaagtgctgagtgtttggggtggtgagccaccacacctgtctagagttat

SEQ ID NO: 21032 - DNA, 397 bp, Homo sapiens
  misc_feature 3, 15: n = A,T,C or G
ccngggacctcggcntttttggccggggtacagggtgccagatagattggaaaaaggaaagaatgtcactttgaaaactattaagaagaagcagaaacacaagggacgtggggcagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactgggagaagctattgaagatgatgatgatgattatgatgaagaaggtgaagaagcggatgaggaaggggaagaagaaggagatgaggaaaatgatccagactatga

SEQ ID NO: 21033 - DNA, 380 bp, Homo sapiens
  misc_feature 16: n = A,T,C or G
gactgaacagtcaganttttctaaattttttttccggaaacagtcatttttctttcaaaagagaacggaggcataatcctttacaaatattgcttatgttcagtaaatcatcttccagtgcagtgaaacgaagtaaatggtgtatgcacttctgcgcatgtttctggaggaggaagtccatatctttagtcagaatctctatcgatttagctattgtggaggcagtaggttgctctggataaatctgagcaaaggaatgagaggaaatcagctcatttgaagaatatgggatgcgaagctttgacacgacaatggcgagtaatttagggattcaggttatcccccgcatctgagtaatctgaaggtaattttctagctag

SEQ ID NO: 21034 - DNA, 240 bp, Homo sapiens
  misc_feature 3, 21: n = A,T,C or G
ttntggtgcgggcgatcaaanggaacaagcatcaagcacgcaacaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctcccca

SEQ ID NO: 21035 - DNA, 228 bp, Homo sapiens
  misc_feature 2, 23, 29, 42: n = A,T,C or G
cncccagtggatcaccaaaccancctacnaggcacagggtantatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtc

SEQ ID NO: 21036 - DNA, 400 bp, Homo sapiens
  misc_feature 2, 5, 31, 33, 42, 43, 46: n = A,T,C or G
tnggngcctttaagaagcatcctctgtcctnancaaaggaanntangaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgat

SEQ ID NO: 21037 - DNA, 350 bp, Homo sapiens
atagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggtta

SEQ ID NO: 21038 - DNA, 194 bp, Homo sapiens
atttcaacaaaggagctccgatgtgaggggcaaggctgccctctgccccagggctcttcagaaagcatctgcatgtgaacaccatcatgcctttataaaggatccttattacaggaaaagcatgagtggtggctaacctgaccaataaagttattttatgattgcgaaaaaaaaaaaaaaaaaaaaaaaaaaaa

SEQ ID NO: 21039 - DNA, 170 bp, Homo sapiens
  misc_feature 5, 28, 30, 33, 61, 78, 113, 115, 116, 122, 125, 133, 159: n = A,T,C or G
caaancaacgtataccccagtccagtgngngtngccataatttgcaattcagcttaacagngcacccaatctatattngcattttgatattatttaagctccatgtacaaggntnngcatgnatntatatggntcttagggaaaaaaatactataaacngcaaatctgaa

SEQ ID NO: 21040 - DNA, 400 bp, Homo sapiens
  misc_feature 26, 78, 160, 172: n = A,T,C or G
aacaaatgcaatataatgtgataagntctttaaaagaggtaagagcaacgagctttgggagcagagaagagggagaangcaacatcttgcctggatgagccaggggacacagaagagaagcccactatctcatttaatctttacaactctcttgcaaggntcccgtggttgngaaaatacatgagataaatcatgaaggccactatcatcctccttctgcttgcacaagtttcctgggctggaccgtttcaacagagaggcttatttgactttatgctagaagatgaggcttctgggataggcccagaagttcctggatgaccgcgacttcgagccctccctaggcccagtgtgccccttccgctgtcaatgccatcttcgagtggtccagtgttctgat

SEQ ID NO: 21041 - DNA, 440 bp, Homo sapiens
  misc_feature 267, 273, 337: n = A,T,C or G
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttganatgaancttcttcatggagtaaaaaatgtatttaaaagaaaattgagagaaaggactacagagccccganttaataccaatagaagggcaatgctttttagattaaaatgaaggtgacttaaacagcttaaagtttagtttaaaagttgtaggtgattaaaataatttgaagg

SEQ ID NO: 21042 - DNA, 450 bp, Homo sapiens
tgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctattcagacctgataggattgcctgcttagatgataaaatgaggcagaatattgtctgaag

SEQ ID NO: 21043 - DNA, 440 bp, Homo sapiens
taaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataaggatca

SEQ ID NO: 21044 - DNA, 440 bp, Homo sapiens
acaggattataagaaagggggaggtggggagggagcaagggttgaaaaactacctattgggttctatgttcactaattgggtgatggattcaatcataccccaaaactcagcctcacataatataccctgtaacaaatttgcacatgtgccccctgaatctgaaataaaagttgaaattttgaaaatacgtattactaaaaagaaattaagactgagctttatttcctgcaatggtggactagcttgtttcaaattaacaccaagaacaactaggaaagctggacaaaatataaataaatatattttttgacagcattgcagagagacagcaagcccagagaggggagcttgataactggtatattttctcctcaagacatttgccagtaacaaatgctgttgtagcttgagaggcctagaagctgagcaagattgtaag

SEQ ID NO: 21045 - DNA, 299 bp, Homo sapiens
  misc_feature 289, 294: n = A,T,C or G
catcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaaagaaggcccggaaggctatgtccaaactgggtcttcggcnggttncagga

SEQ ID NO: 21046 - DNA, 149 bp, Homo sapiens
aacagccacatctttctagaccatattaacccattatacatctgagatattttctccgataccatattgaaatctgtattagtctgttatcacattgctatggagaaatacctaaaactgggtaaaaaaaaaaaaaaaaaaaaaaaaaa

SEQ ID NO: 21047 - DNA, 295 bp, Homo sapiens
  misc_feature 11: n = A,T,C or G
ccacaaaaagnacagttacgactctgatattgggacattaactttttaataactggaaacccttgagaaaatattaacacatttataaatcaaagacatctcttgtgatttattacagaaccacttaaggttcattagataagcactcgttattttgttaatattaatacaattagaaaatatttgctgttggtcatgttttattttatacattatattattctcttaggccttcaattaaagataatcatagaaagcaaagcataacattcaaaaaaaaaaaaaaaaaaaaaaa

SEQ ID NO: 21048 - DNA, 400 bp, Homo sapiens
tgttcaaaataatggtggtgattggattaattctcagtccatcccagaatttgctgttttgaatatacagcttgtttttaaggtatccacttcttttgggaaagtagagataagaaaaaagtctgcttctttaaatgtcttgtttggattgggggcacacagccattttttttctagtgagtagatataaaggatttcccaaaaggtggctgtggcttcgcacaggagagctggagagctcttggtacatatactgctgagtgttgaaggcaggtgaatctgttctatgtttctgtgcagtgggctcttgctggggtcaaagctgtgtggtgtctgtaaaaaagggttgctgtgtaatgctttagaattggaattgcagattcttcttgtgaggggaata

SEQ ID NO: 21049 - DNA, 400 bp, Homo sapiens
  misc_feature 381: n = A,T,C or G
aggcattgaggcagccagcgcaggggcttctgctgagggggcaggcggagcttgaggaaaccgcagataagtttttttctctttgaaagatagagattaatacaactacttaaaaaatatagtcaataggttgctaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggngacttaaacagcttaaagt

SEQ ID NO: 21050 - DNA, 450 bp, Homo sapiens
taggtaatctgtttcttactactttctctttgttttgtcctatcctctctgtttttttgttgacctagaattagtttgtgtgagcggcaggcagtaacattaacaagaaaataacttactgctttggaaatgtagattttgaggttaggggcatttaaaactggatttaaaactggatttaaattggctattgctctttgtatttgaactgcaatttatgaactaaagtactgtaaaaaaatatgatagaggaatgcaccaaaaacaaatataaagaatattttttgagttaagacctatttttgaagaaaatctcacagagccagtttaaatggatgttaaatacccagaatatttggtaattttggaatcacatataacatatcctttaaaaaataccagtattctaattttccttcatttcagcctaacatttttatgaatgataat

SEQ ID NO: 21051 - DNA, 370 bp, Homo sapiens
caaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctatttttcagttgtgtgtaagcaagtttttttttagtgcaggagaaatacttttccattgtttaactgcaaaacaagatgttaaggtatgcttcaaaaattttgtaaattgtttattttaaacttatctgtttgtaaattgtaactgattaagaattgtggatagttcagcttgaatgtctcttagagggtgggcttttgttga

SEQ ID NO: 21052 - DNA, 400 bp, Homo sapiens
  misc_feature 64, 99, 122, 132, 201, 235, 236, 287: n = A,T,C or G
tttcgggacatttcccatcttaaatttttttttgctaggtcttcatattttacatattttgggncttaaaatggcagggacttttggtatataagcagncttagaaaattagtgaaataagntttttaatgnccctcatttttactgacctcaattttatctatggccttaaatttgcgaaaagattgactgctctatttngggcttcctttctcccttcctacctcaccgttgnncctcaaaaccaattcactttttgagctttgatcactagcttgtaagactgntcggggtttaggaaacagcgaggaaatgagcatgacaggcaaggagccagccaggggggtttgtgtgagcagggagacaggcactgggacatcattcgtttacctaatcaatg

SEQ ID NO: 21053 - DNA, 500 bp, Homo sapiens
taatgaggtcggtctattaaaagtgttttttctcacagaaaggtgacaaagtacaatttgaagaatttgcaaaagtagtaaggaatatgcgtgatgctgccaggttagaagagttacaggaagttgtcttagctgctgatttgctggaaggtgacatgatagctgggaagaacttggaagactttctaagaaatgttgggattaagtcacctaaagaagaggtagagaaaattcttcaatcagattttgtttctgaagataacatggtgaacattaaagactgtatgagggctttgagggacacccagaaattttccaattatattgatttcaggaaagaggcttcaaatctaaaattaccaaaggtaaacgagattaaagaagctgctaacatcttgtcacatgtcgataatggcaagattggtatacctgatttggagcatgccttgaaatgtttgaatgttaatttaactgaggaggacttcaatgaagcccttaac

SEQ ID NO: 21054 - DNA, 200 bp, Homo sapiens
  misc_feature 192: n = A,T,C or G
catggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcanaggacggc

SEQ ID NO: 21055 - DNA, 480 bp, Homo sapiens
aatagtactttgcatgctatcatcattacaatgagaaaaatttagtttttccgtggaccaatgtgacttcttgaattcaactcatattttcgtccaagagaaataacaactgccagttacttctgggcaatataaaatggcaagccaacagcatgccacatcatagcaaccaagagtataattcatagcactgaggagtaataataactggtaagccattttcacagtcttcactttattcatttcaaacctagttgtctccaagctctaattacatattaaatattttcccatatttttctgccttcttgctaacagattgataattaaattctgtcccaggcatttgatggcctctgtgctcatgtcttaaagacagttaaagtcattgaaaggtttaagcaaggatttcatgtgaatatacaaagtttacacagagggccttcttgactataggttttgagctgaatcaatcacata

SEQ ID NO: 21056 - DNA, 470 bp, Homo sapiens
ctagtcccacctacttatgtcttgctgtgggaccaccaggaagtcttagcttcttagggcccagggacttttcactgctaagtttaagtaacttgattcggatctgttgtggttcccacagccttcaaatactgtggaagttttaatttaaatcttcagataaactcttaatttttgagaactccttgatttaaataaaacatgtcggctgggcgcgttggctcacacctgtaatcccagcattttgggaggccaaagcgggcggatgaggtcaggagattgagatcagcctggccaacatggtgaaaccccgtttctactaaaattacaaaaattagctgggcatggtggcaccgcaccttgtagtctcagctactcaggaggctgaggcaggagaattgcttgaacccggaagccagagcttgcagtgagccaagatcgtgccactgcactccagcctcgtgacagag

SEQ ID NO: 21057 - DNA, 420 bp, Homo sapiens
catcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaatttgttgtagccggtgaattgagtcgtattctgtcacataatatttttgaagaaaacttgggctgtcgaaacatttttctctctgactgctgcttgaatgttcttggaggctgtt

SEQ ID NO: 21058 - DNA, 460 bp, Homo sapiens
tcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatggagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattaccctgggaggtcaatcaacttggagaagtttgacacaaagagcttctgcaagatcctggggccat

SEQ ID NO: 21059 - DNA, 400 bp, Homo sapiens
  misc_feature 128, 205, 207, 224, 233, 359, 361: n = A,T,C or G
taattttaggtcagtcttgttccttggcaacatctgtagtattattaatcttctgacattttcttatgtttttaaaaagataagagcatctagtgcattaaatgccaaaaaaaaaatacattatcagngattgaaacgtttacatgtacccaaaaaccataatcatctcttggaagaaaatgctgagatcaatgaattattctgngngcctatattgacgtagngagtactanagagttctgtattttattattgactataataattagtttaattagctttgcaaactgatggcatcgaggtaaatatatttttgccaaagttctggccttccaaaactcacccccttatttaaatgngngctatgacccactatgacacagcatctgcattttctaaa

SEQ ID NO: 21060 - DNA, 430 bp, Homo sapiens
  misc_feature 414: n = A,T,C or G
ctaattattacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggngttttatctcctgtga

SEQ ID NO: 21061 - DNA, 168 bp, Homo sapiens
ccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaaaaaaaaaaaaaaaaaaaaaa

SEQ ID NO: 21062 - DNA, 360 bp, Homo sapiens
ataacataaaggtttaagcaaatcagccgtagtgaaagacctaataaacttgatacgctatctctgatgaccattgaaaaagtttaaactttggtaataatctggtgttggatctgctatgccttgcgagattaattttgttctggaagatcctgttttcctcctggcgcctacatccttttgttcctattcattcctttttgcaagtctttctgcacctgtgatgcttggagcctggtccccgggtggggaagcaaggaagtgagtagtcgttatttacacatgaattcaaacgtgtaggcacagcgactttgccaattttatgttaattacaaaatgcatttactgaggatatctttg

SEQ ID NO: 21063 - DNA, 460 bp, Homo sapiens
  misc_feature 28, 459: n = A,T,C or G
agcatttaagaagcatcctctgccaagnaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagana

SEQ ID NO: 21064 - DNA, 367 bp, Homo sapiens
tacttgtatttatgcttttgataaaatgtattttcagcattaatacacatccgattatgccttatttatgtatgaagaataaagttaccatgttatactgttatgtcctaaaattcaaatcactatttgagaaaccctcaaattggtgctttcattatataatgatacatttagacaaaaccccaaactaagccatttgaaacaagattctctccattgcagtttgtagcaatgttatttctgtgtatgtcatgagaaggctaaatatcagtgttaatttcttgtttgaatccgtgaaatcatgcctgtaaagcccaaacatttgtaacaaactccctaataaatttagagaaagcccaaaaaaaaa

SEQ ID NO: 21065 - DNA, 330 bp, Homo sapiens
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttaacgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagag

SEQ ID NO: 21066 - DNA, 400 bp, Homo sapiens
atttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctggggtgttctcagtccttgccatgacg

SEQ ID NO: 21067 - DNA, 390 bp, Homo sapiens
  misc_feature 10: n = A,T,C or G
attaaaaagnaggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgccagacaatggctataaactgaattaggcagtctt

SEQ ID NO: 21068 - DNA, 173 bp, Homo sapiens
tgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttggtaaaaaaaaaaaaaaaaaaaaaaaaaa

SEQ ID NO: 21069 - DNA, 469 bp, Homo sapiens
cttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactaactatcctagaaatcgctgtcgccttaatccaagcctacgttttcacacttctagtaagcctctacctgcacgacaacacaaaaaaaaaaaaa

SEQ ID NO: 21070 - DNA, 390 bp, Homo sapiens
  misc_feature 352: n = A,T,C or G
agtgtagctactacattttagagaaggcgggaacattacatttgaaatatgtagtatagagcagtgtgatgactaagaccacataacgtctgttcattatcttggctaactttaattctgctgctgacttttctaattactcctgttctttttttgatcttttattccaaagaaattaataaaattgaatcttaacactgcacccttatcttacctaagaagatctcattataaggcatagtagttactaatgaaatataaaaatgtgttattcatgcaactttaaagtatcaccccttttaaagtaaatatttctcattttaattatttgtacagtattttattctgttgnctttctcagttctttatttattaaaggtctttattcag

SEQ ID NO: 21071 - DNA, 395 bp, Homo sapiens
ctgggggattccagcgaggaggtggtaggggagcctatggaactggctactttggacagggaagaggaggtggcggctattaaaacttggttatgtcagttcctgtgtgtagacagtaaggaaaaaaaggcatgctatgtgttaccgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtatttttctttaaggagtaaatatttgcctttaaataacttggtattttcctggctttcgtttaatacaatagaaaataaagtattacact

SEQ ID NO: 21072 - DNA, 368 bp, Homo sapiens
  misc_feature 341: n = A,T,C or G
ttcaaccattgtggaagacagtgtggcgattcctcagggacctagaactagaaataccatttgacccagccatcccattactgggtatatacccaaaggactataaatcatgctgctataaagacacatgcacacgtatgtttattcacacacatgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacanggaaaaaaaaaaaaaaaaaaaaaaaaa

SEQ ID NO: 21073 - DNA, 141 bp, Homo sapiens
  misc_feature 22, 114: n = A,T,C or G
attaagtacggttgaaactagnagtatggacaggttatcaacgaaacttctcagcatcacgatgaccttgaataaaaattgcacacactcagtgcagcaatatattaccagcgngaaaaaaaaaaaaaaaaaaaaaaaaaa

SEQ ID NO: 21074 - DNA, 359 bp, Homo sapiens
tggcctaggtaacggggcagagatgtggttcgagattctccccggactctccgtcatgggcgtgagcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacaggtgtatttatgtagcatgcaatgtgttatgtagtgcttaataaaaataaaatgg

SEQ ID NO: 21075 - DNA, 217 bp, Homo sapiens
gaaagttataccatttaaagctggcaccagagacccgatagggacttattaactatattgaacattttttcctttgcctttgaccctatgtataggttacgatgccagattagatttatagcagcctcaagttgtattaaatgatattttgcttcctgtaatactattataaaataaagtttgtttattctcaaaaaaaaaaaaaaaaaaaaaaaaa

SEQ ID NO: 21076 - DNA, 420 bp, Homo sapiens
  misc_feature 19, 315: n = A,T,C or G
aaggaagcagcctacaagnataacttgaatttgccaattctgcaaaatctgtgcttttttgaaaatttaagagtggggacgtgaaactgtattctgtgccttccatcatgatttccacatgaaagcactttaaggcactaattttaagataatgtttttggaaaacccaatgcatatgggtttctgaaatattttatggacttatttctccccaggaaatgattcttacggaaaaaaattgcttttgtatgtagaacaggaactttttgtattacagtgatgcaatagacatgtctaatgtaacttctacttttnccttttgaaagctcagtgtctgtgctattgacttgctctcatcacaatattgttgaattccacaatgtatggacattaaaacactggcagactgttcactttttc

SEQ ID NO: 21077 - DNA, 180 bp, Homo sapiens
acaaaaattagtgtacggtgatggcacgtgcctgtaatcgcagctactcgggaggctgaggcagaagaatcgctcgaacccaggaggcggaggttgcagtgagccgatatcgcgccactgtactccagcctgaataatggagcaagactctgtctcaaaaaaaaaaaaaaaaaaaaaaaa

SEQ ID NO: 21078 - DNA, 440 bp, Homo sapiens
  misc_feature 436: n = A,T,C or G
atgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatggggggaaatgcttccttttttggtttgtgatagcctatttttaatcatttccttcatattttttctcttataaaaatgnattt

SEQ ID NO: 21079 - DNA, 390 bp, Homo sapiens
atcccgtaggagcctctctccctactgctgctacacaagaccctgagaccgacctgcaggacgaaaccatgaagagcctgatccttcttgccatcctggccgccttagcggtagtaactttgtgttatgaatcacatgaaagcatggaatcttatgaacttaatcccttcattaacaggagaagtgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgaggga

SEQ ID NO: 21080 - DNA, 400 bp, Homo sapiens
agattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttggggttggggaatagcaatttattttattggattttagactttatcaagctaattagctcccctttagataagtacatgttgcacatgtgcaccc

SEQ ID NO: 21081 - DNA, 520 bp, Homo sapiens
  misc_feature 9: n = A,T,C or G
cgcaatagnatatagtaccgcaaggggaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtaggaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaaatttaacacccatagtaggcctaaaagcagccaccaattaagaaagcgttcaagctcaacacccactacctaaaaaatcccaaacatataactgaactcctcacacccaattggaccaatctatcaccc

SEQ ID NO: 21082 - DNA, 430 bp, Homo sapiens
  misc_feature 14, 250, 301, 331, 379: n = A,T,C or G
ttatctacctcagnatctattttcctttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgntttttgttcttgtctttgtttcatttttttaaaggtgtggtattaattggntctatgctccctggaatattactgctttgnggaaagtccagactgaacgcagcacccctctgtgtaccctagtacagntataaacctgggtctctcactacttgataatttttgcatttagttaagaca

SEQ ID NO: 21083 - DNA, 146 bp, Homo sapiens
  misc_feature 80: n = A,T,C or G
ctgaactgacaattaacagcccaatatctacaatcgaccaacaagtcattattaccctcactgtcaacccaacacaggcntgctcataaggaaaggttaaaaaaagtaaaaggaactcggtttaaaaaaaaaaaaaaaaaaaaaaa

SEQ ID NO: 21084 - DNA, 450 bp, Homo sapiens
  misc_feature 381, 414, 423: n = A,T,C or G
ggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagcccccgaattaataccaatagaagggcaatgcttttagattaaaatgaaggngacttaaacagcttaaagtttagtttaaaaagntgggagggngattaaaataattttggaaggccgatc

SEQ ID NO: 21085 - DNA, 410 bp, Homo sapiens
  misc_feature 14: n = A,T,C or G
aggaaaattttgcngttacatattacctctggaataactttgcctttgccgcgtgtgttactgtgtacactcagatatttttctcataatggcctttgccgtgtgtgttactgagtgagtacactcagatatttttctcataatggcatgagggaaatcagtctccttttcccattgtgtttgtcacttttgctgagacgcaaaaaataacgtgctatgatattgtgaaatatgtatttggtctttatccccaatccctgacatccagcggaatctgcagagttaagtgtcttttgtatgctcatgtgatgactggtggctgggggcccctagaaagtttcaggatagggcggatcctttgtggccaggagttccagatcagcctgggcaacatagtgagaccttgtctg

SEQ ID NO: 21086 - DNA, 359 bp, Homo sapiens
ctagtcctaaaaggtcttcacacagcagtcactccgtgtcctttactccttttgtaatacttaaattactggcaattttactttcaaactaaagtttgaacaccggaaagtcattactcagtgatttgtaatttgggacttggattatttatctagagatgtttgtatattttgtcagtaactaatactgcgctgccatcatggtgactgtcatggttctacagaaatgccctccatgtgtccctctaatgttgcatgtttcagtgggttggaagttttgtatatttattgtattaacacagagtgtcataaaataaaatgctgtttactggacaaaaaaaaaaaaaaaaaaaaaaaaa

SEQ ID NO: 21087 - DNA, 425 bp, Homo sapiens
attgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggcaaaaaaaaaaaaa

SEQ ID NO: 21088 - DNA, 386 bp, Homo sapiens
  misc_feature 22: n = A,T,C or G
aaaggctgttgaattcaaaatnaaacatttttctatgacatttagaatcattgtggtcttgagttgcttttaacagtcagtaccagactgcgccccggtggctcatgcctgtaatcccagcactttgggaggccaaggcaggcagatcgcttgaggtcacaaatttgagaccagcctggccaagatggcgaaaccccatgtctactaaaaatacaaaaattagccgggcgtagtggcacacacctgtagtcccaactactcaggagactgaggcaggagaatcgcttgaaccttgggaggcggaggttgcagtgagcccgagaattgtgccacttgccctccagcctgggtgacaggagactccatcccaaaaaaaaaaaaaaaaa

SEQ ID NO: 21089 - DNA, 450 bp, Homo sapiens
gagtcttgctaacataccacgtgtgagagaaatacatttggaaaacaataaactaaaaaaatcccttcaggattaccagagttgaaatacctccagataatcttccttcattctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttca

SEQ ID NO: 21090 - DNA, 195 bp, Homo sapiens
  misc_feature 18, 41, 44: n = A,T,C or G
acctacctgaaatcgtanttttggatattgggttaaaatantanttgttggcttgggcattggtggctcatctgtaatcccagcactttgggaggctgaggtgggcggatcatgacgtcaagaaatcgagaccatcctggccaacacggtgaaactccatctctagtaaaaaaaaaaaaaaaaaaaaaaaaaaaa

SEQ ID NO: 21091 - DNA, 450 bp, Homo sapiens
tattcaattctagcaatcccactcctgggtatctacgcaaaggaaaagaagttattatacaaaaaagacacttacacccatatgtttatagaagcaaaattcataattgcaaagatgtggaaccaacctaagtgcccattgactaatgagtggataaagaaaatgtagtatgtatacaccatggagtactactcacctattaaaataaatgaaataatgtctattgcagcatcttggatggatctggaggccattattctaagtgaagtagtacaggaaaaccaaaaactatatgttctcatttataagtgggagctaagctgtgagtaagcaaagtcacacagagtgatataatggactttaaggactcagaagggggagagtgggaggaggactaggaataaaaaattacacattaggtacaatgtatactacttaggtgaagggtac

SEQ ID NO: 21092 - DNA, 330 bp, Homo sapiens
  misc_feature 20: n = A,T,C or G
ctttttgaggaagacgcggncgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagcccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactcc

SEQ ID NO: 21093 - DNA, 340 bp, Homo sapiens
  misc_feature 14: n = A,T,C or G
aaaaattttaaatngttggatttttaagcttttttaaaagctgacattaaagtaaatctaaaaaaagtttaacaaactggccaagacactaatttttactgtataatcacaatattttatactcacctttattgactaaaaataattatgctacatgttgtcctgcatcagaagaattatttcttcttgccagtgttttgggatttgaagataatggttcactcaaagaacctattattttctctactgaggaacccaatgtagaacttgcactgatattttttattactgcctttatatgaatctataggtatctaaatggttaaggcatgtatgatct

SEQ ID NO: 21094 - DNA, 380 bp, Homo sapiens
  misc_feature 364: n = A,T,C or G
aggaaggagtgggatcaatgcatggagcattggtcttgaactcctagctgcaagcaatcctcccaccgtggcctcccagactactggggctttataggcatgagccactgcatccagtcaatgaatggaacctttggaagtctatgtttaaattgagtccagaattctcttccttagccatcaccaacctaagagggagaaagaactagaaaagagtgtatttgagccttggggcttagggtcataaggccctatagaggttaatttctccaagatcctgtgtcttgctcggtctcctccctgttcacatgctgagtctctcccctcctttcactctgacccaagatccagactcgtaatttgnggttttctaatatagc

SEQ ID NO: 21095 - DNA, 410 bp, Homo sapiens
  misc_feature 13: n = A,T,C or G
atcttcgggagancatccgcaaggaaaataccagccaaaatctttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggaataattttctcttctttaggcaatgatttaagttaggcaatttccagtatgttaagtaacacactta

SEQ ID NO: 21096 - DNA, 400 bp, Homo sapiens
  misc_feature 231: n = A,T,C or G
tagaactgtttgaattgcagccattcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgnatcgtgtttctacctttagtaccttgccactcttttaaaacgctgctgtcatttcccatttcttagtactaatgattcttttgattctccctctattatgtcttaattcactttccttcctaaatttgttatttgcatatcaaattctggtaaatggttttgtaaacat

SEQ ID NO: 21097 - DNA, 420 bp, Homo sapiens
  misc_feature 94, 127: n = A,T,C or G
ataacagcaaccttgaaaaaatagacttaaatgaatgcttctagaaacttccagcggctcacaaagaataagactgccttaaggctggcaacantctaagcctctaacagcacagggaagcaaatantcttaccaggcagcctatgaattaacccaaagaagctttggtttggttttggtggatttttatcatgccatgttggacatgagattttttagatcttccttcccacattgctagacgtctcactcaaagacatttgttgggagtcacatttgcatcatagatgagacagtccattcatcttagttaaattggattggagaatgccttttgtttccaggaaaatattgatcaccatgaaagaagatagtttttttggtccccagagacattcattttagttgatataatcctac

SEQ ID NO: 21098 - DNA, 460 bp, Homo sapiens
ggtgaacaacgaagcactaatggtcaaacactacaactaaagacacaagttttcaggagatttccagatgatgatgatgaaagtgaagatcacgatgatcctgacaatgctcatgagagcccagaacaagaaggagcagaagggcactttgaccttcattattatgaaaatcaagaatagcaagaaactatataggtatacacttacgacttcacaaaacctatacttaatatagtaaatctaagtaaacatgtattactcaaagtaatatatttagaattatgtattagtataagatcagaattgaatttaagttgttggtgacatctgcatcatttcataggattagaacttactcaaaataatgtaaatctttaaaaatataaattagaatgacaagtgggaatcataaattaaacgttaatgggttcttatgctctttttaaatatagaaatatca

SEQ ID NO: 21099 - DNA, 430 bp, Homo sapiens
  misc_feature 381, 386: n = A,T,C or G
aagcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtattgaatgtctaccgtgttgctaaccgaagtcactcttaattaatatctgtatcctggaacaatattttatggggtattgttttttctgnggggncaagttttcatagtatccatattttattactgggttattacttc

SEQ ID NO: 21100 - DNA, 410 bp, Homo sapiens
attcaaaggaatgaatgctttacacgttttggaaatgagtgcaaaccctcttgataataatgggatagagccaggggcatttgaaggggtgacggtgttccatatcagaattgcagaagcaaaactgacctcagttcctaaaggcttaccaccaactttattggagcttcacttagattataataaaatttcaacagtggaaccttgaggattttaaacgatacaaagaactacaaaggctgggcctaggaaacaacaaaatcacagatatcgaaaatgggagtcttgctaacataccacgtgtgagagaaatacatttggaaaacaataaactaaaaaaaatcccttcaggattaccaggagttgaaatacctccagataatcttccttcattctaattcaattgcaag

SEQ ID NO: 21101 - DNA, 400 bp, Homo sapiens
attagatagtgactaagccgccagaattgaggtggccattcctttttgtataggctaagaaacaggttatcagtgaaaagttaattatggctttggcactagaatagcactgttgcaaagtatttaagcaccccccatctcagccctttattttatctttcatgtgggctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatgtttcctacctaagcatctcccgagaaaaatatctcattaaaaagcccataaataatagggggagaagaaagc

SEQ ID NO: 21102 - DNA, 400 bp, Homo sapiens
  misc_feature 315: n = A,T,C or G
ctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaaggatggcaagaaaagctggcaacttctatgtacctgcagaacccaaattggcgtttgtcatcagaatcagaggtatnaattgggagtgagccccaaaggttcgaaaagggtgttgcagctttcttcgcccttcgtcaaatcttcaatggaacctttgtgaag

SEQ ID NO: 21103 - DNA, 150 bp, Homo sapiens
agatagcttagcttgttttctggtgctgttgacctgcaagagaatatacttttgcctatacaggtgaaagttttgcaatttatgtatacaaagaaattgtaggcattaaaaatattttattgaaaaaaaaaaaaaaaaaaaaaaaaaaaa

SEQ ID NO: 21104 - DNA, 480 bp, Homo sapiens
  misc_feature 14: n = A,T,C or G
caaaatcagcaganttgatgcagctagcctgaaggactgaataatttggctaagttgggattgagtttcaacagcatctctgctgttgacaatggctctctggccaacacgcctcatctgagggagcttcacttggacaacaacaagcttaccagagtacctggtgggcttggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgctaatgtcattgctaaaaaataaataaaagctagatactggaaacctaac

SEQ ID NO: 21105 - DNA, 400 bp, Homo sapiens
tgtgcaggctgtctcatttatttttagccttgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactggaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatg

SEQ ID NO: 21106 - DNA, 380 bp, Homo sapiens
atattaaaaatcttcaatgcttactaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaaaaaaaaaaaaaaaa

SEQ ID NO: 21107 - DNA, 500 bp, Homo sapiens
tatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtactttctgtttcctgccatgaaacccgaagacaagaaggagaatgtagcaaccactgatacactggaaagcaca

SEQ ID NO: 21108 - DNA, 350 bp, Homo sapiens
ggaaagatgaaaaattttaaccaagctaatatagcaaggactaacccctattaccttctgcataatgaattaactagaaataactttgcaaggagagccaaagctaagacccccgaaaccagacgagctacctaagaacagctaaaagagcacacccgtctatgtagcaaaatagtggggaagatttataggtaggaggcgacaaacctaccgagcctggtgatagcttggttgtccaagatagaatcttagttcaactttaaatttgcccacagaaccctctaaatccccttgtaaatttaacctgttagtccaaagaggaacagctctttggacactaggaaaaaacc

SEQ ID NO: 21109 - DNA, 360 bp, Homo sapiens
gatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcacctaaacgttttgtgccttggtctaatattaacatgatgtatgtgtaaactgacaaaaaaaaaa

SEQ ID NO: 21110 - DNA, 450 bp, Homo sapiens
agcgttctttcgcatgctggtggcaatccgtgttcagccaaaggcttgggaagacccctctgcagatctcactctttgttctgctccatcttctttgatactctgtcctacaaattctagctgcctccattcccctaaactctgatctctgtcacctcaacactgctacgccacgctgagtggctcatgtctgcaatcccaacactttgggaggcagaggcgggagaatcgtttgagcccatgagtttgaggccatcctgggcaatatggggatatctgatctctacaaaacattaaagaataagccaggcatggggggtgtgcgccttgtagtccaggctactcaggaggctgcagtgagaaggattgcttgagctcaggagcagaggttgcagtgagccaagatcgcaccactgcactcctgcctgggcaacagagtgagatcttgtc

SEQ ID NO: 21111 - DNA, 350 bp, Homo sapiens
aggcaaatttggccaatattactccttgaattttctgtgttggatttcctctaggatttcgccagttcctacaacgtgcagtagggcggcggtagctcttgtgtctgcggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctat

SEQ ID NO: 21112 - DNA, 560 bp, Homo sapiens
atacaataactactgctatatgttgtcattgtaataataatcatatttcttcctttgttgaattgctttcctgtagtaatcttattgtgatcatcctgaaacatagatttccgagcttcaagcaaacactattatgttgaaaaatctacattatttctaagtttagcagtgccagtggaaagtttattgaaatagaaaattacttttttaactgaggagtgtagattgtgaattcgtgattcatcttcttaggagatgatcggaatattgataaatattgatgcatagaatatgaacaaaacattacatatcttgtgctgtgatattaaagtagtattctgttctggtagtagtatggcagtattttaggtctgaaagatgtacataatctgtactttgaagtctgttttttaagaggttaatcacaagagatttacataaaacaactaaggttaaaaataaatggtggattagagatacatcaggcaaatttcaatttcaaaagcagatgacagaatctcagtatcagggtagcatttaaagcaaaaagcattaaactg

SEQ ID NO: 21113 - DNA, 175 bp, Homo sapiens
  misc_feature 25, 37: n = A,T,C or G
ctccttgctttacaagtagcttacnctcaatttagangttcctcacttactacttttgcatactggaatttactaaatgtgtaaattatcattttcttagttttgtaataccttttttatttgtgaataaaattatcacctggtattcttaaaaaaaaaaaaaaaaaaaaaaaaa

SEQ ID NO: 21114 - DNA, 320 bp, Homo sapiens
ttaaagtgagtatactgtggagaggacttccaaatgtggttacctcagctatatcactgcccaacaacagaaaacctgacggctatgattactatgccttttctaaagatcaatactataacattgatgtgcctagtagaacggcaagagcaattactactcgttctgggcagaccttatccaaagtctggtacaactgtccttagactgatgagcaaaggaggagtcaactaatgaagaaatgaataataaattttgacactgaaaaacattttattggtaaagaatattgacaaaaaaaaaaaaaaaaaaaaaaaaaa

SEQ ID NO: 21115 - DNA, 345 bp, Homo sapiens
ataggtttggtcctagcctttctattagctcctagtaagattacacatgcaagcatccccattccagtgagttcaccctctaaatcaccacgatcaaaagggacaagcatcaagcacgcaacaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaaaaaaaaaaaaaaaaaaaaaaaaaaaa

SEQ ID NO: 21116 - DNA, 388 bp, Homo sapiens
  misc_feature 11, 21: n = A,T,C or G
gtccaagtatngatcgcgagnaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttct

SEQ ID NO: 21117 - DNA, 110 bp, Homo sapiens
  misc_feature 7, 15, 76, 82, 91, 93: n = A,T,C or G
ttagccngacatggngggcaggtgcctgtaattccagctattcgggaggctgaggcaggagaattgcttgaacccntgaggnggttacagngngccgaaatcatgccact

SEQ ID NO: 21118 - DNA, 243 bp, Homo sapiens
  misc_feature 128, 174, 232: n = A,T,C or G
aaacagtacggcattgtcagcttcaccatgtaacccgtgaaaaaaggggaggagccctggacatcttatccgtgtccaccccttcaggacacaggtacggtgacatatctagaaagtctcgcccaggnagaaaaccccgtctctactaaaaatacaaaattagctgggcgtggnggcctgccctgtaatccccagctacttcagggagggctgaagcagggaggaaatcccnttggaaccctg

SEQ ID NO: 21119 - DNA, 400 bp, Homo sapiens
aatcataaacagttccaacaaatttaaaagtattgaaatcatagagtatgtcctccacccataatgaaattaaattagaaataaataacagctatttgagaaatctccaaatatttaggaattaagcaatagacgactaaacaacacatgggtcaggagaagaaatcacaagagaacttaaaaaatattttgaactgaataaaaatgaaaacatatcaaaagtgtgggatgtagatgtagctacagcagtgtctcaagggaaatgtaaaatatttaaatgtttatattaggaaaatagggaaaggtctaaaattagcaatctaagatactgcctgaaaaaatcaagacacggaagacaaattaaacccaaagaaaacagaagggagaaaataacaaagac

SEQ ID NO: 21120 - DNA, 298 bp, Homo sapiens
  misc_feature 289: n = A,T,C or G
catggaacacaaagtctcccactgtactctgcactgtccactcattatgtatgtacttatttctgtcttgtttttaaaacatctaatgtgaggcttgtatacctttaacatagcaagtaattttaatttaaaaatatgtaggaaaaattaagaaacactaacatggagtaaattgttggggggacaaaatgaatgctgtgaaatgccatacatatgctggaagtggaccacaaattaagctctaaggtttaggaagaaaatgacaatcagtaaccaagacccagggtgnttgtaagtt

SEQ ID NO: 21121 - DNA, 276 bp, Homo sapiens
  misc_feature 77, 87, 183, 235, 244, 265: n = A,T,C or G
attatgggccggggtatcaaagggacaagcatcaagccacgcagcaaatgcagctcaaaacggcttagccctagccncacccccacnggggaaacagcagttgatttaacctttaggcaataaacgaaagttttaactaaagcctattactaaacccccaggggtttgggtcaaatttttcgnggcccagcccccccgggggtccccccgattttaaccccaggtcaatagaaanccgggggtnaaagaaggggttttaagatcncccccccttcc

SEQ ID NO: 21122 - DNA, 143 bp, Homo sapiens
  misc_feature 22, 32, 40, 54, 57, 59, 67, 71, 76, 77, 100, 110: n = A,T,C or G
ccttatggcccggggtaacggnaaccaataanaaaaggtnccatacagggctcntgngnccatctanttanatatnnccacatagggcctatctctcacncgctggtagnacaaggcaataccagagagagagtcatgaggat

SEQ ID NO: 21123 - DNA, 150 bp, Homo sapiens
  misc_feature 27, 28, 34, 79: n = A,T,C or G
accatatgaagaccacaaaacaagtcnnattagntttaagaaaatcaaaattatatcaagtatcttcttagaccacagnggaataaaactggaaatcaactccagaaagtaccctcaaaactatacaattatgtggaaattaaattaatc

SEQ ID NO: 21124 - DNA, 105 bp, Homo sapiens
  misc_feature 2, 14, 37, 39, 85, 87, 91, 100: n = A,T,C or G
gnagtggcacagtnctctcctattatgtgggctcggngncttccaagggcacaggccttcaccgctatgtgctggctgggtacanancagnacaggccgntcaag

SEQ ID NO: 21125 - DNA, 367 bp, Homo sapiens
  misc_feature 12, 15: n = A,T,C or G
gaataaaatagnagnagaaataaacttaaccaaatgcagggcatatacactgaaaaccctgaaacattgttaaaaaaaaattaaagaatacctaagtaaagggaaagacattttgacttcatgcattaattagaaggcttaatattattaaaatgacaatactctccaaactgacctatagattcactgtgatatctatcaaaattctagctgccctttttgcagaaatggaccagctgaacctaaaattccggtggggaagcaaaggacctcaaatagccaaaacaaccttgaagaacagcaaagttggagaactcacactttccaatttcaaagcttacctcaaatctatagtaattaaaacagg

SEQ ID NO: 21126 - DNA, 100 bp, Homo sapiens
ctctttttatgttgaggctgctgttacccggcatgccttcattttgctatggggggcacgcgggggggctggaatttaagcagaaacaacatagccgggg

SEQ ID NO: 21127 - DNA, 236 bp, Homo sapiens
  misc_feature 48, 57, 60, 124, 144, 160, 166, 207, 223: n = A,T,C or G
taattacattgaaattaaacaagttgctcctgaaggacttttggttanacaacgaanttnaggcagaaatcaaaaaaaagtatttgaaattaatgaaaacagaggcacagcataccagagtctntgggatgcagctgaagcagngttaagaggaaagatngtcgtnctaaacacccacatcaagaaggaagagctcatgattaacantctaacgtcacatctngaggaactagaat

SEQ ID NO: 21128 - DNA, 257 bp, Homo sapiens
gtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgtatatgtttctgtgcatgttctctacacaattgtaaggtgtcacctgtatttaactgttgcacttgtcaactttcaataaagcatataaatgttggt

SEQ ID NO: 21129 - DNA, 377 bp, Homo sapiens
ggagacgcagtctgccttccttcccaatttaacagtgcccaattcctgtgtcacctgggattttcctcctcaaccaggtgaaggaaaatggaagctggaaaacctgccctttcccatcttctgagcttggaggcaagcacagaggctcttttctctttaaaagtttttactccttgtcatttggaaaatagacaaggggaaattataaaagcttcagaaaacttgttaatatcctggacatttcttgccaaggcttcttcctatacatatacacaaaaatatgttttatgggaaatgggaattacagaaacttgctctaaagaaaaattgctggattaagggatgtgaatattttagcagtgcttgacacttagcca

SEQ ID NO: 21130 - DNA, 387 bp, Homo sapiens
  misc_feature 386: n = A,T,C or G
cttgactgagtaaattggaacatcgatcagttaaaaaggctggcattgaggtccaggaaatcaaagcagattctgaacacaaactcgagacgagttcaggaagagtacttgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaaagatttacccagaatgtcagattcctttccctttagcacgtttaaagttctgtgnt

SEQ ID NO: 21131 - DNA, 142 bp, Homo sapiens
  misc_feature 6: n = A,T,C or G
gacagnaagtacctagggctataggtgcaaagccaaaagaccttaccccctccagatgagaaggaaaaagcataagaattctggcatcatgaaaatcgaaatgttgtgacaacatcaaaggatcactctagctcctgaaccc

SEQ ID NO: 21132 - DNA, 386 bp, Homo sapiens
  misc_feature 46, 373: n = A,T,C or G
gacctattctttggaaataacccataggatccagtagccttctagnagcaatattcttgtatttatatcataaatgtatttccaggattcacaggtgtttagattaattccacgcagtgcagagaccatcccacagtactagaaaatgggttgttccaccctgttctaagaatagcataggatttggaggtagagggcctgaattcaagtcctagctctgcttttactgatagtgtgacctcagtcattttactttccctctctaagtctcagattcgtcattggccaaataagggaaaaaagtacaaccatcacatagatcattctaagaacaaaattaaattagtggttgggaaaatggctttgtaaaagngttaaaactctac

SEQ ID NO: 21133 - DNA, 386 bp, Homo sapiens
  misc_feature 82, 86, 94, 118, 162, 204, 216, 223, 243, 252, 268, 280,295, 335, 336: n = A,T,C or G
catgctgtacatactttttgggtttatttggaaaggaatgcaaagatgaaggtctggtttgtgtacttttaagactttggtnattntacttttnggcaaaagaataaaccaaggaatngattgggcacatcatttcaagaagtcccctctcctccacattgntttgccaatttgcacattaaatgactcttccctcaaatgtgnactatggggtanaaggggnagggtttaaagatgtagacngttgagggnttttaagggccctttntcaataactggnacactctataacaanggataccttatttaaatagatgacattgactattttttgnntttattaaaaggaagcttacatgcctaccaatatttaatcttttatgatt

SEQ ID NO: 21134 - DNA, 371 bp, Homo sapiens
  misc_feature 13: n = A,T,C or G
agtcttgcctagnaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagcctttgggccatgtagcattttaagac

SEQ ID NO: 21135 - DNA, 267 bp, Homo sapiens
gaaacaaaataagtgagcagaaacctctcctgaagaaaagtagctgggagattaccagacaaagaccttaaaacaactgtcttaaagatgcctaaagagctaaaggaagacatggacaaatacaggaaaataatgtatgaaccaaacgagactatcaataaagagaaaatataaaaaggaactaaaaggaaattctggagctaagaactttaataactgaaatgaaaaagaaactagatgcttcaaaaaagatttaatctggcagac

SEQ ID NO: 21136 - DNA, 273 bp, Homo sapiens
gtactgggaccgggcacaatcctagcgctttgggaggccaaggtgggcggatcacctgaggttgggagttcgagaccagcctggccaacatggagaaatgctgtctctactgaaaatgcaaaattggccgagtgtggtggtacatggcctgtgatcccagttactagggaggctgaggcgggggaatcgcttgaacctgggaggcggaggttgtgatgagccgagatcgcgccattgcactccagcctgggccacaagagtgaaactccatct

SEQ ID NO: 21137 - DNA, 227 bp, Homo sapiens
  misc_feature 205: n = A,T,C or G
ggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgangacttagaagagtagcatgaga

SEQ ID NO: 21138 - DNA, 375 bp, Homo sapiens
cacttaccctagttcttataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaaactttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatcctaaaggtatacaaaatct

SEQ ID NO: 21139 - DNA, 100 bp, Homo sapiens
  misc_feature 5, 13: n = A,T,C or G
gcttnctcatccngggactcacacggtcgctttggagaagaggttgtacacatctttgtatacatgcaatgaggacctgcccatttcaaccggtaaaagc

SEQ ID NO: 21140 - DNA, 133 bp, Homo sapiens
  misc_feature 10, 15, 55, 77, 91, 99, 118, 120: n = A,T,C or G
cagataaccnagctnccttttggcttggttaattaacttctgtgagcttctgttncctttaccttttattgttttcnaaatatcatcgaangcacttantacagtctctagcacatgncncatgaaggtcatg

SEQ ID NO: 21141 - DNA, 376 bp, Homo sapiens
  misc_feature 117, 126, 162: n = A,T,C or G
ggaggggaagatggtcagtaggacagaaggtaacattgatgactcgctcattggtggaaatgcctccgctgaaggccccgagggcgaaggtaccgaaagcacagtaatcactggtgncgatattgncatgaaccatcacctgcaggaaacaagtttcacaanagaagcctacaagaagtacatcaaagattacatgaaatcaatcgaagggaaacttgaagaacagagaccagaaagagtaaaaccttttatgacaggggctgcagaacaaatcaagcacatccttgctaatttcaaaaactaccagttctttattggtgaaaacatgaatccagatggcattggttgctctattggactaccgtgaggatggggg

SEQ ID NO: 21142 - DNA, 356 bp, Homo sapiens
  misc_feature 181: n = A,T,C or G
atcaaagtagtcttcgacaataaattcccatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggngggattttttgtttgttttgttttgtttgttgtttgttgtttgtttttttgccactaattttagtattcattctgcattgctagataaaaagctgaagttactttatgtttgtctttttaatgcttcattcaatattgacatttgtagttgagcggggggttttgggttgctttg

SEQ ID NO: 21143 - DNA, 373 bp, Homo sapiens
  misc_feature 60, 196, 206, 264, 292: n = A,T,C or G
atgataaatactttttgaattaattcatattccatctctgcaaatatagagcctgtgttnaatcctttctccatagtcctcttttatattctgggaaaaagagacaatatgccctctctaaggcgctagctctctttgaaatgacggtgttataataatcctccgtatgtctaatctcccaagattcttactgggngcatctctgnttataaatgagaaagcagcatcaaacaggtagcattccccaaaggcacacagcaaggntggagctgggatatgaacccagatttgnctgagtccaaagagagcaagttgacatttactgctctccccaacgctttccctaaagacatattcacttcactctccctta

SEQ ID NO: 21144 - DNA, 317 bp, Homo sapiens
ataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggggggtgtcaataaacgctctgtggccagtgtaaaaga

SEQ ID NO: 21145 - DNA, 128 bp, Homo sapiens
  misc_feature 8, 16, 43, 76, 79, 88: n = A,T,C or G
agggaagntttttttnaattttttattttgttaaagatggagnaatcctacccacttcagcctcctgagtagctangantacagaggngagccacagcacctggcatgggataggtaaacatttttta

SEQ ID NO: 21146 - DNA, 170 bp, Homo sapiens
  misc_feature 7, 34, 35: n = A,T,C or G
gacttgntacaagacactctaaggcgaagaaaanncgaacatcactatctttcatgactataggttcaaaaattggaagacaagaagtttggctattcatggctgacagtggtttaaaaggatactcttgtgatgacctaattagagttgctcccagagaagcaaaagtt

SEQ ID NO: 21147 - DNA, 260 bp, Homo sapiens
  misc_feature 31, 32, 59, 145, 153, 192, 243, 258: n = A,T,C or G
tgaaagataggagtacaacacaagctacttnnaaaatatagctcactagggttcatganatgttgcttagcgtttagtggataccaatcagtattcccatgcttatatatttgccagagtaatgatacgaccgacttatgaatcngcaggcgncggacaacataaacactggagttacaaaacagggtcctnggggcacagcagggaatgcgtgagattaggactagcaaacactttggccangagcactataagccnta

SEQ ID NO: 21148 - DNA, 372 bp, Homo sapiens
  misc_feature 328, 359, 361: n = A,T,C or G
gaaatagttaccattttttcctgatctgtctcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctacccgggtgctgtattcagcaacacctgttttactatttgttattaaactatcatctccaccttccttttgattagcaatttgtactaagaaacgaaacaatgttatttgggggggngtataattctacttttctagtagattactgngnggaattctgtg

SEQ ID NO: 21149 - DNA, 248 bp, Homo sapiens
ggaaaaagcaaatgagtgtttatgagatttctaatcagttgatcctctgtgtatgccagaattcttggcatggaagaaagaagatacagatgtaatatagtagatgttaaatagaaactctataatattgggccaggtgtaagtggctcatgtctgtaatccctgcaccttgggaggctgaggtgggaggattgtctgaggcccggagtttgagaccagcctgggcaacagagtgagaccctgtatct

SEQ ID NO: 21150 - DNA, 321 bp, Homo sapiens
taaaaaataaacaaacaacaacaacaaaaaaacatgaggtcttgtccgggcacagtggctcacgcctgtaatccaacactttgggaggccaaggtgggtggatcataaggtcaggagatcgagaacatcttggccaacatggtgaaaccccgtctctactaaaaatacaaaaattagctgggtgtggtggcgcacgcctgtagtcccagcaactctggaggctgaggcaggagaatcgcttgaacccaggaggtggaggttacggtgagccaagattgtgccactgcactccagcctggactacaagagtgaaactctgtc

SEQ ID NO: 21151 - DNA, 370 bp, Homo sapiens
  misc_feature 11, 21, 99, 202, 206, 368: n = A,T,C or G
agtgataaatntaatactagnacaaaattgtcttctctttcaaccgagccatatatatgtctgtatatatgggacctactgcttctctgaggaaatgcntaatctgttaatatcagacaaaatgagcaattggcagtgctcataatatattccaatttttattggaattttcgatggaatgttatttcaataaagccatgtnaggngaaactttgataactttttactcttcaagttagggtaaattctgatccaatattcaattcatttgtgtactcccacatgcaaaatgctaaattacaatgcagacattaagaaaaagtattgactggagggggttgaattccttgagaatttatttttatagnct

SEQ ID NO: 21152 - DNA, 294 bp, Homo sapiens
atgtttacatttccaaattcgctggggataaaggctacttaacaaaggaggacctgagagtactcatggaaaaggagttccctggatttttggaaaatcaaaaagaccctctggctgtggacaaaataatgaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccta

SEQ ID NO: 21153 - DNA, 368 bp, Homo sapiens
gacatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggct

SEQ ID NO: 21154 - DNA, 100 bp, Homo sapiens
  misc_feature 6, 27, 31, 41, 62, 83, 88, 90, 99: n = A,T,C or G
aatagnatttcaataaataattacttntgtnattctctctnacagaggcagggaatcagaanctgaagactctataacaatanaaccngnggaatatgng

SEQ ID NO: 21155 - DNA, 295 bp, Homo sapiens
  misc_feature 6: n = A,T,C or G
gaaaanaaggaaagatggttaaacattttcccactcattctgaattaattaatttggagcacaaaattcaaagcatggacatttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaaggaaagctgtgtttatatggaagaaagtaaggtgcttggagtttacctggcttatttaatatgcttataacctagtt

SEQ ID NO: 21156 - DNA, 123 bp, Homo sapiens
  misc_feature 19: n = A,T,C or G
tagtcccagctactcaggnaggctggggcaggtgaatggcatgaacgcaggaggcagagcttgcagtgagctgagatcgcgccactgcactgcagcctgggcaacagagtgagactccatctc

SEQ ID NO: 21157 - DNA, 120 bp, Homo sapiens
  misc_feature 15: n = A,T,C or G
ctttctcttgtcttnggcttgaactttggatctccatgtcttttgtaactaaaaacagtgtaaatggaaaaataaacgatgtaatatgttgtaataaatcagctatatttggacttaatg

SEQ ID NO: 21158 - DNA, 340 bp, Homo sapiens
  misc_feature 19, 20, 338, 340: n = A,T,C or G
ggggaagaccccctaaagnngtggcatctgagttcatcctttaaagaaagaaggagtggtcaaggaggcagctgagtacaggtgctcctggccaaatgtgcaaaggcagagtgagagagagcaggcccaggtgagtcacctgtaggtagtttgtgaagttggaacaaagtctgggacctacctcctatcactacactattcctgaggctgtgaggagccactgaagcgaggaagacaccatcagatttgtgtcttggaaagactacagtccagcacagtgttttccaaagcacctttatcagaataacctgggaagcttgtcaaaatgcatgttccanan

SEQ ID NO: 21159 - DNA, 101 bp, Homo sapiens
  misc_feature 12, 33, 43, 62: n = A,T,C or G
gaacaccaaaangcttcttattcgggtgtgagncttttcagcnacccggtccagtactgggngatacagccatccaccttcagatgtgtctacgtgcgctc

SEQ ID NO: 21160 - DNA, 389 bp, Homo sapiens
  misc_feature 6, 8, 31, 45, 63: n = A,T,C or G
cagttnanacgtgacaagtagcttctcagangcacagattttaanaactcaatttagtgaganctaaaaattttctttaaagtataaaaactgtggctcacacctgtaatcccagcattttgagaggctaaggtgggaggattgcttgaggccaggagtttgagaccaggctgggcagcatggtgagaccctgtgtctgcaaaaaaaataaattaaaaaaataggtggacattgtggcatgctgctgtagtcctagctacttgggaggctgaggtggggagggtcaccttgagcccgggaaatcaaggctgcagtgagctgtgtgaagccactgcatcccagcctgggtgacagagtgaggccctggctcaaaagtaaaataaataaat

SEQ ID NO: 21161 - DNA, 230 bp, Homo sapiens
  misc_feature 13: n = A,T,C or G
gcatttatgtggngtaatcaaacccgatgctttcagatgacctacttacatcttcaatgtggataagataaagaacaaaacacatgcgtctaaactgctgggcaatccagttgacttttaaatgtaagaatggaattccaaacacttaacacattcagctatatgacagaaagtaaatctatggatatggtattttgtgaatgatcttttaaataaaagaaaaccttacg

SEQ ID NO: 21162 - DNA, 354 bp, Homo sapiens
  misc_feature 8, 9: n = A,T,C or G
ggtcatcnntagggcttaaattaaatgctgaagctgtcactcaaagagtttacactaaaatcttcagggctttaaataaaaggttaagtccagcttccaaacacaattttccacattagcagctccaatcttcttaaataaagctctgttttcctatatttttatgactgctgagaccccacagggaccaatatttgtattcaaattacatttcatggtttcccattgtttcacaatgagttctaataaatgggatttactataataatccaagtatgacatagccggtatgctttcatgaatgtttttatggtaagattttcctcccatgaacatgagtaaataaatctgttt

SEQ ID NO: 21163 - DNA, 376 bp, Homo sapiens
gggatcactgctgatttaacttatcttgccatgaaagcattctgttcctctttcccatgcttggtaatatatccttttggaagaaacactcttgccaaaagagaatggcattattacatccaagggaaatattatttgcccaagagtgtaaaaatgtatgaaagaaatatgtaaataaaatcctatatgtaaaatctaataatatcaaagtttaatgatgaaatttgtcaagatgattataaaatatcacagttaaactgtatattatattcatgtttcttgccatttgtatgctaaaaacttataatgatttgaatgtacaaaatcaaaaatcgggagaaaagaagatagatcaaagcctattaccaataattta

SEQ ID NO: 21164 - DNA, 356 bp, Homo sapiens
  misc_feature 353, 354: n = A,T,C or G
ggagtctgtcttggataattatgattagacagaccgtcctccaggaaagaaggaacagctgggaccaaggcacggaggtgagaatgacgtgcccaacaataaggagacaccatccatgtggcatgggaagaaataatgagacattataaccccatgtctttagtcctgaaatctgttctgagcatcagtctacccagctgacctcagcatgctaccaatatcatcatatcccttgttatgtgattaccagtctttccatggagaggcaagtttagtcttattccaggaatgtttggcattactggacatccgaagtagctgaatccaaagtgctttgagtggaggacaggccnnga

SEQ ID NO: 21165 - DNA, 160 bp, Homo sapiens
  misc_feature 3, 22, 23, 33, 41: n = A,T,C or G
ganggtaaatacccctgagtanntttacacccntagagtcntgcgaagggtggggaggaagagtgtgggtttttatccttttgggttgaacctgatgccatacaactcaccactctatgatcttaaaagcaaaacagaaagagaatgagagaaagaaagg

SEQ ID NO: 21166 - DNA, 371 bp, Homo sapiens
gatttgacttgagtactgacaagcacactacatgacctatccaatttaaaatgtttggtttctaaaagattaagaaatgagccaaaaatcagatgaaagtaaacaaaagatttgcatgacctgaatctgtaaatctctaaggctatacacaaaattttatttttctacacaaaaggatacacagctttaatgaggttcccaacaactatggcgtccaaataaatttacataccactgataaaatgtacaataggcctgaagggtggttaagaacttcttgggggtaaataacaaaaatctctatataaatccacctcttttaacatttgtcttcactggccacagcctatttcatctaccttttctagaca

SEQ ID NO: 21167 - DNA, 225 bp, Homo sapiens
cttccatgttttatgcaaaaacagacatttaaatcaataaataattgtgccctagactgaaggttaatgtttaggagaggaaaaaaattgttggaattttttctacatttttttgtgaagaatcttttttggaaaggaaggatacatatttttgttgtgtaatattttctatttttgaatgcattttattggtacaagactgtttttttggtgaagacattattt

SEQ ID NO: 21168 - DNA, 371 bp, Homo sapiens
gatatttaaaggggaaaagcaggctggaggggaaagagggagggtatgctaatccacctgttgcaagagaaaaggagcaggtaggggaacagtcaactacgtattcctctggtgctcagaaaatcggcaccttacataagataggatgaaggcagagtagctacctgtggagatatggaaccttttatctatagctatctgcttaggaagagaaggaaaggcagtttcttgtatgactcagctttcagcttaattttttgcctttggcatagtgaactggggtcccgacttctttttttttcttcctctcacagatacaaaaagaaggttggagaaaaagaattagcctttagtcttgcccattttaaatt

SEQ ID NO: 21169 - DNA, 395 bp, Homo sapiens
  misc_feature 377: n = A,T,C or G
ggccgggatatttccaccagaggaaggaccaggcaaaagggagaataaattcacttttttaagataatgcttctgagttttagcacagcatcccacttcccgggaagctttattgccaaggcaataaggagaccatgtgagtaggagttaaatgcacagccatttgtgaagtgagactgcttgggttcagatcttgattctgccctttattctatgttgtggaatatattacattgtgctgtgcctcttttaccttatttgtaaaatagagcaagcacccaactcaagcagttgttgcaagaactgcctgctatgctgtttaatacagtatgtggcaaatagcaagtgggtagtaaatgttaataatacctgggttnggattctcattttacata

SEQ ID NO: 21170 - DNA, 297 bp, Homo sapiens
cagctcataaagtggtgtcttcctttaggacagatagcatttaatagttttcaaaggtcaggttgggtcagtagtaggagtggtgatttcactgcctctgaccctgggaagaagttactgctggcccttgaaattccagttctgctggaggaaaactggaagatgggtttgctaggctggctgtgtagaaatgaatattgtgggcttgtttccttgccactagtttgtaagaatatgtcaactcttttctgctacaaagaaggatgtctgctctgtgtgtgtgtgtgtgtgtgtgtg

SEQ ID NO: 21171 - DNA, 372 bp, Homo sapiens
  misc_feature 29: n = A,T,C or G
agcttagagttcttctttctttcttaagnccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtagggaaagtcacccaaacacttctgctttcacttaagtgtctggcccgcaatactgtaggaacaagcatgatcttgttactgtgatattttaaat

SEQ ID NO: 21172 - DNA, 380 bp, Homo sapiens
  misc_feature 377: n = A,T,C or G
gttcaaaaaactgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgccctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgtgtaaaggaacttaagtatttggggttaatattaaccttgnatc

SEQ ID NO: 21173 - DNA, 400 bp, Homo sapiens
aaaagcgcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcaggga

SEQ ID NO: 21174 - DNA, 372 bp, Homo sapiens
  misc_feature 2, 13: n = A,T,C or G
tntggccgggganttattatattgatcagtcaagagatacttattgagtactgtgagggactgtaagaaacactgaagaggtacaagatactaagagtcaagagtcaaaaatataattagaccaaagttgtaacacagtgcttctgttcttactactaaatgatatattgtctgcaaaggtttataaagataatcttggtgtctcttagtacatagatttatcatataggaagaatggaaaagagtgggaaaatattataatttaatttaataatataattcaatgaatggttatggcttctaccaaggatagtcaatatattcttcacagagcatctcgtttcatccttagaaacaagcagtgtctttcag

SEQ ID NO: 21175 - DNA, 265 bp, Homo sapiens
gttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaacca

SEQ ID NO: 21176 - DNA, 363 bp, Homo sapiens
  misc_feature 24: n = A,T,C or G
gcctcaggccagcagcaacgcggnggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgc

SEQ ID NO: 21177 - DNA, 275 bp, Homo sapiens
  misc_feature 266, 275: n = A,T,C or G
gtaagttacctaccttgtgatccttaactcctaaatacttgagcttggaaaaccctgcaaattttacacttttagcttacttggcttgtctggaatgaagtgctaggaagagtggcttggtttgcttttcaacaaatagtatgaatataaaaaaaatctaagatagtcatcaagcttttaaatatacaaacaatccagaaatcgaggcagagcggttttcctgtttaggttctagaagatatggtagggttttttttttttttccnttgggcccn

SEQ ID NO: 21178 - DNA, 214 bp, Homo sapiens
  misc_feature 23, 24, 62, 198: n = A,T,C or G
taagattttatctttgataactnnaatagaatgtggctcagttctggtccttcaagcctgtntggtttggattttcagtaggggacagttgatgtggggtcaatctctttggtacacaggaagctttataaaatttcattcacgaatctcttattttgggaagctgttttgcgtatgagaagaacactgttgaaatanggaactaaagctttat

SEQ ID NO: 21179 - DNA, 308 bp, Homo sapiens
  misc_feature 20, 26, 27, 30, 32, 47, 64, 100, 137, 183, 228, 254, 255,288, 305: n = A,T,C or G
ttgtgttcttacatgcactngtactnnacngntgcgccatgctaccncgatgtggcactgtggncccccacaatggcacaataaagcccctttgtgaaantgttctttaaatgaaacacaagaaattggccactggnaaaactctgcagcttcaactgtgcttcatttaatgccattaatgcnaatatacttccttttctttttgcgtggttttgcccacctctgccntagtgataatctgatgctgaagatcnnataaccaatataaagcatatttcttggccttgntccacaggacataggcnagc

SEQ ID NO: 21180 - DNA, 336 bp, Homo sapiens
  misc_feature 19, 24, 27, 32, 78, 91, 108, 150, 179, 228, 232, 255, 292,298, 301, 318: n = A,T,C or G
cagtttattccagtatcanccagnggngcagnccacaccaggactgtgttgaagggtgttttttttcttttaaatgtnatacctcctcatnttttcttcttacacagngtctgagaacatttacattatagataagtagtacatgggggntaacttctacttttaggaggactactctnttctgacaggcctagactggtcttctacactaagacaccatgaaggagnatgngctcctattattcctggctttgngctctgccgaacccttctttagcccttcacacatcgngctggngantatgatgctgaagggtntgggggacacagatgatg

SEQ ID NO: 21181 - DNA, 100 bp, Homo sapiens
  misc_feature 19, 21, 33, 38, 60, 79, 85: n = A,T,C or G
aaagttcgattctatagtncnccggggcccagnacttntccataaatcctataagctganttacaatgaggggagccanagactnaacacttttttgggg

SEQ ID NO: 21182 - DNA, 100 bp, Homo sapiens
  misc_feature 14, 22, 34, 41, 43, 45, 46, 49, 57, 65, 77, 80, 89: n = A,T,C or G
aaaacaggtgtgtnttttcttnttttaattggcncaccttntncnntanatctgtgncttgcacnaaacaaattggnggnagccctganattttctggtc

SEQ ID NO: 21183 - DNA, 135 bp, Homo sapiens
  misc_feature 4, 20, 35, 38, 43, 57, 83, 84, 87, 93, 94, 98, 107, 126: n = A,T,C or G
attngctaagatgagcaganggaggaaaacggtanaanacganacaaagttcatctntatatgtgtgagaacggtgcgcgacnnttncaaagnntatnatttaaaangctccaaataactggcttnttcaagaga

SEQ ID NO: 21184 - DNA, 397 bp, Homo sapiens
  misc_feature 51, 127, 169, 170, 171, 174, 241, 285, 286, 302: n = A,T,C or G
atttctgtgcccttaaacccatttagaaaataactacaaagtaaaaatgtngaggaaatagaaatgtattttttcatgaacattttgatacaaatttcatcatttaatgattcaccaatttcttgcnttaatttgaatttaagcttttaattcaaagagaggggagcannnatnattgatacatgtgggcttttaaaaactccatcctttataaatagtcaaggtttgggccacacaaagnatatttttatcatggaaaaatttcaactcctcaagccgtaatgnngaacagaattggagtnttttctttataatttcttgaacaggcgaatgaaagcttattatagaatgcgtggattttcttttatctttggaacatcagccccaggatattgct

SEQ ID NO: 21185 - DNA, 350 bp, Homo sapiens
  misc_feature 44, 263, 323: n = A,T,C or G
caggcattggcctcctcgtggccatcttccacaagtactccggnagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagcccctcaagggctgaaaataaanggggaaagatggagacaccctctggggggtcctctctgagtcaaatccaggggggggggnaatttgtacaataaattttttttgggc

SEQ ID NO: 21186 - DNA, 398 bp, Homo sapiens
  misc_feature 2, 5, 31, 153, 197, 200, 268, 283, 310, 343, 354, 359, 374: n = A,T,C or G
anagnattctgagactatccccatgaaaatntttccagtcaagtaaattgctataaaggactctggatataggttaataaattatataaagtttatcgctagaatagtaattcaacaactaattcagaattcaactaaagttttttaaataangggctgtcttcaaagaagttacttattttttgttcttaaaaccngtnaaataacaaggaatcaagaaagaaatgctgtaaacaaatgttgtaattatttctgagataattgcagncaaggaaaacacctntgcaatacagaatgtatccaaatagtntatatcctaaacacactaaacaatagtggtggnaaacctaatanggggnaataagattaggatntagggaacattgctggctttaatt

SEQ ID NO: 21187 - DNA, 383 bp, Homo sapiens
  misc_feature 4, 34, 38, 55, 80, 114, 163, 200, 203, 334: n = A,T,C or G
aatnccaaattgctgaagcgcccagttttatgtnatantgagaaaatactgcctnaaattgtaaaatttgtaaagtatanagtatataaagtagatactaaatacagacacttntatgttttgttgaagctattgactgtacaattaaacattttcaaaaggngtaatttatttaaaattgtctcattttggtaaaattntangggaacttttaaagctaaatattaaacttaatatgctatgtaaatatatacatatatacatttaatgatgtatttttttaaaacattggcttgctttttgttaaagtgcaagtgttacatatggctttgtncattaaagttgaaagggggtttacattttccattaaaaggactttttct

SEQ ID NO: 21188 - DNA, 201 bp, Homo sapiens
  misc_feature 18, 88, 133, 139, 175, 176, 182: n = A,T,C or G
aattttacccacagtttntgggacaaaaaccaaggaatctctatggtgatcagccttcaggcctcctgaagactatctcttacagtgncctattctcatgctgaggagcctgaagtccctgtgtgaggattangacagngggattgttattgtgtgtaggagaaccagcttaatnnggctgnccatgtctgaacttattgc

SEQ ID NO: 21189 - DNA, 226 bp, Homo sapiens
gcgcatttcgttcttttgctttgtctgtgtattagctctttccattctttgcccccagcatgagttaactcgcgtggactctgcagtgcgagtagtgaccccagcataccttgtcctctggacctcctgtcttctctgcttctgggtgcatggtagactttgtggcatttgatacaacttggacaatacctagtttggagggaggggaatggaaagggggcattgg

SEQ ID NO: 21190 - DNA, 177 bp, Homo sapiens
  misc_feature 24, 174, 176: n = A,T,C or G
tagagaataaggagcctttcttancggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagngng

SEQ ID NO: 21191 - DNA, 398 bp, Homo sapiens
  misc_feature 2, 26, 180: n = A,T,C or G
tnagatggacactctggactgctacntggggacatgggacggcagttacctctgatcacttgcgtggattctcccggagcagaacgacagaagccgccagtcattcgcccagatctacagctggaattctgtgctgaagagaccaaccctcagagtcaggacctgtctgtctctcggggnctaaaaactctttttaatttggatctgggagaatgtctgagcaaggaggactgactccgaccatactggaagaagggcagacggagccagagtctgccccagaaaatggcatcctcaagtcagaaagtctggatgaggaggagaagctggaactgcagcggcgactggcggctcagaaccaagagaggagaaaatccaagtcaggagcaggcaaaggg

SEQ ID NO: 21192 - DNA, 100 bp, Homo sapiens
  misc_feature 9, 18, 27, 43, 58, 77, 80, 83, 89, 96: n = A,T,C or G
tgggccacncgggccttntgtggcaancccgaatggccgagancgggaaactcgacangtccactctgaagaagacnganccnctaganaaaaacncaca

SEQ ID NO: 21193 - DNA, 135 bp, Homo sapiens
  misc_feature 7, 23, 32, 45, 46, 106, 122: n = A,T,C or G
cttttanatgaagcctagagtcnactggacanacaaataaagccnnagtcccctttgactaacccctaatccttggccatctgcctctgtgtggatgtaactgggnatacgtttggtttagngcttatccttctg

SEQ ID NO: 21194 - DNA, 313 bp, Homo sapiens
  misc_feature 3, 40, 56, 57, 59, 202, 204: n = A,T,C or G
aancggtgcttaactcagaaaaattcattgagaggctggncatggtggcacacgcnngnatcccagcactttgggaggccgaggcgggcggatcacctgaggtcaggagttcgagaccagcctggccaacatggggaaaccttgtctctactaaaaatacaaaaattagccgaacatggtggtgcatgcctgtaatcccagntnctcaggaggctgaggcaggataattgcttgaacctgggaggcggaggttgcagtgagtcaagatcaagccactgcactccaccctgggaatcaggagcgggactctgtc

SEQ ID NO: 21195 - DNA, 400 bp, Homo sapiens
  misc_feature 24, 179, 285, 311, 333, 395: n = A,T,C or G
tctgctgagggggcaggcggagcntgaggaaaccgcagaataagtttttttctctttgaaagatagagattaatacaactacttaaaaaatatagtcaataggttactaagatattgcttagcgttaagtttttaacgtaattttaatagcttaagattttaagagaaaatatgagggncttagaagagtagcatgaggaaggaaaagataaaaggtttctaaaacatgacggaggttgagatgaagcttcttcatggagtaaaaaatgtatttaaaagaaaatngagagaaaggactacagagccccganttaataccaatagaagggcaangcttttagattaaaatgaagggggcttaaacagcttaaagtttagtttaaaagttggggggngatta

SEQ ID NO: 21196 - DNA, 381 bp, Homo sapiens
  misc_feature 203: n = A,T,C or G
tgcctatgtgaatatgtatgtgtgtttttctgcttctgtgattgacttctgacggacacttcccaactctttttatgagtctagcataaatttggtaccaagacctgataatgatattacaagaagggaaaattataggccaatatttctaatgaacatggatgtaaaaatcctaaacaaaatgttatcaaatagaatccagntatgaaaaaggtaaaatttcatgaccaggtgaggtttatttcaggaatgtaaaattgaactttcagaaaaaaattggtaaaattcaccactgtaaatgaatacaggagacaaaaacacgatcatctcaaatatagaaaagcacaatgattggctgtgctgaatgctacctggttgagt

SEQ ID NO: 21197 - DNA, 100 bp, Homo sapiens
  misc_feature 14, 21, 41, 46, 55, 67, 71, 73, 87, 89: n = A,T,C or G
tcatgtaaagatanggagctnaagctatctactaaccctgnccttntttcactgnagtttttctagncagntncgttgcttatcatnangcaagggtaag

SEQ ID NO: 21198 - DNA, 189 bp, Homo sapiens
  misc_feature 40: n = A,T,C or G
ctttatttgaagcataatttagccttatagaactcttggngtcagagccttggacttgaatcatagttatgctgcctactcattcttattactgtgggattacttcttaatttcaattatcctttctttcgtcacctgtaaaattgggaaaacatttccctcatagaattggaagaatagttaaggaac

SEQ ID NO: 21199 - DNA, 143 bp, Homo sapiens
  misc_feature 3, 28, 32, 37, 42, 45, 56, 72, 78, 103, 138: n = A,T,C or G
tcnagtacagtagagaacatgaggcccntggnccgantggtncanaaaacaaaggngctaattaatagtatngcaganacttgaagaatgttgatggtgctangaagaatttgagaagaaatactcctgtattgagtngtatc

SEQ ID NO: 21200 - DNA, 397 bp, Homo sapiens
  misc_feature 172, 235, 396: n = A,T,C or G
cctggtactcgtactgataacggattattggaagtcagtcacagaatttggaaataaattctagtctctccttagctatttgatgcttttcatataggccaagaactcattgcaaaacatttttgcaaggatgaatgcctgtatttggtctaggaacagtacattttaggcngatttagaattactggtagcttattttaaagcaaggaaaagcagctgagctcaagtttgctgnctttagaatggtttgtgaaaatatggtataaaggtgttttcattttcctggcttacctattattgtatagagctattcatgccattttttgggaaaactttaaaaattgccccaaatactgacattgagtgcattaaataacaaattatctttgatacatna

SEQ ID NO: 21201 - DNA, 357 bp, Homo sapiens
  misc_feature 13, 65, 218, 305, 337, 342: n = A,T,C or G
tgtatggcgcggnaaccctatacgagtaatatgcctgctttttgaagtgtaattgagaaggaaanctttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggnatcctgtcgattagactggacagcttgtggcaagtgaatttgcctgtaacaagccagattttttaaaatttatattgtaaatattgngtgtgtgtgtgtgtgtatatatatatatatgnacagntatctaagttaattt

SEQ ID NO: 21202 - DNA, 390 bp, Homo sapiens
  misc_feature 372: n = A,T,C or G
ggaactcctcaagtaacccgctgtggtttttgcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggngttgaatatgaaacattc

SEQ ID NO: 21203 - DNA, 388 bp, Homo sapiens
  misc_feature 120, 204, 209, 298, 340: n = A,T,C or G
atccctatgaaaatatgcaggtcattagcttactataatttacttttgacttaatggggcataaataaaactttcatagtacacatgaggtggatatttgatacacagaacatttgcggngggctttctgtgggttagatgtaaagcccacatattttaatattcactattttaaatgagcaatgcatgaggggaatgcagtgncaggnacctggcctatttttaaactagtgtaatcaccctagtcataccattcagtatgtttactttttaaaataaataaccacaattaagttgntgtagcccttgcacttcaagagatctagtctttactttcagntgtctgttaggtccattctgtttactagacggatgttaataaaaacta

SEQ ID NO: 21204 - DNA, 147 bp, Homo sapiens
  misc_feature 5, 29, 44, 54: n = A,T,C or G
gatcnacacggacattaaagtagttgttntgactgtagtttgcntgtttaagancactagaagaaggatttaacatgttaaatagagacaaagaagatataacaaagatataaatcaaactgaagagatgaaaactgcagtgcctga

SEQ ID NO: 21205 - DNA, 396 bp, Homo sapiens
ccatccagcactgtaaggggagagacatcgtgtggcagttcttgttttatgggacctagattttctgcactagcttatgggctagaaactttgttaagctagtattttttaaacaatgtacttgtatttttggttcctaaaaacagtaaaagtaacacttgtttcatagagaaagcacagagaagtataaaaagaaaataaaaattacttaaaaacttgccatttggaagtaattctttggtcacattttgtggccttttcccaattttttttccacatgtatatataacatatgtaaatttgaatatgttgccatgtaatacatatattttatataatctctgctaaatagtaaatgtatataagtctatttgtattacataagtatatttatta

SEQ ID NO: 21206 - DNA, 400 bp, Homo sapiens
  misc_feature 12, 18, 40, 180, 235, 299, 374, 398: n = A,T,C or G
tcagtatataangtacanagctttactcgttctctgcttngcctctagaatagaaacttttcagaaaatctgcacatactgtttgtaagtataaaataattgaattctagacttttggagtgtggaagggtgtttgtgtgtgaaggtaataaatgtgttgctgcatgtgtttaccatagngaacgttgccaggctttgtcaaatgaggacattgttgtgagggtgtgacttttgngaagccagaaaactgtgcctaagattcattacagtgagtatgtgcaggaggcccctgacccagnaaatgctttttgcctttttattcccaatgtcttggacagttgagacaacttggcccaactctgaattgtagcagnggatgtcttatatgcttacgaggntt

SEQ ID NO: 21207 - DNA, 362 bp, Homo sapiens
  misc_feature 15, 16, 38, 55, 59, 66, 67, 69, 75, 78, 79, 80, 84, 86, 100,119, 134, 223, 225, 226, 227: n = A,T,C or G
tcgcgcacaagtgcnntctctggaatgtggcggctcgntggttttttgttgcttnagtntagaggnnantgcgcngannnatcntncatgcccacgttgnttttttttgattcccattnggagggaaattgtangcttcttctcattcatgcagtaaataatacatcctttcactcagcagagatggccatattaaacacgttttgctatgttaaaagtggcngnnncaggaaagacgaattaaaaataacattttttaagcgacataaggatgaaatactgatgaatctctgtgacattacagggaaaaaaatatagttttctatctctttcaagggcagaagagttttcatttttatttt

SEQ ID NO: 21208 - DNA, 398 bp, Homo sapiens
  misc_feature 218: n = A,T,C or G
atggcgcggcaagaacatgagaaccttcatacattgttgtttggaattgtaaaatggagaaaccactttggaaaacagtttggcatatcctcaaaatgataaacacagggttaccatatgatccaacagttcccctattctaggtatacaccctaaagaaatctgaacatatgtgcgtacacaaaaactttcacattaacttttattgtagcattatncaaaataaccaaaaggtgcaaacaacccaaatatctgagaagtgatgaatgaataagtaaaatgtggtatatacacagaataaaatgttattcggccacaaaaaggaatgaaatattgatgcatgcttcaacatggagaatcttgaacacattatgctaggtgaaaaaggtcacaaaagt

SEQ ID NO: 21209 - DNA, 128 bp, Homo sapiens
  misc_feature 4, 6, 39, 50, 55, 66, 67, 68, 72, 73, 77, 82, 84, 89, 95,97, 98, 103, 115, 117: n = A,T,C or G
agtntncgcagatctttttaagagccacggcactctgangagaacacctnatgancctattcatcnnntagnnagcngcagngncattntggagnannaatgntcaattatggangngatgaaggata

SEQ ID NO: 21210 - DNA, 390 bp, Homo sapiens
  misc_feature 6, 57, 208: n = A,T,C or G
ataacntaggtgatcagaggggccatggtttaagatcactgccagtttgtggattcntttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggnctacaattcctggaaaatggtagatgctgcacaaagttaccttctgtttcatcattgcagacaaaaatcattgaaaatactatgccgcattcatttaaagctattttgtttactatgtataaaagtctacaatctaattaatagcaatacctagatgtttattattagaaaagattgctgag

SEQ ID NO: 21211 - DNA, 110 bp, Homo sapiens
tatgaaaaattatagccaagcataatatagcaaggactaacccctataccttctgcataatgaattaactagaaataactttgcaaggagagccaaagctaagaccccca

SEQ ID NO: 21212 - DNA, 214 bp, Homo sapiens
  misc_feature 158, 177, 178, 202, 214: n = A,T,C or G
gagatagtagctattatattttacacttgcttgatgtgataactctaaagactttttaactgataaaagcgcacatggctattttgatacacaaagttgtgtttgctacctttagaagcttttgtggcaagaattgtaatctaattttcataccttgnatttctgaatcacaataannaaataaatggggaacaagacttanaaaaaaaaaaan

SEQ ID NO: 21213 - DNA, 106 bp, Homo sapiens
  misc_feature 2, 5, 32, 39, 40, 52, 53, 54, 60, 64, 71, 82, 97, 99: n = A,T,C or G
anggnaaggcgaaaaagaagaaaaaggggggnaacattnnctaagggaaaannnaagcangagnctaatanccgggccgggnggggaggaaatgacncnggggaag

SEQ ID NO: 21214 - DNA, 400 bp, Homo sapiens
  misc_feature 7, 29, 32, 33, 34, 50, 54, 62, 64, 74, 185, 189, 306, 398: n = A,T,C or G
aaggtgntgcggagccatatggagtttgnccnnntaaagaaagaggacanagtntgaaaatntnttgttttgancgaagattttaaagaactcaactttccagcatcctcctctgttctaaccacttcagaaatatatgcagctgtgatacttgtaggatttatatttagcaaaatgttagcagngggngacaagacaatgagagtaattgcttgacaacaacctatgcacattaactttggaaacaaaaatgtacaattaagtaaagtcaacatatgcaaaatactgtacattgtgaacagaagnttaattcatagtaatttcactctctgcattgaccttatgagataattaatgattaaactattaatgataaaaaataatgcatttgtattggntc

SEQ ID NO: 21215 - DNA, 300 bp, Homo sapiens
  misc_feature 13, 27, 38, 61, 72, 133, 209, 210, 267, 268: n = A,T,C or G
atggcgggaaatnaatgctgccatggngcacatcaatngggccctgaaactcattattcgnctctttctggnagaagatctggttgactccttgaagctggctgtcttcatgtggctgatgacctatgttggngctgtttttaacggaatcacccttctaattcttgctgaactgctcattttcagtgtcccgattgtctatgagaagnncaggacccagattgatcactatgttggcatcgcccgagatcagaccaagtcaattgnntgaaaagatccaagcaaaactccctggaatcg

SEQ ID NO: 21216 - DNA, 398 bp, Homo sapiens
  misc_feature 172, 173: n = A,T,C or G
gatgatagaccattgacgaaagaccattttagtttaacttggtattaatagaaatagacgaaagcaaaaggtagggttagtagaatggattagagaaaaataagagggaattataaaaagaaaatgtcatcttttattagcactattactcttgtgaagttagtccttggtnnataaaatattttgatttgcattgaagatgacagtcaaataactttcattccccctgaaaggggacttcttaagtaagtcagaaactagttaatatccctatgatttttgagtactgccagtgtgtggcacattctgagtgctccctttatcccccaacaggggggtgcagccccagctctgtggcttttgcatgcaggatctcagtgagtccctggaaggcactc

SEQ ID NO: 21217 - DNA, 388 bp, Homo sapiens
  misc_feature 28, 47, 49, 51, 204, 370, 387: n = A,T,C or G
atttgattttttattattttatgttccnccggtagattgttttaagngntngcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgcgctnctcagcagcttctgtcctcttctgtgagtcagtcagcgagtgcttgggatccgcatccagccgtgctgagcacacaacaggctgtgtgtggaaatggccaccaccattctccttccccaccccaccacaaaaagagaggctgtgtcttttagacaaaccctgaggnatctgtgttacaatcgnt

SEQ ID NO: 21218 - DNA, 389 bp, Homo sapiens
  misc_feature 5, 6, 29, 57, 206, 285: n = A,T,C or G
gagcnngaggcggagtttcggccttcgcntgctggaaaagcagtaggatcggcccgnggcgacagcaggagctgagcctaagccctggcggggctttgggctgtagattcctgtctgactaaagggacctcaaaaaggagggaaaatggcttctgagtctgaaactctgaatcccagtgctaggataatgaccttttatccaactntggacgagttccgaaacttcagtagatacattgcctacattgaatcccaaggagctcatcgggcagggctagccaaggntgttcctccaaaagagtggaagccacgagcatcctatgatgacatttgatgaatttggtcatttcctgccccccattcaacagctggtgacggggcaagtctgg

SEQ ID NO: 21219 - DNA, 276 bp, Homo sapiens
  misc_feature 6, 8, 237, 257, 273: n = A,T,C or G
aaagcncngtggcagcattcagcagtatttttataaataggaacctgtacagaagtgccctgggaagaaggcctgctctaaattatccagtgtatggagaaacgacacaggttaggagacgtcgctttgaacgtgctataggaccttctcaaacccacacccatcagaattcaatattcacctgccaggactggcttatcaagacaaaggggggcctttcataatgaagttaaaggngagtatactgggggggaggncttccaaatgggggtncct

SEQ ID NO: 21220 - DNA, 126 bp, Homo sapiens
  misc_feature 2, 6, 13, 14, 33: n = A,T,C or G
tntttngctgganngattatgagaagcgttgtnactgtttcactactcagcatggaaacaagatgaaattccatttgtaggtagtgagacaaaattgatgatccattaagtaaacaataaaagtgt

SEQ ID NO: 21221 - DNA, 369 bp, Homo sapiens
  misc_feature 4, 24, 28, 189, 284: n = A,T,C or G
aaanagcacagtgtcttgaagttnactnttgattgcacccaccctgtagaagatggaatcattggatgctgccaattttgagcagtttttgcaagaaaggatcaaagtgaacggaaaagctgggaaccttggtggaggggtggggaccatcgaaaggagcaagagcaagatcaccgtgacatccgaggngcctttctccaaaaggtatttgaaatatctcaccaaaaaatatttgaagaagaataatctacgtgactggttgcgcgtagttgctaacagcaaangagagttacgaattacgttaccttccagattaaccaggacgaagaagaggaggaaggacgaaggatttaaatttcatttatctgg

SEQ ID NO: 21222 - DNA, 388 bp, Homo sapiens
  misc_feature 32, 50, 206: n = A,T,C or G
caaactagttgaagtaaatccaaagtagtttngatgcaggtggtgctganggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggnctgactactttgcgcaatgggacattagttgcattccgaggtcattatttctggatgctaagtccattcagtccaccatctccagctcgcagaattactgaagtttggggtattccttcccccattgatactgtttttacctaggtgcaactgtgaaggaaaaactttcttctttaaggatt

SEQ ID NO: 21223 - DNA, 331 bp, Homo sapiens
ggacggttagatacacagcatgttgatttggtcactaaaaagaagaaaaggactaacaagcttcacttttatgaacaactattttgggaacatgcacaatagtatgtttttattactggtttaatggagtaatggtacttttattctttcttgatagaaacctgcttacatttaaccaagcttctactatgcctttttctaacacagactttcttcactgtctttcatttaaaaagaaattaatgctcttaagatatatattttacgtagtgctgacaggacccactctttcattgaaaggtgatgaaaatcaaataaagaatctcttcac

SEQ ID NO: 21224 - DNA, 246 bp, Homo sapiens
atattactttaacctgcccataccttacttggaaatattaaaagaaagggttctgtaaaatggaaaacttagtttgtgaattgattttgaggagtggtttttcttttcttggacgcttaattctgttctgatattaatttatcagattgcttttgtgcattggataacaccaccattcacaagttaagattcttggtatttggatatctgttagatgctactaagaaaatagagatgagctttctt

SEQ ID NO: 21225 - DNA, 196 bp, Homo sapiens
  misc_feature 177: n = A,T,C or G
caatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagggntttagatcaccccctcccc

SEQ ID NO: 21226 - DNA, 381 bp, Homo sapiens
  misc_feature 29, 204: n = A,T,C or G
catccgaagataactatgaaacctttaantggacagtggttccttttaaaagcagccttactgaaaattttatatacacttaaatcaagtaacagttaccgtgagttttctaaacttttgtgttaacagaaatgccagttcagcagtgtgacctgttacttttaaatgtctgtcttgccgccctagagtgacagacatcccagntaaacatattaggaataagaaatacataaatccaatgaagactgtagaaaaagaattttagcacttgaaggaacttcagtcatttaacccaacccattcatgttataggattgagaccatagaaataaaagtagcctataggatacaaaagttagcggcagatctgagataaaaatc

SEQ ID NO: 21227 - DNA, 367 bp, Homo sapiens
  misc_feature 8, 20, 135, 138, 139, 198, 227, 251, 253, 255, 297: n = A,T,C or G
cttgcaantcaggatttggnttcatacactgaattttcagtattttatctcaagtagatatagacactaaccttgatagtgatacgttagagggttcctattcttccattgtacgataatgtctttaatatgaanggnnacattatttataattgggagagttattgtatctttttatagttgtaagtacacagaggngggatatttaaacttctgtaatatactgnatttagaaatggaaatatatatangngntaggggttcaccttcttttaagggttacccctgggggggggnttaaaaaatctataggcctgggaattccgatcctagctgcagaatcgcatccccacaatgcgagaatgat

SEQ ID NO: 21228 - DNA, 260 bp, Homo sapiens
  misc_feature 19, 21, 34, 140, 255: n = A,T,C or G
cttgaaatgccatgacgcngntagaattgcgtcntttaaagcctagataacgcatttactaaacgcagacgaaaatggaaagattaattgggagtggtaggatgaaacaatttggagaagatagaagtttgaaggggganactggaagacagaagtaccgggaaggcgaagaaaagaataggagaagatagggaaattagaagataaaaacatacttttagaagaaaaaagataaatttaaacagaaatacgggnaggcg

SEQ ID NO: 21229 - DNA, 400 bp, Homo sapiens
  misc_feature 15, 16, 165, 166, 168, 204, 350, 352: n = A,T,C or G
atggtagagctaaanngccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaanngngactgagggaagaaaaaaaatctctttttttctggnggctggcacctgattttgtatccccctgtagcagcattactgaaatacataggcttatatacaatgcttctttcctgtatattctcttggctggctgcacccctttttcccgcccccagattgataagtaatgaaagtgcactgcngngagggtcaaaggagagcaacatatgtgattgttccataataaacttct

SEQ ID NO: 21230 - DNA, 123 bp, Homo sapiens
  misc_feature 16, 48, 50, 51, 62, 71, 75, 76, 81, 84, 87, 89, 93, 98, 100,104, 106, 110, 113: n = A,T,C or G
ctggaggatgagtcanaccactgcccggtgtggggactggcgcaacgngnncatactacctnacagagaangcannagaanatngtncnccangaatncnagangngctngangtaaatccct

SEQ ID NO: 21231 - DNA, 189 bp, Homo sapiens
  misc_feature 25: n = A,T,C or G
tcctggcccgcttggtagagacccnggctctactaaaaatacaaaaattggccgggcgtggtggcacatgtctgtagtctcaggaggctgaggcaaggagaatcatttgaacacaggtggcaagatgttgcagtgagctgagattgcaccactgcacttcagcctcggcgacaaaatgagactctgtct

SEQ ID NO: 21232 - DNA, 400 bp, Homo sapiens
  misc_feature 2, 5, 47, 356: n = A,T,C or G
tnttnttatggtcgcgggaataccaagtctaactggctctggaaatntgaaagggctgcactggaacaacacagatgagatattctacacattaatctacttatctggaatcactttgcctctaaaggccagagaaaaatcacagcttccttgtcggaggggaaaaggacaggtgatctggggaaaacgcagctacacctggagcaaggtctcttcccggcttggcaatctcagctgtgccggcgctacgggacccgagccgtcccagaaaccaaagggcaggcacggcagcaaacgcctgagtgctgctgccttcggtgactatatgagaatggaaacttctaaggaagccaggntgttagaattgttaccccctttactcagagataacatagattat

SEQ ID NO: 21233 - DNA, 181 bp, Homo sapiens
  misc_feature 5, 9, 28, 40, 45, 82, 165: n = A,T,C or G
ctagngcancgtctataagtgagactgngctcgtaaaagnagcangaacaagtctttctaatgttttgtacagtgcctggcnctctgtgggtgctcaataaatggataggagttttcatttgaaggatatttgaatttttaaaataaagtgttttattcccttanaaaaaaaagggggggg

SEQ ID NO: 21234 - DNA, 398 bp, Homo sapiens
  misc_feature 15, 16, 25, 32, 33, 39, 58, 215, 281, 295, 333: n = A,T,C or G
gttatggcggggaanncttttcttnggataanngtggcntacttctacatgaacaaangcccaacatatactatattataatccttaatatggattatattggcctttgtgtggaagtggcagggtggtattagatgatgggatggatattagcgatggagaattttaagtatctcctgtgtacaattcagttataatctaaaatgttcagttgncactctgctcacatgttttctgaacatcatgatgttcattaaattttttttttcatagatagctgngggtatttttttgnagcctggtaatttacagggtatttagtaatttataagnaggctaccctattagggatgatgagttccaaaatgtcatatatatctctagtttacttttgggga

SEQ ID NO: 21235 - DNA, 398 bp, Homo sapiens
  misc_feature 6, 11, 181, 184, 231, 251, 297, 391: n = A,T,C or G
aggccngaaanacattattgaggaaaattaatatcacagcttaaccccaccctttacattttgtgcagggattattttttaaagtcttctttcatgtaagtagcaaacagggctttactatcttttcatctcattaattcaattaaaaccattaccttaaaatttttttctttcgaagtgnggngtcttttatatttgaattagtaactgtatgaagtcatagataatagnacatgtcaccttaggtaggnaggaagaattacaatttctttaaatcatttatctggatttttatgntttattagcattttcaagaagacggattatctagagaataatcatatatatgcatacgtaaaaatgggaccacagggacttattttggaggtgntaggttg

SEQ ID NO: 21236 - DNA, 307 bp, Homo sapiens
gtaatatttttaataattttgtacctgaaacaaagttttgactgtgttttgactctgatccatcatataaggtcagatgtgaaattttctacttatggcgtcatgtgggtgcttaaaaagttttggattttggagcatttcagatttcagatttttggattaggggtactcaacctgtgttagtaaagagttcagtgtccaaagatgtaaagatttcttcctgagtgtatcaagtaatttaaatccaaatctcatcaaatctgtcaatttagaaatgattttggaaggcctataactaaaataagac

SEQ ID NO: 21237 - DNA, 385 bp, Homo sapiens
  misc_feature 27: n = A,T,C or G
gtgctgacatttgcatcaagggtacanttgcaaagttggggtaaaactgctgagaccttagcataaatcaagtggtgcctaactgtactagtactcactatattttccacaaccacacacacatttgtggtaaaataaaaaccatcttcactgaaaaatgtccttggcgaaatagtaaaaatgattagttgttataaatcttgacccttgagtacatctttttgatattttctgttgtaaaactagaagctcacataatgcacttctactccatactgggttccaatgattgtcttgaggaaaagcaggtgtgtgataagagttgtgagctgaactagccacttttctgatggaatagcatttttacacgaaagaacatgagaca

SEQ ID NO: 21238 - DNA, 359 bp, Homo sapiens
  misc_feature 337: n = A,T,C or G
gaccgcaccctcctgaaaactgcagctttcttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggngtcctggtacatgtgcagaaat

SEQ ID NO: 21239 - DNA, 378 bp, Homo sapiens
  misc_feature 52, 245: n = A,T,C or G
aaccttccacgtattgtaacccttatttgaacatcagcgaattcacactggncaaaaaccttatcagtgcaacgaatgtgagaaagccttcaaccagtattcatcctttaatgaacatcggaaaattcatactggggaaaaactttatacatgtgaggaatgtgggaaagcctttggttgcaaatctaacctttataggcatcagagaattcatactggagagaaaccgtatcagtgtaatcagngtggaaaggccttcagccagtattcatttttaaccgaacatgagaggatccacactggagagaaactgtataaatgtatggaatgtgggaaagcctacagttacagatcaaacctttgtagacacaaaaaagt

SEQ ID NO: 21240 - DNA, 400 bp, Homo sapiens
  misc_feature 18, 68, 80, 150: n = A,T,C or G
gttatggcggggaagccnaaaaagagaggaaatccctgatttaaactagcctcaaaatccaggctcancatcagtactgnccatctgtctagtctgatgtctgttagcctcattcagcttactactaatgaactccttgggatagaaggnggaatatatgtgtgtaattagtgatgattgagagacaaggccacaggcggctctaggtttgttttctctctacataacacattcagaaagaaaatctgagagcttatctctctcacatctacatttaaaatctcagggaatgttctggtcccagtttggatcatgtgctaattgatctctgagtcattcactgaaaaggaagatggggggatatgattgaccaggcaggcctggaggtcttattcttggg

SEQ ID NO: 21241 - DNA, 377 bp, Homo sapiens
  misc_feature 28: n = A,T,C or G
gaagcgatcggaagccggttggggtgtntgaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgt

SEQ ID NO: 21242 - DNA, 362 bp, Homo sapiens
  misc_feature 1, 29, 50, 52, 57: n = A,T,C or G
nactcgggctgaatatttagtgtaattanttctcagctttgagggctccngnggcanattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgc

SEQ ID NO: 21243 - DNA, 238 bp, Homo sapiens
  misc_feature 29: n = A,T,C or G
aagcatggtttagaaatggaaaaatgttnacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactc

SEQ ID NO: 21244 - DNA, 162 bp, Homo sapiens
  misc_feature 28, 50: n = A,T,C or G
tgtgttaggttctattatatcagtaagnggaagcttgtaatgaaggcagngcccagaaagtatgtcatagagctataagaggagaaggccaaggacagaacctaattaaacactagtattaagggacagtcaaaggaagagaaaattaagaaagaataaagc

SEQ ID NO: 21245 - DNA, 366 bp, Homo sapiens
  misc_feature 1, 65, 285: n = A,T,C or G
nttatggcgcgggaaacttttaaggagtagcaattgaaggtatttgaggagccgaatggctcctncctgaagaacatagagaagtatctcagaagtcaaagtgatctcacaagcaccaccaacaacccagcctttcagcagcggctgcgactgggggccaaacgcgctgtgaataatgggaggttacctgaaagacggaccgcagtacagggtcaattatgggagcttagatggcaaaggggcacctcagtatcccagtgcattcccatcctcgctcccacctgncagccttctaccccatgagaaagaccagccccgtgctgatcccattccaatatgtagcttctgtttggggactaaagaatc

SEQ ID NO: 21246 - DNA, 382 bp, Homo sapiens
gagcaaaatggattttaatagaaaattcttatttaaaatttgggcagatatctgtattgttgagttaaccaaatgagaagagaaaaatccttacaacgtagcttgtcatttgcctgacttgatgcagactgctttgcttagtaatcatgcagcactatcaagactgtgtacataatgtcaggatccatctacataagatgtagtatggactgatgccaagtgagcctggggtggaaatcagaactggatgcaaatcctgatgttatccgagaacaggcacctgttacataggctgtgttacctgtggcaaaggtaatggtaaaacacagactggccagaggcattgtgtacaatgagaccttgcaactttgtgtatattagt

SEQ ID NO: 21247 - DNA, 182 bp, Homo sapiens
  misc_feature 5, 12, 38, 48, 50, 96: n = A,T,C or G
tggangcgaganagccctaatagtagaagaaccctccntaaacctggngngacaatatggatgccccccaccctaccacacattcgaagaacccgnatacataaaatctagacaaaaaaggaaggaatcgaaccccccaaagctggtttcaagccaaccccatggcctccatgactttttcg

SEQ ID NO: 21248 - DNA, 400 bp, Homo sapiens
  misc_feature 6, 13, 30, 31, 35, 43, 44, 48, 51, 55, 60, 64, 66, 67, 68,73, 74, 368: n = A,T,C or G
gctagnttctagnctaacctagactgctanngtgngacgtggnncccncangacnaattntgcntnnngccanntttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatattttagtaaagcttttcttttttaatttccaggaaaaaataaaaagagtatgagtcttctgtaattcattgagcagttagctcatttgagataaagtcaaatgccaaacactagctctgtattaatccccatcattactggnaaagcctcatttgaatgtgtgaattcaataca

SEQ ID NO: 21249 - DNA, 400 bp, Homo sapiens
  misc_feature 7, 13, 29, 31, 40, 42, 44, 58, 66, 70, 89, 90: n = A,T,C or G
attatgntgcggngagacgaatttatagntnggggcgacnanantctaccgagcctgnggatagcngggngtgcaagatagaatcttanntcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctctgcataagcctgcgtcagat

SEQ ID NO: 21250 - DNA, 364 bp, Homo sapiens
  misc_feature 4, 203: n = A,T,C or G
gganagtggaaaattaaacttgatttaaatgtaaatgatgacaagtcggcctggtctttgctgaatttcacctttgaaattcagttaagctatcggtttgagctaccagttaagaaagctttgcattgctgagcagatcagtaggatggatacaactcaccaaagagaacaagctcattaacaaccttaatagattaatatgngggggtttatactccagttacgtttgcattcactagagcagaacttagaatgggaaatacttagctggcaaggaatttattctagttcatatctgaaagtaataaaactgtagtaaaatgttttcagtgattcagttatgtaatccacattacctcttaca

SEQ ID NO: 21251 - DNA, 364 bp, Homo sapiens
  misc_feature 205: n = A,T,C or G
gattctcttaatgaagtaatataggctggtattgggtcctgaatttagctgtgtgctactattaacattacacatgtgcatctctaaatttggtatattttcctgttagcttttcagaacaggtgcaacaatggcaaaatctcaggtactacaaccaactacaagcgactatgagaaagggtttgttgagagagcaagcacatgngtcactaatgttattcctctgttctccctgctaactctattattataaaccaccaggggatagaaattgacgagaattgaaatgctcagcaggattccttggcccattcaattctttgctggctcaaaacagtgctagcaagaattgctgtggagagtg

SEQ ID NO: 21252 - DNA, 384 bp, Homo sapiens
  misc_feature 3, 204, 319: n = A,T,C or G
ggnctattagctaattatctacaggctttagcacattctctcatctagcacactctttcttgggatgaaaagttgcactcttgccaagaaggatgagttcacctgataaacttgatggcatctacattctaaagtctctcctgccaatcagagatgggaatgaaagccttattggaacaatcaggccagtctttcagaatgtgngctctctacaagttaaagggagaaccaggaagatgcctcacagaaacattcaggccaagcttagctaaagcttgatctattcaattgccttttgggaaaatgcagtgagaattgntgcccttgctgtggtttgttcagcgcctaattgtgtagctaccttttgtctgtgaatatgatcat

SEQ ID NO: 21253 - DNA, 399 bp, Homo sapiens
  misc_feature 22, 40, 300: n = A,T,C or G
atctggcgaatttcaccatgangctttgagtgaagctctncctgggagacaatgtgggcttcaatgtcaagaatgtgtctgtcaaggatgttcgtcgtggcaacgttgctggtgacagcaaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaaggnggccctaaattcttgaagtctggtgatgctgccattgttgatatggttcctggcaagcccatgtgtgttgagagcttctcagactatccacctttgggt

SEQ ID NO: 21254 - DNA, 385 bp, Homo sapiens
  misc_feature 4, 27, 41, 47, 50, 56, 57, 203: n = A,T,C or G
aacnccgatgagattatgacttcactnttgtctgttaatgnacaaanagnaagccnnattagtcctgatggctctcgtaaaaaccccgctagaaactgcagagacctgaaattctgccatcctgaactcaagagtggagaatactgggttgaccctaaccaaggatgcaaattggatgctatcaaggtattctgtaatatggnaactggggaaacatgcataagtgccaatcctatgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttc

SEQ ID NO: 21255 - DNA, 119 bp, Homo sapiens
  misc_feature 3, 48, 64, 105: n = A,T,C or G
tgncccataacaaatctactgaccttcccataagatagtaattaagtnagccattagctttttncttttcaaactcaggaaaacatctctcattcctttcctttnccccattttaattt

SEQ ID NO: 21256 - DNA, 185 bp, Homo sapiens
atagtgagacacccatttctacaaaaaaaatgaaaaattagctgagcatggtggtgtatgcctgtagtcccagcttctcaggaggctgaggtgggagaatcacttgggcccaggaggtcaaggctgcagtgagctgtgaacacgacactgcagtccaacctcatgacagagtaagaccctgtctc

SEQ ID NO: 21257 - DNA, 312 bp, Homo sapiens
  misc_feature 29: n = A,T,C or G
tacctctactgtattggcgagcatggttntagaacatttcatcacagttctgctggaccaatctagatagattcattatcccatctagagaagagactttagtcactgtcttcttgcttcagacccatctatatttaaaacaaatttccctaaatcctgagactgagacggagctacaaattctcagatggcgaccgtgtaaatggtattagcggctgaagaaaaaaaatttttcaagacctctgttttttaactgaactttatcattggcattgtgggtctttgaagttgctgggataaattaatataatt

SEQ ID NO: 21258 - DNA, 114 bp, Homo sapiens
  misc_feature 6, 7, 39, 79, 80, 87, 89, 90, 104, 113: n = A,T,C or G
tatggnncggagaacccattgaggcagacagcgcagggntttctgctgagggggcaggcggagcctgaggaaaccgcannataaggntnnttctgtttgaaagnatagacatna

SEQ ID NO: 21259 - DNA, 269 bp, Homo sapiens
  misc_feature 183, 186, 187, 224: n = A,T,C or G
actgcagctttcttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgnganngggggatgtgatcaccattaaatctgaaagtaccttntaaaaatactgagatttccttcatactgggccaggaatttgacga

SEQ ID NO: 21260 - DNA, 388 bp, Homo sapiens
  misc_feature 4, 27, 285: n = A,T,C or G
ggcngacatgaatagtcgccaggcttnttggctcttgctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcgttggttcaggacttggaaactcatggatttgacaaaacacaagcagaaacaattgtatcagcgttaactgctttatcaaatgncagcctggatactatctataaagagatggtcactcaagctcaacaggaaataacagtacaacagctaatggctcatttggatgctatcaggaaagacatggtc

SEQ ID NO: 21261 - DNA, 312 bp, Homo sapiens
  misc_feature 172, 173, 174, 176, 214, 276, 309: n = A,T,C or G
ctaatgaataaattagtttggcatcctagaatttaaagttctaagattagtataaagagtatatagattgttaatccccaccagctagactttgaacttaagtcagacttaaagatttgagaaattatttgtgtcatttactagacgtgatttttagttctgtttgattatnnngnctacacaaacttcttatttaacaggatagcctactaanattaaatgtttcttatttcacttaactcatttgattaaactgtgttctaaaacatttggggnttttccccctattcagttttaatcttgggaatntgc

SEQ ID NO: 21262 - DNA, 400 bp, Homo sapiens
  misc_feature 17, 20, 286, 368: n = A,T,C or G
tatgccttttctaaagnatntttctataacattgatgtgcctagtacaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagntgttattgtttacaggaccatttaattaatatttcctctgtttattcctcctctccctcccattgcatggctcacacctggnaaagaaaaaagaatcaaattgaatatatcttt

SEQ ID NO: 21263 - DNA, 342 bp, Homo sapiens
  misc_feature 19, 211: n = A,T,C or G
agacttcgctcgtactcgngcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgnacattccacaagcattgccttcttattttacttcttttagctgtttaactttgtaagatgcaaaagaggttggatcaagtttaaatgactgtgctgcccctttcacatcaaagaactactgacaacgaagg

SEQ ID NO: 21264 - DNA, 398 bp, Homo sapiens
  misc_feature 29, 174, 305, 354, 390: n = A,T,C or G
gagctattccactgaagtcaagcccgaantctatttagctggatagctacccatttcctgtgacctgcaaaagagatgccctattctttcaggatccttggaatgccacatgcccaggcccactggaaaactgggaaggaaaactggagccacatgcctgggcccactgagatncatcacccttcccctacaaccctgtgtcaaggaaacacaaagatagagtggatttcagcaccacccaatgcagacgcatggctgctagtttatcagcataggtcaatgaatggttttaagttgctatgggnttaagaggatctcttagttgatgggaatttttgaatcttttttttgcgngggaccctttggcagggtttgaaaatgtacagactntttctcag

SEQ ID NO: 21265 - DNA, 295 bp, Homo sapiens
  misc_feature 24: n = A,T,C or G
caaaaagaaaggcgatgaccaganccggcaaggcggggctcctgatgctggccaggagtgagtgctaggcaaggctacttcaatgcacagaaccagcagagtctccccttttcctgagccagagtgccaggaacactgtggacgtctttgttcagaagggatcaaggttggggggcagcccccagtccctttctgtcccagctcagttttccaaaagacactgacatgtaattcttctctattgtaaggtttccatttagtttgcttccgatgattaaatctaagtcatttgaca

SEQ ID NO: 21266 - DNA, 388 bp, Homo sapiens
  misc_feature 53, 87, 206, 223, 294, 342: n = A,T,C or G
gccatctggttatttatgtaaaaactatttctaataaagttagttagtggctnctatcactttaaatctttagtgtccaaaagtggngtttaaagtaatagcacatcagaaaaccttgtctggacaaaactagttcactcactgcttctgcacctgcagttgctccctttagggttataaaataatgacccaaatgttacatgtgngggatattataacttgncagttactgatgtctgtggtatcctaccctcatctctgaaagggataatactgaataattattagaaaacnataaaacttcacactttgtaccattaaaacctaaaattttaatcttgnccttttttactatggatcagtcggcactcgggaacagcagcaaggg

SEQ ID NO: 21267 - DNA, 387 bp, Homo sapiens
  misc_feature 19, 20, 99, 173, 175, 176, 235, 265, 278, 290, 322, 363,364, 369: n = A,T,C or G
aattgttcagcattcttgnntgccacagttaccacattttcccccaccccttgcactcatttttgtgaagtttgggtcatagtacaacctgtgagcggngaaaaaggaatcctgggcattttgtccctcttgacccgttctctaatctgatggtttggagatttgcagtttanannaaaggcatagaggaaagtgggatgtgtttatagcccctaacttagaatatgtcgattgnaatcatctgaagtatatcacagattggggngggtaacataggnctctagattagnaaaatactagtttgagcctgagccacgtctgnctatcaccttttaccttttactaatatagggagtcctttgnnggggntcatcctgtcctttcaga

SEQ ID NO: 21268 - DNA, 388 bp, Homo sapiens
  misc_feature 22, 25, 354, 373: n = A,T,C or G
tctgctgagggggcaggcgganccntgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaggacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggngacttaaacagcttaaagnttagtttaaaaggtg

SEQ ID NO: 21269 - DNA, 351 bp, Homo sapiens
  misc_feature 22, 98, 346, 347, 348, 350: n = A,T,C or G
acatatggaattggctatgganaattcatatgctttcaatcaacgaagcacatgtaatggaattccatctgagaagaaaaacaacttccttgtatcangaagatcatggacaaaaaatcttaagtgtactacagaattttagagaacaaaatgtcttttatgatttcaaaataattatgaaagatgaaataatcccgtgtcatcgttgtgtgttagcagcatgcagtgactttttcagggctatgtttgaagtaaacatgaaagaaagagatgatggaagtgttaccattactaatttgtcctccaaggcagtaaaagcatttctcgattatgcctatactgcgannnang

SEQ ID NO: 21270 - DNA, 400 bp, Homo sapiens
  misc_feature 25, 28, 147, 171, 175, 293, 333, 380: n = A,T,C or G
tgttgctggggagaaaaggaaaccnggntgaaacctccacaagtcgtccgagtaggaaccaagaaaacttcttttgtcaactttacagatatctgtaaactattacatcgtcagcccaaacatctccttgcatttttgttggctganttgggtacaagtggttctatagangggnataaccaacttgtaatcaaaggaagattccaacagaaacagatagaaaatgtcttgagaagatatatcaaggaatatgtcacttgtcacacatgccgatcaccggacacaatcctgcngaaggacacacgactctatttcctacagtgcgaaacttgncattctagatgttctgttgccagtatcaaaaccggcttccaggctgncacgggcaagcgagcacagc

SEQ ID NO: 21271 - DNA, 377 bp, Homo sapiens
accaagtggaagaataaagttttttttactgacactatccttgattactaccactacggtgatcaagacagtgtggtatcaatgaaagaataaagaaataaatcattgaaacagaatagcccagaaatagactgatacaaatataggaaactgatctttaacaaaggagcaaaggcaattcaatggagaagggatagtctttttaacaaatgggtgctggtataacaatatctgcatgcgaataaatgagtctgtaaacagaccttaaatttttcacaaaaattaactcaaaatggattatagaactaaatgtaaactgtgaaactatacagcttctaaaagataagaaaattcaggtgaccaaagtatgatctatg

SEQ ID NO: 21272 - DNA, 399 bp, Homo sapiens
  misc_feature 9, 38, 39, 42, 62, 76, 84, 120, 144, 159, 196, 205, 235,245, 269, 307, 313, 329, 372, 387, 389, 390: n = A,T,C or G
gccgaatantcgctttaatcatatagaaaaaaaaagcnntgnagaaaaaaatgggcaaaagnacctaaaacccgangaaccttntgtaagaagtggtggcaagcatcagcctcacaaagngacacaggataagaaggacaaggnttctttgtatgccgngggaagggaggcgctatgatcggaagcagagcggctntggtgggcngacaaagccaattttccggatgaaggctgngaccacaaanaagattgtgctaaggctggaatgngtggagcctaactgcagatccaagaggatgctggccanttaagnagatgcaagcattttngaactggggaggagataagaagagaaagggccaagtgatccanttctaaactttgggntnntttttcttc

SEQ ID NO: 21273 - DNA, 131 bp, Homo sapiens
  misc_feature 21, 23, 27, 48, 87: n = A,T,C or G
gtatacttattatatataaananccangggtgtacatatatgtgtgtntatctatgaatcaaacatactgtttctgttggagatggntcagaattataaagattatctgaatctttatctgggagcagtct

SEQ ID NO: 21274 - DNA, 263 bp, Homo sapiens
  misc_feature 2, 3, 29, 53, 180, 206: n = A,T,C or G
gnncctgtgatattttaaatatcccagtnctcactttttccaaatgatcctancaattgcctagaaatatctttctcttacctgttatttatcaatttttcccagtatttttatacggaaaaaattgtattgaaaacacttagtatgcagttgataagaggaatttggtataattatggngggtgattattttttatactgtatgngccaaagctttactactgtggaaagacaactgttttaataaaagatttacattccac

SEQ ID NO: 21275 - DNA, 168 bp, Homo sapiens
  misc_feature 12, 28: n = A,T,C or G
ggacgcaaagtnaataaagcattcatgntaaaatacaactggaggcaccactagattttcgtatacattaggttcccacgggggaggaccgaagagagaagaaagaagtggaaagggaggagcgtgcaggagagacaggagaagagaataactaaacaaagacattat

SEQ ID NO: 21276 - DNA, 396 bp, Homo sapiens
  misc_feature 175, 392: n = A,T,C or G
tctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgangacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttggaggngatt

SEQ ID NO: 21277 - DNA, 285 bp, Homo sapiens
  misc_feature 3, 5, 18, 181: n = A,T,C or G
cancnattgaactcaagnaactatttttttctttgaatatcacctcccagtctgctttataatttttaaaaacaagatgacaagaaaataaaaaatgaggatgacagcagtctcagttactgttcctcttttatttgctggattttgcacatactgagactcagactgggctgggcacagnggctcacatttctaattccagaactttgggaggctgaggcaggaggatcactggagcccaggtgttggagaccagtctgggcaacatggtgagaccctgtctct

SEQ ID NO: 21278 - DNA, 388 bp, Homo sapiens
  misc_feature 5: n = A,T,C or G
ggtcntttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgacttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaaattaca

SEQ ID NO: 21279 - DNA, 390 bp, Homo sapiens
  misc_feature 7, 33, 57, 151, 208, 209, 210, 212: n = A,T,C or G
aacctcnatttaactgcctcagtgacctatttntctttcttctcatgtgccagatgncaagatgaaggaggaatacaacacatactcaagcctcagcctgtttagttgttttcactggggctcgcttttctgggacggtatttattatcangactggcaagcctaactccataggtttacaggaagtagggatatttttataaaacannngngtcctccccacattttgctatgttaatatttgcttctaacaatttgcagctgtttcactttttcctcatttgtctctaagttgaaggctttgttggaggggacagagcacaggaacagccttgacagtctgtaattattgtacagatattttaatagcatataaataagtatattcct

SEQ ID NO: 21280 - DNA, 400 bp, Homo sapiens
  misc_feature 174, 175, 177: n = A,T,C or G
ctcaggcagtcagactgtcttaggcaaatcttgataaaatagcccttatccaggtttttatctaaggaatcccaagaagactggggaatggagagacagtcaagggttatgtcagaaaaggatgagtatcagtttcaacatcagggagcggtggagctgcttgtcttcaatttnngngctcatccttaccattttgacaatctggttatttaaaaatcatcgattccgcttcttgcatgaaactggaggagcaatggtgtatggccttataatgggactaattttacgatatgctacagcaccaactgatattgaaagtggaactgtctatgactgtgtaaaactaactttcagtccatcaactctgctgggtaatatcactgaccaagtttatgaatat

SEQ ID NO: 21281 - DNA, 397 bp, Homo sapiens
  misc_feature 22: n = A,T,C or G
actctccattccagaaccatcncccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagggttggtggaccatgtgtgatca

SEQ ID NO: 21282 - DNA, 389 bp, Homo sapiens
  misc_feature 30: n = A,T,C or G
aaaaacaaagttaaatgtcccactactatntgtcatagcactagacagtgttcccacaaccgtcttcaaactcatctgtatttcataatctctcttctagttcaaaccagcacaggtcagctgaaactctgaattctacaaataaatatttagaggaagctaacttcgtcagacactcccctatgctctcagttcaaacgaaagggttctgttacatttcacctacctacagccttacctcactcagctagcattagactactcagcaatgagttccaacattgccttgctaaaaagcaaggtggctcacaaacaagacttcagcaaagatagcattaaaatgtgaagtctgcatttgttcaaggcataccttagatggagtaattcat

SEQ ID NO: 21283 - DNA, 112 bp, Homo sapiens
  misc_feature 3, 7, 52, 53, 80, 83, 108: n = A,T,C or G
ccnaacntatttgctaagaatatttttctctaggcttttttccttttggggnnctacagtcgtaaaagagaaataagatnagntggacagtttaaagcttttattcgncctt

SEQ ID NO: 21284 - DNA, 388 bp, Homo sapiens
  misc_feature 55: n = A,T,C or G
gtctctcggccttagcgccatttttttgttaacctctgcgccatgagagccaagnggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataat

SEQ ID NO: 21285 - DNA, 388 bp, Homo sapiens
  misc_feature 31, 56: n = A,T,C or G
gacaccaccctcctgaaaactgcagcttttnttctcaccttgaagaataatcctanaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcgccattaaatctgaaagtacctttaaaaatactgagatttccttcatactgggccaggaatttgacgaagtcactgcagatgacaggaaagtcaagagcaccataaccttagatgggggggtccctggtacatgtgcagaaatgggatggaaaatcaaccaccataaaga

SEQ ID NO: 21286 - DNA, 350 bp, Homo sapiens
  misc_feature 29, 70, 80, 178, 244: n = A,T,C or G
gtagctatatgttacagcatgaatgaganttggaaaagagggtagttattttgactgatgtagacagccnaagtgggtanttgagacccctgaaacttcctttaggattttgaatgatcctatttggctgtcttggggagtcacaacagtgggataattaccatatttttactccagngtgtggacaactacttctaatactggtttctcagtccatttgcatttagattctattggggagtangaatggtgaagggtgaaattaaccataaaatatattaatctgtttgaactcaagtagattttaaaaatactagatttaaccatctgaggaaaacagacttgcctcc

SEQ ID NO: 21287 - DNA, 223 bp, Homo sapiens
  misc_feature 25, 44, 135, 204: n = A,T,C or G
aaatgttacatttgtaaagaaattntaaaaatgtaactatagcntatgaccctgcttaaactgtgctgcattgttggatgacaactctttttgtcacagttagagaatgaggttgactaatgcatattatgaatngagtccacaaaggaacacaaaactctttgtaattctgttataatcttttatgtagatttatttatgatnagcctactaattaaaacta

SEQ ID NO: 21288 - DNA, 311 bp, Homo sapiens
  misc_feature 52, 102, 207, 310: n = A,T,C or G
ctaccaataagtgttaaagtctttacttattgtcaaaaacttttgtgagggncccgtaccttttaatatcttttattcatatatgggtatttttattttggnaggaaatgttgatgaattaaatgggttggcatttggtttcgagatccattgctttaggaaacagcatctgcagaaattgagcatttggctttgttgggattaagngtggaagacagttggttttagctctgccttcacccgtcagtcctagcccagtgaatgtgaatgctagatagaatttcaggaatatgagaattgcctacttagnc

SEQ ID NO: 21289 - DNA, 102 bp, Homo sapiens
  misc_feature 11, 17, 19, 21, 23, 53, 57, 97: n = A,T,C or G
aaggccaaganctatgngnangnctgctcttgatgatatttctcacattaatncccntaaaagaataacagctgaacatcatagctgccaaaaaaanttaga

SEQ ID NO: 21290 - DNA, 394 bp, Homo sapiens
  misc_feature 18, 20, 43, 196: n = A,T,C or G
agggaacatcctgctgtntncctatcagtatggtgctaatgtncctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatggganggtctagaaaataatgcaaatgtcacggctactctatatacttttgcttggttcattttttttcccttttagttaagcatgactttagatgggaagcctgtgtatcgtggagaaacaagagaccaactttttcatttccctgcccccaatttcccagactagatttcaagctaattttctttttctgaagcctctaac

SEQ ID NO: 21291 - DNA, 389 bp, Homo sapiens
  misc_feature 32, 55, 56, 57, 108, 208: n = A,T,C or G
gaaccaaggtgttgtactaatagcaaactttntacagaaaatttcagttttaggnnnggtgtagctgatgagttattacctcatagagactataatattctatttggnattatattatttgatgtttgctgttcttcaaacatttaaatcaagctttggactaattatgctaatttgtgagttctgatcacttttgagctctgaagcnttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtctt

SEQ ID NO: 21292 - DNA, 381 bp, Homo sapiens
  misc_feature 5, 31, 169, 203, 218, 220, 306, 337, 339: n = A,T,C or G
ccccnaacagacaaacagtagagccaaattntgagtgaactcccattcacaattgcttcaaagagaataaaatacctaggaatccaccttacaagggatgtgaaggacctcttcaaggagaactacaaaccactgctcaagggaataaaagaggatacaaacaaatggnagaacattccatgctcatgggtaggaagaatcantatcatgaaaatggncntactgcccaaggtaatttatcgattcaatgccatccccatcaagctaccaatggctttcttcacagaattgggaaaaactactttnaaattcatatggaaccaaaaaagagcccgcntncccaagtcaatcctaagccaaaagaacaaagctgggggcgtc

SEQ ID NO: 21293 - DNA, 140 bp, Homo sapiens
  misc_feature 8, 20, 33, 40, 41, 62, 64, 66, 70, 115, 124, 130: n = A,T,C or G
gctgaggnggcaggcggagntcgaggaaaccgnaaataannttttttctctttgaaagatananantaanacaactacttaaaaaaatataagaacaataggttactaagatctngcttaccgnctcagntttttaacgt

SEQ ID NO: 21294 - DNA, 388 bp, Homo sapiens
  misc_feature 28: n = A,T,C or G
gaagccattgaggcagccagcgcagggntttctgctgagggggcaggcggagcttgaggaaaccgcagaataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgact

SEQ ID NO: 21295 - DNA, 344 bp, Homo sapiens
  misc_feature 29: n = A,T,C or G
gcttctcctccttggctgtctgaagatanttcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaatgaacccaaacatagacttgcaagacatggcctgtatgagaagaaaaagacct

SEQ ID NO: 21296 - DNA, 398 bp, Homo sapiens
  misc_feature 15, 19, 25, 36, 207, 252: n = A,T,C or G
gtgtggtcgcgtctnggancccggnagcgcttgcancatggctgaccaactgactgaagagcagattgcagaattcaatagaagctttttcactatttgacaaagatggtgatggaactataacaacaaaggaattgggaactgtaatgagatctcttgggcagaatcccacagaagcagagttacaggacatgattaatgaagtanatgctgatggtaatggcacaattgacttccctgaatttctgacantgatggcaagaaaaatgaaagacacagacagtgaagaagaaattagagaagcattccgtgtgtttgataaggatggcaatggctatattagtgctgcagaacttcgccatgtgatgacaaaccttgggggagaagttaacagatga

SEQ ID NO: 21297 - DNA, 400 bp, Homo sapiens
  misc_feature 23, 26: n = A,T,C or G
agaacgagggaggaggtgccagnttnctttaaacaaacaggtctcctgcgaactcgtagaatgataaatcattcattaccctgaggacagcaccaagaccttcctaagggacctgccttcctaacccaaacaccccctcccactaggcccacctctaacattggggatcacatttcaaaatgagatttggaggggacaattatccaaccatatcatttagccaaagaatggaaaggctaggcctacctagaatatcctctcaagaacacgactggcatctaattgttgtatcctctttctcttgttctgtcttctttcagttcttggattttttagttagttcagctgagagtagagggttaggaattggaagatggaatagcatgaacagtgatgctga

SEQ ID NO: 21298 - DNA, 380 bp, Homo sapiens
  misc_feature 28, 54: n = A,T,C or G
gctctttttccggctggaaccatggagnttgtagaagagaagaagaaggaggtncctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagctttcttcgccttcgtcaaatcttcaatg

SEQ ID NO: 21299 - DNA, 303 bp, Homo sapiens
  misc_feature 23, 175: n = A,T,C or G
cttggagaatagtttttgctttncgggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactggngacagttttcctccatgttatttatgaattttatattccgtgaatgtatattgtcttgtaatgttgcataatgttcactttttatagtgtgtcctttattctaaacagtaaagtggttttatttctat

SEQ ID NO: 21300 - DNA, 381 bp, Homo sapiens
  misc_feature 1, 30, 54, 162, 234, 319: n = A,T,C or G
natcccaaagaaatgtgtggggtctggttnattgcttatatggcaacattttancaataaacttgtttcttggataaaggaatatatattctttggattaacaaatttaaacttctcactcaactccttgccttttccaataattgagagtatcttgatcgnttcttcattaggaagtgtctgctttcttgattctcaaggacgtcattcctcaattgggctttgaaaaagtgngttgatatttctttttatctaaggaccctcagcatctttacaaatatagactccttaaaaacacatctggtcagctgggcacggnggctcacacctttaatcccagcactttgggaggctaaagcaggtggatcacgaagtcaagag

SEQ ID NO: 21301 - DNA, 259 bp, Homo sapiens
cagcccagtgatactgtgaagcaaccacttaaacaagcctgcaaaataaccaactagcatcatgatgacaggatcaaattcacacagaacaatagtaaccctaaacgtaaatgggctaaatgccccagttaaaaggcacaaaatggcaagctggataaagagccatgacccatccatatgctgtcttcaagagacccatctcatgtgcagagacacacatgggctcaaaataaagggttggaagaaaatttaccaagca

SEQ ID NO: 21302 - DNA, 120 bp, Homo sapiens
  misc_feature 3, 11, 36, 43, 52, 53, 107: n = A,T,C or G
ggncagctggntgcttgcggctagttttatggtaantgcctgnctcgcgctnncaggaagctgctctgttaaaagcgaaaatgaaacaattgcctgcggcaacaggncgactcctttgca

SEQ ID NO: 21303 - DNA, 385 bp, Homo sapiens
  misc_feature 27, 29, 205: n = A,T,C or G
gggccattcctgaaactgacagcattntngccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagntgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggatc

SEQ ID NO: 21304 - DNA, 363 bp, Homo sapiens
  misc_feature 4: n = A,T,C or G
gaancaacacacacccggttgaactgtttttttcctttgcatgtttagatgatgctaggttgggatactataaaaattatattttctacaagaggagactgatattggcctctgctaattgttaccaaaagtcaaactagaacctaaaagaataaaaattaagatattgtatttccctttgaaagcaattatcattttaatccgaattatagtagtaaaatatatttcatgcaaatgcaattatgcaacataactggtatataaaaatacaggggaaagttcatgcttctgtaaagccagaaattgcctgaattttctatgaaaatggattagagtcaattatccttttatatgacacaggat

SEQ ID NO: 21305 - DNA, 399 bp, Homo sapiens
  misc_feature 4, 44, 45: n = A,T,C or G
cttnttacggccggggataccttctcagcttactaagatgacanntttaagagattaaagtaaagacaggcctaggaaatcacaagagtattgattatggaagtgataatgtccgtgaaatctgcacaatttatgttcagagattgcagtaaagacaggcgtaagaaattataaaagtggggaactgataaatgtccatgaaatcttcaaaatttatgttcttctgccatggcttcagccagtccctctgtttggggtccctgacttcccgcaacactcaacgaaataagagaggacacaaacaaatggaaaagcattccattttcatggataggaagaatcagtattgtgaaaatggccatactgcccaaagtatttgtagattcaatactattatca

SEQ ID NO: 21306 - DNA, 336 bp, Homo sapiens
attcgctacagtacaaaaagtgagtaaatatttgatagatctccataactcagtgcaccatcttttggactgaccatcacataatgctatgcaatcatgtgcaggtaaaaggtccattcaaatacaggatagatctatggattttcctgttaagtgtacaaaaagtttgatgtggttcggattacaactaacttttaagaatttactatttgttcgggaggctgaggcaggagaattgcttgaacctgggaggtggaggttgaggcggaggttgcaatgagctgagattgtgccgttgcactccagcctgggcaacaagagcgaaactacatctct

SEQ ID NO: 21307 - DNA, 140 bp, Homo sapiens
  misc_feature 4, 27, 29, 45, 48, 49, 50, 54, 56, 81, 83, 85, 87, 100, 101: n = A,T,C or G
gacntaaatgtctgatataaaacatgncncagggagcaattcggngannngagntnctctgaatagcatatatatgatgcntngnanagggcattatgannttttaccatttcgacttacatatatgaaaaccaattcat

SEQ ID NO: 21308 - DNA, 383 bp, Homo sapiens
  misc_feature 4, 11, 29, 56: n = A,T,C or G
ggcncaatagnatatagtaccgcaagggnttgatgaaaaattataaccaagcatantatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagaga

SEQ ID NO: 21309 - DNA, 194 bp, Homo sapiens
  misc_feature 4, 27: n = A,T,C or G
gatntcgtagatgttcttgttgattangggataagggcacatacagacaaacccaggaattatctgacttcggctaaaacaacaacaacaaaacatctccagtactagcctgagtaattgcttttggcataatagctgttacctcagacagactgaaggtttaataactagattggagacttccctttgcggtt

SEQ ID NO: 21310 - DNA, 346 bp, Homo sapiens
  misc_feature 1, 26, 38, 80, 136, 138, 171, 175, 210, 287, 311, 340: n = A,T,C or G
naacaatgcttaagagctattccagngagctatcagtngcctcaagcatctagtctaggccaggcgtggcgactcacgcntgtaatcccagcactttgggaggccaaggtggacgggatcatttgaggtcaagagntngagaccaacctggccaacatggtaaaactctgnctgnaccaaaaaatacaaaaaattagccaggcgtggtgntgcatccctgtaatcccagctactcaggaggctgaggcaggcaaaatcacttgaacctgggaggcagaggttgcggngagcccgagatcatgccacctgcnctccagcctgggtgacacagcgagactgngtctca

SEQ ID NO: 21311 - DNA, 186 bp, Homo sapiens
  misc_feature 8, 25, 182: n = A,T,C or G
gccaaagnagaaaggtacctgggtncaactaaagcgccagcctgctccacccagagaagcacactttgtgagaaccaatgggaaggagcctgagctgctggaacctattccctatgaattcatggcataataggtgttaaaaaaaaaataaaggacctctgggctacaaaaaaaaaaaaaangggg

SEQ ID NO: 21312 - DNA, 301 bp, Homo sapiens
  misc_feature 25, 27, 95, 200: n = A,T,C or G
ggcccaaacagattattcttccttntnaattattctctttctggcctcttatttcgtgttagaagtaggtttttccttttcttctgctttgtggncttacagaccatttgtttatcaaaccccatctttaccattttccatctgtatatgtttacaaaaagtggaagaacattggacttatactgagaagtaatgtgtgnggaatttcagtgcataatataactttaccacataaaaaagtaaaattttaaattccttggaaacttaccagagctacagaataaaagttttaaatactgcc

SEQ ID NO: 21313 - DNA, 361 bp, Homo sapiens
  misc_feature 3, 6, 30, 54: n = A,T,C or G
ggnccntgtggctgctgctgagaaaacttnacagggtgtggcagaagcagcagnaaagacaaaagagggtgttctctatgtaggctccaaaaccaaggagggagtggtgcatggtgtggcaacagtggcttcaatctacgatgttaaaacaaattaaaaacacctaagtgactaccacttatttctaaatcctcactatttttttggtgctggtgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctat

SEQ ID NO: 21314 - DNA, 380 bp, Homo sapiens
  misc_feature 52: n = A,T,C or G
ggccaggtctgaggctagtctgaaattttagagttcagtgtcagttctgaangatcaggagaaaagctgggccttgcagatctgcttgagcccgttaaaacttcatcttctttggccactgtaaaaaagcaactgaatagagtcaaatcaaagaaggtggtggagttacctcttaacaaagaaaaaattgaacagatccacagagaagtagcattcagtaaaacctcacaggtcctctccaaatgggaccctgtcatcctgaagaaccagcaggcagagcagctggtttttcccctggggaaggagcagccagccattgctcccattgaacatgcgctcagtggctggaaggcaagaactcccctggagcaggaaatttt

SEQ ID NO: 21315 - DNA, 143 bp, Homo sapiens
  misc_feature 2, 4, 27: n = A,T,C or G
tntnattcatttctctaacagcagccntattaataattttcatgatttgagaagccttcgcttcgaagcgaaaagtcctaatagtagaagaaccctccataaacctggagtgactatatggatgccccccaccctaccacaca

SEQ ID NO: 21316 - DNA, 385 bp, Homo sapiens
ggccgggtctatagcacaaatcagtcttttgtaaatgtcacccctcttagttgtttttcgctcgaaaaagtattagcaatgtgtgttcgatgtgggagtactggagtctacaaggaggtagaaaagaatagcagaaggaccctctattcttggctaatagctccacacaagaccattcacctcttagatcctgctgatgacttctgaaggaccctagggccaccaggcagggaagggctccaaggtgaagaacatggaaggtaccccatccttcagttgtaggttcttagccactttcagcatcctatagcatgagaatctgatagagtaaatggtgattaaaatttagaagcactagctttattcataaaatccaagaactgga

SEQ ID NO: 21317 - DNA, 385 bp, Homo sapiens
agccaccccaaaccaattttcaaaggttttggaggactaactggacaaatagcggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatat

SEQ ID NO: 21318 - DNA, 398 bp, Homo sapiens
  misc_feature 14, 81, 87, 126, 134, 149, 151: n = A,T,C or G
ataaagcaacaagnagaaccccgatgttgcccacgattaccttactgctatctaaattttaccaaaaatcaattatatatntgattnattctctttgtctgaatgtatggcaattccctgacttancatagtgnaggtacacaaaatcnantaatggaataggacaggaccttttaaacaaggagccaaataaactgtgtaaattgaaacctgaataatagtcattacaattctatgatggtttttggctacagtgacacacagaatcctacctaggagatgcctatggtgatggagagagataggtataaggagagtgtacttttctgagattgaggcagatgttggtgctcctactgctttatcagagtattcattcctaagaaaggaatgaagta

SEQ ID NO: 21319 - DNA, 385 bp, Homo sapiens
  misc_feature 27, 51, 204, 205: n = A,T,C or G
gaacccaagtgatctttctctgccctnttttatgtgaagacaaggtaagangacagctatgaaccaagaagcaggcccttaccagacaccaaatctgctggtgcattgatcttggacttctcagcctccaggactgtgagaaataaatgtttattgttgaagccacccagtctacagtaatttgttatagcagccgaaattgannaggacaatttaaaaaaattaatctcattgactatcaatttggattctggagcatacctggattcaggtatacattggatttgggcatatctgaactggaatatgggctctatcattctaactcctttaactaagttaaagtctgttaagtgccaaacctcagtattctcatctgtaaaat

SEQ ID NO: 21320 - DNA, 179 bp, Homo sapiens
  misc_feature 23: n = A,T,C or G
caacatggtgaaactctgtctcnactgaaaatacaaaaattacccaggcgtggtggtggtgcctgtggtcccagttgcttgggaggctgaggcatgaggatcacttgaacccaggaggcggaggttgcagtgagccgggattgcaccactgcactccagcctgggtgacagaggctttc

SEQ ID NO: 21321 - DNA, 161 bp, Homo sapiens
  misc_feature 23, 27, 61, 159: n = A,T,C or G
accctcaaccgaccatttgtagntttnttaatgaggtgtagcaatgatcaccaccattggncaggtgtggtggctcacgcctgtaatgccaacactttgggagaccaaagcggatggatcacgagttcaggagttcaggaccagcctggccaatatggnga

SEQ ID NO: 21322 - DNA, 100 bp, Homo sapiens
  misc_feature 17, 19, 27, 33, 37, 39, 45, 50, 61, 68, 77, 84, 85, 87, 88,90, 93: n = A,T,C or G
tacatttcaaactgaangnggcctganaaacanaaananccaagntaagnacacgtgaagngggcggngcctgtggnaccaggnngnngnggnagggaat

SEQ ID NO: 21323 - DNA, 400 bp, Homo sapiens
  misc_feature 14, 41, 48, 70, 82, 103, 109, 112, 139, 201, 291: n = A,T,C or G
aattctggaggcanatgcaattttttaaggaaatcgcaggnaaaatgntgcccaataaggaatatgcggntaatgaagttgnggcaggaataaaagaatattncaatgngangttgggcactcagctgctctacaaatntgagaggccccagtatgctgaaatcctcttggctcaccctgatgctccaatgacccaggttnatggagcaccacacctactgagattatttgtaagaattggagcaatgttggcctatacgccccttgatgagaaaagccttgcattattgntgggctatttgcatgatttcctaaaatatctggcaaagaattctgcatctctctttactgccagtgattacaaagtggcttctgctgagtaccaccgcaaagccctgtg

SEQ ID NO: 21324 - DNA, 229 bp, Homo sapiens
  misc_feature 23: n = A,T,C or G
agttgggacagaaaaaaataggnccaagaaaataaatgcagtgattagaatggggataaggcagatttagaaaatgaatcttgccgggcacagtggcttatgccagtagtcccagcactttgggaggctgaagggggaggatcaattgagcccaggaatttgaggttacagtgagctgtaatcacaccactatactccagcctgggttacacagtgagacacttgtctc

SEQ ID NO: 21325 - DNA, 398 bp, Homo sapiens
  misc_feature 45, 224: n = A,T,C or G
gctgtctgttttcgtgattcattttgtttcatctcaagatttatnaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacncccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaaggaagact

SEQ ID NO: 21326 - DNA, 361 bp, Homo sapiens
  misc_feature 23, 29: n = A,T,C or G
gtccgccactaggaataaaaagnaaattnggacaaagtctttgccctcaagttacttatattctagagccaagaaagagatagatgaagaacacatcttatatattaggactgtgttgggggcaggagtaggcagagtaaccctttggatatgggaaatgaaaataaatcaaactcaaaacaagtttattatttgcttgaagctctggtaaaagataaagtgaaacctgcaaactgtaaaatgaagttgctgctacacatttctccagttttggatttcattcttggatggcctttaacttggatagaaggatacaagacagccatatatatatatatacagctggtgctctttaagatat

SEQ ID NO: 21327 - DNA, 116 bp, Homo sapiens
  misc_feature 11, 19, 29, 31, 34, 52, 60, 68, 70, 74, 88, 109: n = A,T,C or G
ttttcattttnaagggggnccccgggggntnagntcccaaaaaggattaaanattggggncccccccntntttntcttttggcaaaanttggcctaaccttaggtggtntcctccg

SEQ ID NO: 21328 - DNA, 350 bp, Homo sapiens
  misc_feature 22, 156, 215, 252, 253, 271, 287, 321, 322, 327: n = A,T,C or G
gtgaaaaactgtggaaacagcntctgtccatttcataagcctgcttcacattgcccaagagtatactgtcctcgtaactgtatgcaagcaaatccacattatgctcgtgtaattggaactcgagtttattctgatctgtccagtatctgcagagcngcagtacatgctggagtggttcgaaatcacggtggttatgttgatgtaatgcctgtggnccaaagaaagacctacattgcttcttttcagaatggnntcttctcagaggtttacngaatcctccaggaggnaaaggcattcagagtgttttgcgtgttgtgtgannctgantacttgggagaggaccataaagg

SEQ ID NO: 21329 - DNA, 273 bp, Homo sapiens
  misc_feature 7, 8, 11, 19, 21, 22, 37, 102, 149: n = A,T,C or G
aactaannagnacaaaagnannagcaactacaacagnaaaaaaactaccgaatccaaaataacagctacaaccacacaagtaacatctaccacaactcaagnataccacaccattcaaaattactactcttaaaacaactactcttgcncccaaagtaactaccacaaaaaagacaattactaccactgagattatgaacaaacctgaggaaacagctaaaccaaaagacagagctactaattctaaagcgacaactcctaaacctcaaaagc

SEQ ID NO: 21330 - DNA, 386 bp, Homo sapiens
  misc_feature 2, 208, 223, 278, 314, 346, 383: n = A,T,C or G
gnaggcattgaggcagcccagcgcaggggcttctgctgagggggcaggcggagcttgaggaaaccgcagaataagtttttttctctttgaaagatagagattaatacaactacttaaaaaatatagtcaataggttactaagatattgcttagccgttaagtttttaacgtaattttaatagcttaagattttaagagaaaatatgangacttagaagagtancatgaggaaggaaaagataaaaggtttctaaaacatgacggaggttgagatgaancttcttcatggggtaaaaaatgtttttaaaagaaanttgagagaaaggactacagagccccgaattantaccaatagaagggcaatgcttttagattaaaatganggt

SEQ ID NO: 21331 - DNA, 280 bp, Homo sapiens
  misc_feature 201, 205: n = A,T,C or G
gtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggngggngattattttttatactgtatgtgccaaagctttactactgtggaaagacaactgttttaataaaagatttacatt

SEQ ID NO: 21332 - DNA, 150 bp, Homo sapiens
  misc_feature 11, 14, 28, 32, 37, 38, 61, 62, 87: n = A,T,C or G
ataaaaaaagntcncgttggtacccagngtcnatctnntcatgtatggcccgggaacaganncaagtactctgtcttcgggggaaancaaaaaaaaagtgtgctttgtcaagagaagcaccagcagacctctaagaaactgctctctaag

SEQ ID NO: 21333 - DNA, 365 bp, Homo sapiens
ggcaataattttagccacagaacatcctggttatatagaattgctcctgtgtagaataaaaatatatatgctctttttagttgagaggaaaatacgaaaatctcattttatatagccttgagtagagggcaatacgtaagacaaagaattctgcttagagaggaaagtgtcgccctggacttagaaatcttttttcatagatggtgcgtcctgtgttaggtattacttggaagaaaattgaagtaaaaaacagctttaagtaactgagtaattaggattaattagtagctgttgaatctaaatcccttaagactaaatttcattgcagctctgtaccctcagcaggacttcctttcttgattgtt

SEQ ID NO: 21334 - DNA, 201 bp, Homo sapiens
  misc_feature 45, 61, 84, 126, 161, 166, 192: n = A,T,C or G
gaaggccatatgcagttgtactctggtttggtattttttaaagancatgaaccatgattanaaaaccactaatattaatatatngaaacaataattttagatgaagcaattattcttgcttccttntgggttaagtcactatccaattcgccatcagaaangaatnttttcctcaggatatctattcttaanttcttcttt

SEQ ID NO: 21335 - DNA, 358 bp, Homo sapiens
  misc_feature 9, 26: n = A,T,C or G
gatttaagnaagcatcctctgccagnaccaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaattcaatg

SEQ ID NO: 21336 - DNA, 347 bp, Homo sapiens
caaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacatt

SEQ ID NO: 21337 - DNA, 372 bp, Homo sapiens
aacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgcca

SEQ ID NO: 21338 - DNA, 398 bp, Homo sapiens
  misc_feature 11, 15, 33, 362, 391: n = A,T,C or G
ttcattatggnccgnggtagctcctgagcatgnaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgnctccagtctacctccgagagattagctgnaacacag

SEQ ID NO: 21339 - DNA, 377 bp, Homo sapiens
  misc_feature 79: n = A,T,C or G
gaaagaaccctgatactgacctgcaggacgaaaccatgaagagcctgatccttcttgccatcctggccgccttagcggnagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgcccgagggaccaaatgagactgagggaagaaaaaaaatctcttttt

SEQ ID NO: 21340 - DNA, 313 bp, Homo sapiens
  misc_feature 157: n = A,T,C or G
gatctttgccaatgaaaatctaaattacatcatgaagatatttgtgtgtgtatggtcctcctgaattcatgcaaggatgtagttttgtactgaaagaataaacactgactctaattttcagtagcatttctctataaacatgcttgttcaatacaanaattataatacatcagaaaaatgttgtaatgccttttgaactgatctataacataacacattaaaggacaaaaggagacatatcactgctttgatgtatagttaaaaagagatgccatcatcacaattattcaaatagtttacagtgtatgtttag

SEQ ID NO: 21341 - DNA, 262 bp, Homo sapiens
aggagaagagcgaacagcctccttttacaaaagacagtcccatatgtcctggtttagtgcatctctcttcaaagatcactttgcattgagatgtcaggaaagcgtgacagctggatgaagcacctaccccagtttgcaagcaggtgggttttcggttttctggaccctcttacccagctcccagatggccatgcatttgaaaatcgccaattaggcactttgcagtcacctggagtttttctattgagacatgtttcaatct

SEQ ID NO: 21342 - DNA, 151 bp, Homo sapiens
gtcagttttcatgcttttttcttttttgtggaacagcttatatagaattggtgataggatcacaacttctggggtcccagcaagagtcctaacatctagcagctctaccaccaggacaggccccctaaaactaattccaacaagcacctct

SEQ ID NO: 21343 - DNA, 400 bp, Homo sapiens
  misc_feature 12, 18, 39, 49, 218, 257: n = A,T,C or G
gttttttgaaanggatcnctttgtacccagggccttttntccttatggnccggggtggtatgatgatgggaagaataccacgtaggaagaacagtggcagaaggaatatctcggtgccatttgctcctgcacatgctttggagtccagcggggctggcgctgtgacaactgccgcagacctgggggtgaacccagtcccgaaggcactactggccagncctacaaccagtattctcagagataccatcagagaacanacactaatgttaattgcccaattgagtgcttcatgcctttagatgtacaggctgacagagaagattcccgagagtaaatcatctttccaatccagaggaacaagcatgtctctctgccaagatccatctaaactggagtgatg

SEQ ID NO: 21344 - DNA, 357 bp, Homo sapiens
  misc_feature 17: n = A,T,C or G
gaactcggtggtggccnctgcgcagaccagtacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaacta

SEQ ID NO: 21345 - DNA, 381 bp, Homo sapiens
  misc_feature 351: n = A,T,C or G
agaaaaaaaaatgcctggtcagcaattcactgtcatgcacctatttttagattgggcagggagatgggaggagtcgtgatttttactttgaatactatttcactgacgttactaagcattgcagcacaatgtagaaattggcttgggatggataggtatagggaagggcattcgttgggaaattgatgaccggaaactagaaagcccctataatgtggaatatgcatatgtggggtgaaaccgtatactactttcactgccatgacactaggcaaaaaatatttcctgttaaaagaaagagaaaaagagagggatattgaaaaatataaggagttgagtcgctttgtggtntagaagggagtaaggaataaaagatataga

SEQ ID NO: 21346 - DNA, 246 bp, Homo sapiens
aagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagcccccaaaaaaaaaaa

SEQ ID NO: 21347 - DNA, 251 bp, Homo sapiens
gggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcgaagaaaagaatagagaagatagggaaattagaagataaaaacatacttttagaagaaaaaagataaatttaaacccaaaaaa

SEQ ID NO: 21348 - DNA, 362 bp, Homo sapiens
aagaacgaaagctggttcattctctatttcagacgccagctgcctgctacgggggaccagcgccaaaaactctgagttactttccccaggtgctaatcaggtgacaagcacagtggacagcctcgacagccatgacctggaaggggtacagattgacttcgatgccatcatagacgatggggaccactccagcctgatgtcgggggccctgagcccaagcatcattcagaacctttcccatagctcctcccgcctcaccacgcctcgggcgtccctcccattcccagcgctgtccatgagcaccaccaacatggctatcggggacatgagttctttgctgacctccctagcggaagaaagca

SEQ ID NO: 21349 - DNA, 266 bp, Homo sapiens
  misc_feature 264, 265: n = A,T,C or G
gatttgaggcccagtataagtgacagctgcagggccagaggacagagcagctgtccttggcaagaaggtcgtgatctggatggtgaggccagagttgctgaacacgtgggtgcctctgcctctcttaagggagtctgaggaagaatctggtggctttgacatcctcaatgggaagtgagaagccgccccctaccaagaggtcatgtaacaggagcaccttcaaaacagaaacaaaacttggatctggacagggaaaaaaagccnnt

SEQ ID NO: 21350 - DNA, 380 bp, Homo sapiens
aaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttat

SEQ ID NO: 21351 - DNA, 142 bp, Homo sapiens
  misc_feature 1, 12, 25, 26, 27, 28, 33, 34, 36, 37, 38, 49, 57, 59, 67: n = A,T,C or G
naggagaagaanaggtatttttagnnnnggttnncnnnttgacacgagnaaactcgntnattgtggnccggggaggcattggaggcagccagcgcaaggggctttctggctgagggggcaggcggagctttgaggaaaccgc

SEQ ID NO: 21352 - DNA, 361 bp, Homo sapiens
ccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaaga

SEQ ID NO: 21353 - DNA, 388 bp, Homo sapiens
  misc_feature 3, 36, 314: n = A,T,C or G
ggnaggagcctctctccctactgctgctacacaagnaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgcnatggtttatggatacaatgctgcctataatcgctacttcaggaagcgccgagggaccaaatgagactgagggga

SEQ ID NO: 21354 - DNA, 382 bp, Homo sapiens
gtcacattcaaaggaagaaatctcacaaaattgttatcgtcactatacaggcaacagtagacttgttgaaagtgttttttgtctaactattttgcattgtaatttatgtaaggtacattgtgtgattgccttattatagattctaatcggaataaatagctatgctattaaatggaattacgtacatgtaaccatggtttttagaacatgcctatatgaagatttatatgataatcttaggtaaacattttatatgtgaaaataatagaattggaaataatgacggacgttaaaggactttgaggtatccagaatgcaattaagagaggcagaagttgcataaatgttcagacatgtttataatttttagcatcccatcttt

SEQ ID NO: 21355 - DNA, 343 bp, Homo sapiens
  misc_feature 16: n = A,T,C or G
atttcaataaatccgnagaccaaaaagtattaaccgcaaactattttgaaaaccaagctattctttgtctcagtggtagaggaaagataaatatctggatatcaaaataacaaaaataaaaacagaggaaattagacaaatggggtcatggaaaaacacacaggctgaccagcacttacagaaatgtaatcacatattgtagccaggttgtgcccaaacagcttggattcattctaactcaggactgaatataataaatcctgaagagcccgttagccaaatgtcttcattacagtggtataagcccagtagtttaatctgcgtttttcatcaagtgtgacgc

SEQ ID NO: 21356 - DNA, 167 bp, Homo sapiens
  misc_feature 89: n = A,T,C or G
aagaacagaatgaagaaagtcagggggactgcaaaggccaatgttggtgctggcaaaaagtgagctggagattggatcacagccgaagnagtaaaggtgctgcaatgatgttagctgtggccactgtggatttttcgcaagaacattaataaactaaaaacttcaaa

SEQ ID NO: 21357 - DNA, 107 bp, Homo sapiens
  misc_feature 66: n = A,T,C or G
gaggcatgagaataacttgaacctgggaggtggagcttgaagtgagccaagattgtgccactgccntccagcctgggtgacagagtgagactctgtctcataaaaaa

SEQ ID NO: 21358 - DNA, 362 bp, Homo sapiens
  misc_feature 150, 179, 204, 236, 246, 360: n = A,T,C or G
ggggcattcctgagtctgacagcattcgggccgaggatgtctcgcttcgtggccttagctgtgctcgcgctacctctctctttctggcctggaggctatccagcgtactccaaagattcaggtttactcacgtcatccagcagagaatgnaaagtcaaatttcctgaattgctatgtgnctggggtttcatccatccgacgttngaagcctgacttactgaagaatggagagaganttgaaaaagnggagcattcagacttgtctttcagcaaggactggtctttctatctcttgtactacactgaattcacccccactgaaaaagatgagtatgcctgccgtgtgaaccatgtgacttntg

SEQ ID NO: 21359 - DNA, 143 bp, Homo sapiens
  misc_feature 33: n = A,T,C or G
gaactgacaattaacagcccaatatctacaatnaaccaacaagtcattattaccctcactgtcaacccaacacaggcatgctcataaggaaaggttaaaaaaagtaaaaggaactcggcaaatcttaccccgcctgtttacca

SEQ ID NO: 21360 - DNA, 212 bp, Homo sapiens
tatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcactttctaaatttaaaagaaaaca

SEQ ID NO: 21361 - DNA, 372 bp, Homo sapiens
agccgaccatctttcaaaacaagtaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccgggcctctgagcaa

SEQ ID NO: 21362 - DNA, 370 bp, Homo sapiens
gacctttttgaggtaattggagtagtgttgctgtgctgcagtcggtagaaaatcctgaaccgtttatcaactatgatttctcactgatagtatggtaactttctggtaagcaatgctctaggggaacatttgcacatgttgtgactttttgttgttgttgttgaaaagtaggattattttttcagccactaacaaccaagagaaaagattatttgtttctcccttttctctgttaatttaatctggtttatatattgaattcgcagaccaacatcattggcatgggaagtaaagaagatgtctccgggacgccatgtgattccaagtccatcaacagatagaataaatgtaacatcaaatgctcgacgaa

SEQ ID NO: 21363 - DNA, 344 bp, Homo sapiens
  misc_feature 1: n = A,T,C or G
ntgtgttggaaactgaagcgccagtgcaacagtattgagaggtagaaactttaagaggtgatcagtgctgggtgcagtggctcacgcctgtaatcccagcactttgggaggccaaggcgggcagatcacctgaggtcgggagtttgagatcagcctgatcaacatggagaaaccctgtctctactaaaaatacaaaattagctgggtgtgttggcacatgcctgtaatcccagctactcaggaggctgaggcaggagaatcacttgaacccaggaggcggaggttgcagtgagccgagattgtgccattgcactccagcctgggcaacaagagtgaaactctgt

SEQ ID NO: 21364 - DNA, 230 bp, Homo sapiens
  misc_feature 226: n = A,T,C or G
atttatcatgagtattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgactcagtgtaagtttctgtcagcagtagtttcacccatttgcatggaaaaatttaaagctaataaagcanttta

SEQ ID NO: 21365 - DNA, 328 bp, Homo sapiens
tgcaggtaactgcagaaaggatgaaaggaaggaattctgttgttcaggagaagtttgtcaccagtaagattgaaagggaaatctcctttcgttgatacctgaaaagaataatgaaacactgttcatcttgcataatgacttaaagctcatttattcagaaatctgctcttacagtgttatgacttatgttcccaccatttcaagatgcaagtgtatgtgtgaaaacccttagaattaatggtagtggttacctcttttaaaaacaaaattgttaaaatcccaaacagtattattaaaatacttataactcaggcttcatatattcacg

SEQ ID NO: 21366 - DNA, 239 bp, Homo sapiens
  misc_feature 3: n = A,T,C or G
ggnaccagaaagtaggttagcagttaccagtaggttcttggagaatagggataatggggagtgattgctaatgagtactgagtttctttttggggtgatgaaaatgctctagatttatataatggttattattgcataactttgagaatatactaaaactgactgaattatacattttaaaaagataaattttatggtattatgattacatgtcaatgtaaatatatgcatacatattc

SEQ ID NO: 21367 - DNA, 299 bp, Homo sapiens
  misc_feature 12: n = A,T,C or G
gaaacctgtagnaaatatacattgtaaaataattccgtgggtaacaaagaaagtctcaagggacataaatatattgaactgaatgacaataaaaatagaacacgtaaaaatttgtggatcacagctaaagcaactttgagagggaagtttatggcacaccacacaggtacattagaaaagaggaaaagtctcaaatcagtaatctaagttcatagttcaagaacctaaagaagagctgtaagtatccaaagcaagcagaaggaaggaaataatattaagaacaaaagtcaataaaattg

SEQ ID NO: 21368 - DNA, 306 bp, Homo sapiens
  misc_feature 2, 160, 208, 233, 270: n = A,T,C or G
gngcttaacctgtaccagttatacttatgattgaaggcctaatatctggtcagaaatcaacatctaattattatattattttaatgaaaaaaatttttgtggtagttaactaggaatgtaaattactaaaaaggattgcttataattaatagtaattgcntacaattttgtggagttgcagcttaaaatggattagaaaatttccagntttgttttatatttttgaaataaanattttaactgggtatctttccaggtaagtacaaaggngggctgtgcatgccctcaaaagaaaaccccagaggg

SEQ ID NO: 21369 - DNA, 366 bp, Homo sapiens
  misc_feature 133, 326: n = A,T,C or G
atcttagttgcattgctgtttgtaatttctctcttcttgtcaaatttagataaagctcttcattcagctggaatagattctggtttcataatttttggagctaacctgagtaatccactgaatatgcttttgnctttactacaaacagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgnccttcacactagctacatgatttatagtcttgctccccaa

SEQ ID NO: 21370 - DNA, 162 bp, Homo sapiens
tgtccatggtatttagctacatgaggatatctggctgcacgcctgatggggtagtaggctgaagagtttacgggaggcaagggcactccattctgacacagagagtccaagggaatgtaaaggccaaattgtttcctcagttcagggcctacttggagctag

SEQ ID NO: 21371 - DNA, 373 bp, Homo sapiens
  misc_feature 274, 366: n = A,T,C or G
ataatcctaacattgtaaatgctgtttattggttttaattttagaatcaacctatagacaaagcacggaagacttatgaacgccttgttgcccagttccccagttctggcagattctggaaactgtacattgaagcagaggttactattttattttattttttcttatatcagcattgcagcattcactgtagtgatagaaaacaagttaggaacatagccaattaggacaaggaggatttaaatgtgtcttacctttattttgtaaaataggnataaaggagtaattaaaatgaatttttgaaatttgggtcttttacaagctgatgattgttgcattttggagttgcaacaacattaaaacagnttcaatg

SEQ ID NO: 21372 - DNA, 190 bp, Homo sapiens
atatgagataaagcatgtggagtatttcatacagtgcctggggcagtaaggactcataaatgttagaagaggaagatatttattaataacgtgcagcatgtaccagggattgtgctaatgatacgtccatgaggtttatagcctcaaggagctgaaattctattgcagaagtcagacaataattaaacac

SEQ ID NO: 21373 - DNA, 299 bp, Homo sapiens
  misc_feature 266, 269: n = A,T,C or G
gagttccggcctccaaggggcgggcagaagttggaaacatgcggctgtcggtcgctgcagcgatctcccatggccgcgtatttcgccgtatgggcctcggtcccgagtcccgcatccatctgctgcggaacttgctcacagggctggtgcggcacgaacgcatcgaggcaccatgggccccgtgtggacgaaatgaggggctacgcgggagaagctcatcgactatgggaagctggggagacactaacgaacgagccatgcgcatnggntgactttctggctaacagaaaaaggatttg

SEQ ID NO: 21374 - DNA, 322 bp, Homo sapiens
  misc_feature 189: n = A,T,C or G
ggaggagagttagcccaagtataggctctgcccagtatgccatcacatccctgatactgtgtatgctttgaagcaccttccctgagaagggaagaggggatctttggactaggttcttggctccagacctggaatccacaaaagccaaaccagctcatttcaacaaaggagctccgatgtgaggggcanggctgccccctgccccagggctcttcagaaagcatctgcatgtgaacaccatcatgcctttataaaggatccttattacaggaaaagcatgagtggcggctaaccctgaccaataaagttattttattgattg

SEQ ID NO: 21375 - DNA, 260 bp, Homo sapiens
ggccctgagctgatggggtcaaatgaaggtgaattcaaggctgaaggaaatagcaaatccacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatccca

SEQ ID NO: 21376 - DNA, 368 bp, Homo sapiens
ggcagataatttttagcttagggcctggtggctaggtcggttctctcctttccagtcggagacctctgctgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatggtttcactataacgctgctttagaatgaaggtcttcca

SEQ ID NO: 21377 - DNA, 371 bp, Homo sapiens
  misc_feature 180: n = A,T,C or G
ggacgctgagcgagcgacaacagcggcagctcgggaatgggggctcggagcgcggcggccaagttttatgttatgtatattttacaagtaaaaaaattttttcacctcagcctgaactgaacactagctgacagacgttttgatttctttgaccatcacggaatcgtggccaagcgcggnggctcacatctgtaatcccagcactttgggaggtcaagatgggcggattgcttgaatccaggtgtttgagatcagcctgggcaacatgacaaaaccctgtttctagtaaaaatacaaaaattaaccaggctcaagccatgaccatgcaccattgcactccagcctaggcgacaggagcaggaccctgtcgc

SEQ ID NO: 21378 - DNA, 346 bp, Homo sapiens
  misc_feature 2, 14, 32: n = A,T,C or G
tntttggccggganttgtggccagggttcacnttggccaagttatcatgtccatccgcaccaagctgcagaaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccaatcgtggccctctggacaagtggcgggccctgcactcatgagggcttccaatgtgctgcccccctcttaatactcaccaataaattctacttcctgtcca

SEQ ID NO: 21379 - DNA, 355 bp, Homo sapiens
  misc_feature 26, 330: n = A,T,C or G
gatgaggcaaatttctatctattgtnatactctataaaagtcatcactatcctaggtaagagtaatcaaaatctcaggttaaccatttagttttgcttttcaacaatattttagggctataaacatctttaatcaatttaggagttatttgtgatagctgggcaaaatttgttccagaatgattcaaaactgacaacagagacttttccctatgaccttgaatactggtggaagtgactttaaatatgacccaagggggaaggaaaaaagtatgtatatagggttagaagaaatgttatgtgtacacatttttttttcttaagagttggngctgagaaaactggatatccacatg

SEQ ID NO: 21380 - DNA, 382 bp, Homo sapiens
  misc_feature 16: n = A,T,C or G
atggatggtggttttnagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtgg

SEQ ID NO: 21381 - DNA, 312 bp, Homo sapiens
  misc_feature 7, 9, 12, 14, 23, 26, 28, 30, 31, 34, 41, 237: n = A,T,C or G
aggtttnanctncntccactgangtnanannttnctgtccntttgttttactttcttaattgttgctactaattaaatgttaataaaaaataaaagtctttaaaaattctgatttggccttgcaatatgcgattagaacacttgtaaaaatgcaaacatataaataatgcaaaaataatatttgaaaaatgtaatcgttcttaatgttattgaacatccaaaagttattgacgaagnattcagaagcattttagattattgtaaaatattatttaaattatatttaattaaaaaatgatatacattactcag

SEQ ID NO: 21382 - DNA, 365 bp, Homo sapiens
  misc_feature 9, 12, 363: n = A,T,C or G
gagggagantcntggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaacctttaggtttactttcacttgttatttgacttagcaggngc

SEQ ID NO: 21383 - DNA, 375 bp, Homo sapiens
  misc_feature 3, 14, 28: n = A,T,C or G
ggncgcagggaganttgcgtcatttaangcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaaatgaaaatattgtcaagagtttcagatagaaaatgaaaaa

SEQ ID NO: 21384 - DNA, 388 bp, Homo sapiens
  misc_feature 9, 131, 168, 170, 311, 344: n = A,T,C or G
ccccaattntcagggaaatgcaaatcaaaacccaatgtgataccacctctactcctgcaagaatgacccttaaaaaaaaaatagatgtttgtgtgaatgtggtgaacagggaacagttctatacttctggngggaatgtaaactagtacagccactatggaaaacagngnggagattcatttgagaactaaaagtagaactatcacttgatccagcaatcccactacaatcccagaggaaaagaactcattatatgaaaaagatagttgcacacacgtttatagcagcacagttcacaattgcaaaaatgnggaaccaaccttaatgcccatcaatcaatgagnggataaagaaaccggggtatgtttatatgtgctggaatactact

SEQ ID NO: 21385 - DNA, 400 bp, Homo sapiens
  misc_feature 4, 10, 28, 32, 35, 36, 45, 55, 56, 61, 68, 77, 98, 107, 177,247, 271, 274, 286, 308: n = A,T,C or G
tccntgactnttaaaatctgagggaaangttntgnnaacctttanttttttttanngagangatgaanggcaggccnctttcctcacaagaccacacncactatacncgaatagacatcaaactcaatgctttatttgtaaatttagcgtttttttatttctactgtcaaatgatgngcaaaaccttttactggttgcatggaaatcagccaagttttataatccttaaatcttaatgcctcctcanagcttggattaaatacataatggntgntactctcttgcnccaaattatcttgatgcattcnaatttgtctggttaaaaaataggtggtagatattgaggccaagaatattgcaaaatacatgaagcttcatgcacttaaagaagtatttttag

SEQ ID NO: 21386 - DNA, 382 bp, Homo sapiens
gagtggataaacttgagcagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctc

SEQ ID NO: 21387 - DNA, 376 bp, Homo sapiens
atctctagggatgtttaacccttcacttgcaaaataaaccaactctaaaaaaagaaactaagagagaattggtactttaacttacttgtgtgtttgcaaataggctcctttttccctgttgagtagattactaaccttcttaactatgcataggcctaagaaaggtggcaatgaactgtgcatgtaaattttaaatgggtactttgtgcaattcgttaaaagaagatactctatgaatatgattctatatattgaaatcagaaaacctaccaaacaaaaacatcagaagctgctgccataatgactattttctactgtaggctgctttggaaataattcccatatccttgctttgtaagttggtaatatcactatg

SEQ ID NO: 21388 - DNA, 376 bp, Homo sapiens
gatagttgtgtgtatgtgtgtgtggggtggggggatggtaagagaaaagagagaaacactgaaaagaaggaaagatggttaaacattttcccactcattctgaattaattaatttggagcacaaaattcaaagcatggacatttagaagaaagatgtttggcgtagcagagttaaatctcaaataggctattaaaaaagtctacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcact

SEQ ID NO: 21389 - DNA, 400 bp, Homo sapiens
  misc_feature 8, 25, 75, 293: n = A,T,C or G
taacttangtctttctccaagtgcntgcagtcttttgcgtacctccttcagccgagtattttgtactcttcctcnttcagtacaaggaagctttcagtttgcttagaaggcaacattggaatgttagagttcatcagaaacatagaattttaaactgtgggttccacctgaatacattttaatgtctgtaggaagaatcaaaacacctatttaaagatggcaatatataataatcattttaaaagtatttgattcaacctaattttccagaaatgaaaaaaaaaaatcagctntaaaaccaaagctgatttcagaaaatttgaaaatgtaaatcagccctatccataatatagggttctctaaaactttatcttagtcattttaaaataatataactatt

SEQ ID NO: 21390 - DNA, 372 bp, Homo sapiens
gacagcaccctcctgaaaactgcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactggagatttccttcatactgggccaggaatttgaacgaagtcactgcagatgacagggaaagtcaagagcaccataaccttagatggggggtgtcctggtacatgtgcagaaatgggatggga

SEQ ID NO: 21391 - DNA, 399 bp, Homo sapiens
  misc_feature 12, 30, 89, 216: n = A,T,C or G
aagtgcatgtgntccctctgaacacttccnttgttatgccacccagaaacctactggagttacttcttaacctcaaggctggaacctantttgcctcagtcctatctgattcatgagcacatggttattactgatcgcattgaaaacattgatcaccctgggtttctttatttatcgactgtgtcatgacaaggaaacttacaaactgcaacgcanagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttt

SEQ ID NO: 21392 - DNA, 100 bp, Homo sapiens
  misc_feature 28, 32, 34, 52, 53, 54, 55, 56, 57, 58, 59, 60, 61, 62, 65,67, 68, 69, 70, 71, 72, 73, 74, 75, 76, 78, 79, 80, 83,84, 85, 86, 87, 88, 89, 90, 92, 93, 95, 96, 97: n = A,T,C or G
ttttggtcccccgggtactttcggcctntatngnccgggggaacctttatannnnnnnnnnnttngnnnnnnnnnnannnaannnnnnnnannannnaaa

SEQ ID NO: 21393 - DNA, 372 bp, Homo sapiens
gaactcggtggtggccctgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaacttttgtaagatgcaaagaggttggatcaagtttaaatgactgtgctgcccctttcacatcaaagaactactgacaacgaaggccg

SEQ ID NO: 21394 - DNA, 191 bp, Homo sapiens
  misc_feature 11, 12, 29, 32, 74, 87, 107, 109, 113, 141: n = A,T,C or G
cagatgcgttnntagaagaagccccacgntanccaggaagggactggctcgtgtttgtcgcttttctccaagtnagcacccaaaggncaatgcacaagagaccccgngngggngagcgctggcttctcaaacggccgaagntgcctcttttaggaatctctttggaattgggagcacgatgactctgagtt

SEQ ID NO: 21395 - DNA, 377 bp, Homo sapiens
gaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgtcagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatg

SEQ ID NO: 21396 - DNA, 399 bp, Homo sapiens
  misc_feature 23, 34: n = A,T,C or G
gctgcaattctcttgtctgttcnttgtgtaatantgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacatttgggtttagttttatgaaacgatttaccttcatgatctcatagttaaaattgtaataaatttaggaatataaaggatcaatatgggaagcaaaatttcta

SEQ ID NO: 21397 - DNA, 368 bp, Homo sapiens
  misc_feature 5: n = A,T,C or G
aactnacgataaaataatcttggatttagggtgggccctatgtccaacagctggtgtccttataagaaggagaggagacggctaggcgcggtggctcacgcctgtaatcccagcactctgggaggctgaggtgggcagatcatgaggtcagggagatcgagaccatcctggctaacacggtgaaaacccgtctctactaaaaatacaaaaaaattagcccggcatggtggcaggcgcctgtagtcccagctagtcgggaggctgaggcaggaaaatgatgtgaacctgggaggcggagctttgcagtgagctgagatcgtgccacttacactccagcctgggtgacagagcgagactctgtctcaaaa

SEQ ID NO: 21398 - DNA, 388 bp, Homo sapiens
  misc_feature 4, 231: n = A,T,C or G
tggnggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttntaaatttagcttgtgctttctgaattacaggagaagggaatcataatttaataaaacgcttactagaaagaccattacagatcccaaacacttgggtttgggtgaccctgtctttcttatatgaccctacaataaacatttgaaggcagcataggat

SEQ ID NO: 21399 - DNA, 375 bp, Homo sapiens
  misc_feature 35, 46, 290: n = A,T,C or G
gacagcaccctcctgaaaactgcagcttccttctnaccttgaagantaatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcnctgcagatgacaggaaagtcaagagcaccataaccttagatggggggtgtcctggtacatgtgcagaaatgggatggaaaatcaa

SEQ ID NO: 21400 - DNA, 214 bp, Homo sapiens
  misc_feature 6: n = A,T,C or G
attttnagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaa

SEQ ID NO: 21401 - DNA, 148 bp, Homo sapiens
  misc_feature 3, 35: n = A,T,C or G
tgnggggaagcagtgataacatggagtgaaactgntgtggagaaataggaacactttcacactgttggtgggactgtaaactagttcaaccattgtggaagtcagtgtggcaattcttcagggatctagaactagaaataccatttga

SEQ ID NO: 21402 - DNA, 399 bp, Homo sapiens
  misc_feature 9, 309: n = A,T,C or G
attcgtttnttatggccaggggtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgccttgtgtgcgtgtccttaaacttccaatcttactttggctcttggagattgttgaacgcagcttgtctaggaaggggatgggactaggattctaaaatttatttgggaccatgggaatgatngttgggaagaaaactatttgcacacgacagatttctagatactttttgctgctagttttatgtaatatttattgaacattttgacaaata

SEQ ID NO: 21403 - DNA, 400 bp, Homo sapiens
  misc_feature 2, 8, 34, 35, 38, 42, 63, 64, 73, 86, 114, 129, 179, 195,226, 228: n = A,T,C or G
cncggggnttctttccccatacttgcatgtatgnnggntganaaagttgacaaagccagcatnntaaaggagnaagcaacccgagnccagaggaaggattagatgctggtggcnaggtgaaaaagggtnaccctcaaagctaaaaagcccaaggaggggaagccccattgcagccgcancccctgtccttgtcangaggaattggcaggtattcccgatctgccgngngttccagaaaggccatgtgcaagaggaagtactcagccgctaaatccaaggttgaaaagaaaaagaaggagaaggttctcgcaacttgttacaaaaccagttggtggtgacaaggaacggcggacccgggtggttaaacttcgcaaaatgcctagatattatcctactgaag

SEQ ID NO: 21404 - DNA, 107 bp, Homo sapiens
  misc_feature 3, 17, 52, 70, 84: n = A,T,C or G
tantatggccggccagngaaataggaatcaagttcatccagcaactgggagnaagaattgggaagaaggngctggaggtttaanaagagagaggaaaaggtgtgaag

SEQ ID NO: 21405 - DNA, 398 bp, Homo sapiens
  misc_feature 1, 9, 27, 51, 52, 60: n = A,T,C or G
ntttttttntacccccgggcaattcgnttcattatggcccggcaaaaaaannaaaaaagnaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtctagta

SEQ ID NO: 21406 - DNA, 242 bp, Homo sapiens
  misc_feature 3, 6, 27, 30, 36, 39, 41, 45, 48, 51, 52, 66, 68, 69, 79,86, 93, 102, 107, 112, 130, 159, 167, 170, 189: n = A,T,C or G
ttntantatgggactctacgatggcantgnagaatngancnccgnctnacnngctttaagtggatntnntgcgtgagcngctcggngagtagntcgaaattncacgncatgngcgcaccacacccagctnatttttgtttttttagtaggagacggggnttcaccantgntggccaggctggccttganctcctgacctcaggtgatccacccgccctggtcccccaaagtactggggttac

SEQ ID NO: 21407 - DNA, 359 bp, Homo sapiens
  misc_feature 11, 18: n = A,T,C or G
gtgattgcagnaaccagnagggacacacagttttgacggcatttggaaggccagcttcaccaccttcactgtgacgaaatactggttttaccgcttgctgtctgccctctctggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcgaggataagaagtatacctga

SEQ ID NO: 21408 - DNA, 400 bp, Homo sapiens
  misc_feature 4, 16, 32, 119, 244: n = A,T,C or G
tttntaccccgggtcnattcgttcattatggnccgggccttcgaatattcaataccgctcagtattttaaatgaagtgattctaagatttggtttgggatcaataggaaagcatatgcngccaaccaagatgcaaatgttttgaaatgatatgaccaaaattttaagtaggaaagtcacccaaacacttctgctttcacttaagtgtctggcccgcaatactgtaggaacaagcatgatcttgntactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataa

SEQ ID NO: 21409 - DNA, 398 bp, Homo sapiens
  misc_feature 14, 16, 27, 41, 48, 54, 55: n = A,T,C or G
tttcttttttaccncngggccaattcnttttcatttatggnccggggnacgggnnaataatttccgtctgatctatgacaccaagggtccgctttgctgtacatcgtattacacctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttagagactggcaagattactgatttcatcaagttcgacactggtaacctgtgtatggtgactggaggtgctaacctaggaagaattggtgtgatcaccaacagagagaggcaccctggatcttttgacgtggttcacgtg

SEQ ID NO: 21410 - DNA, 237 bp, Homo sapiens
  misc_feature 2, 11, 73, 231: n = A,T,C or G
tncattatggnccggggaatataaaataactataattcgagttgggtttaaatgagttttaaatttgaaaggnctatcaagaactacacaatggaggaaaacatttcactgtagatgtatataggaatgtgctccaattgtctactttctatcactgttaagtaaaatgaaccaaaatatttacttagcttgtaagatttaggcttaatttctacaaatagacaaattggngtatac

SEQ ID NO: 21411 - DNA, 100 bp, Homo sapiens
  misc_feature 3, 8, 11, 20, 25, 29, 30, 31, 32, 33, 38, 43, 49, 50, 69: n = A,T,C or G
tgnaaagnaanactgggggnccggnccannnnntcagnatggnccgggnngcattgaggcagccagcgnaggggcttctgctgagggggcaggcggagcg

SEQ ID NO: 21412 - DNA, 400 bp, Homo sapiens
  misc_feature 10, 24, 217, 220: n = A,T,C or G
tcattatggnccggggtcttaaangccatcatgaaagtaaggtattttgttaggcatttacaaatacaaaatatcatagactgtgtctccattctagactcaacaaatgatctcattagtgaaagaatcctagggacatcagtgttatccacacttggcctatccagattctcttataacacaggcctgtgatatgcttcttcctatcccttctganagnaccatgcatgagctgcaggctctttgtgtctctttacaagtattattttcaaatgttgtaggggccattactagaaagcctgaggtatacattggaaaaatatatatattaaaaatgagaagtcttggccaggtatggtggctcacgcctgtatcccagcactttgggaggccaaggcgg

SEQ ID NO: 21413 - DNA, 400 bp, Homo sapiens
  misc_feature 4, 22, 32, 56, 102, 337, 367, 368, 382: n = A,T,C or G
cttntacccaggggcctttctnttcttatggnccggggaaataatacatactaggnaaaatctaaacttggctaacacgtaggggaacaactgcctttagcngggccagattaatcatttcaaagacatccattttagcatcacaagcaggaaggcgatagtctcaaaggcactttgtttctcccaggtaggccaccaggcagcctctagagttgctttacccaaatccttctccagccatgactgggggactctaagcttgctcccacctgccccctccacttccctcagatgatgaggagccagggctaagggggcagccttctctcttcccagngatgcacatccttcacattggctgctttgnnctggaatatggatntctcagcctggatgccga

SEQ ID NO: 21414 - DNA, 367 bp, Homo sapiens
  misc_feature 14: n = A,T,C or G
gtgtggagcaaagnagcagttaagcaacatgaggaagaatcacaactggacaacctaaaggtaagttgcctagaatcacagcagtgcttaaagtagtgaatggcttcgtcagctctgaggggcagcaagcctgtttctgtccttctctgagctaagaaaattgtgctagtggcctggaatggcttgaggctggtaattgtggagaaatacctgctcttaacaaaagtgctctctctttctggcacacctttctagtacctctctgcaaattagtattggtctgtctgtatgctcttttaattataaacagaaacagttgaactcttaaacaggctgatcagtagaaccactggctagaattaacagc

SEQ ID NO: 21415 - DNA, 351 bp, Homo sapiens
gaatgccgtcccatggaaagtggctgtcctgggaggctacacgtttctccaatggtgatgctgttgctcagaacttgctagaggtctttagggaacctccgtgagagctgcagcacctttttaattttctcggtgtcatcctctgagtatggattttctgtttttaaacagcccaaagtttagaagggtattttctaatgtggctcataaaccaccttttaaggcctttcctcaaacaggagttctaaataagtctccaacaatagtaagttttgttggagctaaggatgtaactactttgagggagaaatgttcgtttagatttctacattctgttatgttggttttaga

SEQ ID NO: 21416 - DNA, 368 bp, Homo sapiens
  misc_feature 2: n = A,T,C or G
gnccctcccagtacgcagaacatctcaccttcgttttatcattgcaggcaacaggcagtatagtctagttctgaaaaagacaaacagagattcagaaatacaaagatcagcacaaaacattagaaacatcagacatttaagaaagtcaatctaataaaggaagacagcaaactcaacaaacccaagttctgagaactaaggaaatcaaattaatacagcaattatggagtgatgagagaggacattgcatccaaataaaaataattgacataggatattttgttgaaataaaaggaaaaatcagtagttgtactgagtgtagaaatcagaagtcctatgaggggttctagagggaaagaacacagagc

SEQ ID NO: 21417 - DNA, 309 bp, Homo sapiens
  misc_feature 3, 55, 110, 119, 201, 207, 211, 225: n = A,T,C or G
aancttggaggttgagggtgcagtgagccgtgattgcaccagctggattgcactngagcctgggcaacagagcgagaccctgtctcaaagtaaataaataataaaatggngaaaatggngaatttcagttatgtgagttgtatttaaaaaataatggcatttagaaagactttcagaaatgtgtactttatgtcttggacngggggnaggnggtttagctagagnggagtctttgtaagggggagcggtggatgctaagggtgggaaaaggtttggctagatattgaaagatattgactggctaaggag

SEQ ID NO: 21418 - DNA, 255 bp, Homo sapiens
  misc_feature 62, 206: n = A,T,C or G
ttccctgtcagcagcagaaatgctgagtcatcagtattctgttacagttcattgaaagcagngctgacagtggtgcggccagatggacaatagtgagagctccagggccccagctcagtgctgcacacaatgggtgacaccaaagaaaagcttttattaaaataatacagtctataatgaagaaattaaattttacaaaacttcancccactctccagatgattaaatgaattattaggaatatttcttttctaa

SEQ ID NO: 21419 - DNA, 381 bp, Homo sapiens
  misc_feature 1, 8: n = A,T,C or G
ntaaaatngcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtgg

SEQ ID NO: 21420 - DNA, 374 bp, Homo sapiens
  misc_feature 251, 329: n = A,T,C or G
aagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcanagaaactattaaaggtattcagaaacgtgaagccagcaattgtttcgcaattcggcattttgaaaacaaatttgccgnggaaactttaatttgttcttgaacagtcaagaaaaacattattga

SEQ ID NO: 21421 - DNA, 372 bp, Homo sapiens
ataacccaaaaattaaattgaaacaaaatgtcccaactaagaaaatatatagagcattttatttttttttagtgttgtaaaatattaacctctgtgagatcctttgtatcttaatgcattacctttacacatatttattcttattttctctcctttcagagtttacatttttatatttaatttactatttcagatttttaaaatagtatagaaaaaagtaggagtgatagagaacaaaaatactcttatacagtgcaaccccaaataccgcgaatgcatcagctaaagcagcgtgtaaataggagtgacgagaaagttaatggagtattttattttcaaagttcctgataagcattggaaagaaatcgacat

SEQ ID NO: 21422 - DNA, 304 bp, Homo sapiens
ggacagcactttccatgtggtgcttccgaccctggctgtcagagtgaaatgtaaagtcagggctctgtacagttttgccatttcactgttctgctttaagcttagcttattagaactcttggtggagggtgcgtacacacattccagaaaaggcttcactcgctgggaacgtcaacccagcgagaaaggaggggaagccccttctccggggaccttatctgtggactcaggaatgatggtgtttattgcaaatgcacaatctttttcccattgaaatgtcatcacactggaaattgtactatat

SEQ ID NO: 21423 - DNA, 359 bp, Homo sapiens
gacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcat

SEQ ID NO: 21424 - DNA, 376 bp, Homo sapiens
atacatatacatacatgcacacaaatacgtatacctataggagctgtttgacttgtcttaaagtatgaaaagatttatgtttaaaattaaatgtgaaaattcaccaaaaaaagagaggaagagctgtaagggtgagcagtctagggtaggatgatggtgacccttaggggtgggtcaggaggtgaggccaccaaggtcatggccaagagaatgtgaactctcctcagtgagttaccttaaaagttaatagtcaaaactgggcatggtggcttacgcctgcagtctcagctactcagaagtctgaggcaggaggatcacttgagccccgtagtttgaagtccaggctgggcagcatagtgagaacctggctcttaaa

SEQ ID NO: 21425 - DNA, 371 bp, Homo sapiens
  misc_feature 1, 203, 205, 206: n = A,T,C or G
nagcatcacaaatctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacngnnagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaa

SEQ ID NO: 21426 - DNA, 353 bp, Homo sapiens
  misc_feature 60, 205: n = A,T,C or G
gaaattctggtgtctctcaaaaccctgatcctgccaaaaccaagaatcgccgcaaaaggnagccatccacttctgatgattctgactctaattttgagaaaattgtttcgaaagcagtcacaagcaagaaatccaagggggagagtgatgacttccatatggactttgactcagctgtggctcctcgggcaaaatctgtacgggnggagaaacctataaagtacctggaagagtcagatgaagatgatctgttttaaaatgtgaggcgattattttaagtaattatcttaccaagcccaagactggttttaaagttacctggaagctcttaacttcctcccctctgaatttag

SEQ ID NO: 21427 - DNA, 312 bp, Homo sapiens
  misc_feature 201: n = A,T,C or G
gagttgtagaggagaaatgtgtcgtagttttagatatctcaatttgttagtagtatctgtagtgctcccagatagaaatattcactgggagccagaaatgcaggattggaatttgagagaatgtagagcttcaaaatcaaatgagaattagtgtgttagttctattatatcagtaagtggaagcttgtaatgaaggcagancccagaaagtatgtcatagagctataagaggagaaggccaaggacagaacctaattaaacactagtattaagggacagtcaaaggaagagaaaattaagaaagaataaagg

SEQ ID NO: 21428 - DNA, 379 bp, Homo sapiens
gggtcagaaggctgggcagcccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgag

SEQ ID NO: 21429 - DNA, 375 bp, Homo sapiens
  misc_feature 3: n = A,T,C or G
ccnaactatgtgagtgaattttaaaagacagaaaagtccagagttgaaatgctcaccagtggttttaaagtcatttcacagagaggcctcggagagtctcattgtactccacattattcacataaaagaacttcacttaattttccccagcttcaaaggagagcactactaaacattggttcataaatcagtaactactgaagcagaaggcaagaccagagaaataaattatatgcacatataaagaaaagcaaatatttatgtcagaaggcaaacaagttttacctttatgatgtgtcttgaacttttcctctattctgagaaaccccttgcattaaaatattcattttcccagcctgggcaacaaaagcaaga

SEQ ID NO: 21430 - DNA, 376 bp, Homo sapiens
cacagcttctccaagcatcaccctgggagtttcctgagggttttctcataaatgagggctgcacattgcctgttctgcttcgaagtattcaataccgctcagtattttaaatgtagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatc

SEQ ID NO: 21431 - DNA, 377 bp, Homo sapiens
atttacagaagtattttggaagaaggtgctggctatttgttatggggaaaggatggattaattgctaccccatacttaagtatgttcttttttccttttttgtaatggcagtttgtcagtgtgaaataaaatgttcttttttaattaaaatctaaattaaaaattaaacatggagacaaaaggaaaataggctggcatttttacagtgtcagggtgggttagcaaagacatgatatcagaagcagaaaataaagtgatccgtttgactaaatagaaacaaaacatatagcagagacttgtaaataaaattgaaggcaatcagtagactgggaaaatacatttgtaattttattgacaaggggtcaacattcttacta

SEQ ID NO: 21432 - DNA, 371 bp, Homo sapiens
gggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattaggtgttgtgcacttcatgtcattaatcaatttctcaatagttcttaaaa

SEQ ID NO: 21433 - DNA, 364 bp, Homo sapiens
  misc_feature 205, 207, 244, 315, 354: n = A,T,C or G
gacttagtaaactgccttcctgggtgatttgcatgtgtcttagtcttagtcaccttattatcctgacacaaaaacgcatgagcgtacatgtctacacatgactacacaaatgcaaacctttgcaaacacattattatgcttttgcacacacacacctgtacacacacaccggcatgtttatacacagggagtgtatggttcctgngngcactaagttagctgttttcatttaatgacctgtggnttaacccttttgatcactaccaccattatcagcaccagactgagcagctatatccttttattaatcatggncattcattcattcattcattcacaaaatatttatgatgnatttactctg

SEQ ID NO: 21434 - DNA, 251 bp, Homo sapiens
agagcagtgtcatccaatagaaataagatataacctgtgtatgtaatttaaaattgtcatttggtgcaatggctggtgcctataatcccagttacttgggaggctgaggcagagggatcacttgagcccacaagttccaggcttcagtgaactatgatcacatcactgcactccagctctgggtgacaaaggtgacaaaggaagaccgcatctcaaataaatacataaataaataaattttctagtagcca

SEQ ID NO: 21435 - DNA, 200 bp, Homo sapiens
catttgtattgtacataaaattttctagaaatacacttttttccaagtgtaagtttgtgaatagattttagcatgatgaaaccgtcataatggtgaatgttcaatctgtgtaagaaaacaaactaaatgtagttgtcacactaaaatttaattggatattgatgaaatcattggcctggcaaaataaaacatgttgaatt

SEQ ID NO: 21436 - DNA, 266 bp, Homo sapiens
  misc_feature 133: n = A,T,C or G
gaagaaaatctaggcaataccactcaggaaataggcacaggcaaagatttcatgacaaaaacgtcaaaagaattgcaacaaaagcaaaaattgacaaatgggatctaattaaactaaagagcttctgcacagnaaaagaaactgtcttcaaaatgaacagacaacctacacaatgggagaaaaattttgcaatctatccatctgacaaaggtctaatatccaaaatctacaaggaacttaaacaaatttataggaaaaaaacaact

SEQ ID NO: 21437 - DNA, 365 bp, Homo sapiens
agtgcaacattgagaatttttttttaatggttcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaaagtattacaaagatatgtcattagatccaagtgctgattaaatttttatagtttatcagaaaagccttatatttttaggtttgttccacattttg

SEQ ID NO: 21438 - DNA, 215 bp, Homo sapiens
atgataatgctttttgtgttttaagaggttcttagctctcctaaagtcataaggacattttccctctactgctttatgaagttattttgtccttttcttacagtatgactttattttatgttatgtaccggatataaattttttttcataatggagtaaatagccccagcaccctttttatttaaaaggaatcaaatcccttttccccctaactg

SEQ ID NO: 21439 - DNA, 377 bp, Homo sapiens
aagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacgaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaac

SEQ ID NO: 21440 - DNA, 124 bp, Homo sapiens
  misc_feature 119: n = A,T,C or G
gtttgtcctgtctttgcctggatccatagcgagagtgctctgtattttttttaagataatttgtatttttgcacactgagatataataaaaggtgtttatcataaaaaagaaacagcgnaaaaa

SEQ ID NO: 21441 - DNA, 380 bp, Homo sapiens
  misc_feature 92: n = A,T,C or G
gcttttttcttttttccggcgttcaagatgtcgaagcgaggacgtggtgggtcctctggtgcgaaattccggatttccttgggtcttccggnaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttatttttgaagataatgcaggagtcatagtgaacaataaaggcgagatgaaaggttctaccatta

SEQ ID NO: 21442 - DNA, 381 bp, Homo sapiens
atggatttctcttgcagcagttaaaagactgcaggcagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttaccgaaggttcaagattatctaagaagatttgaaagtataccagatatgcttgaattggatcacctc

SEQ ID NO: 21443 - DNA, 252 bp, Homo sapiens
  misc_feature 15: n = A,T,C or G
ggtctggagagaganggctctgtgaggtgagggtagagaattatccaggaagtgggactggccagggtgactggctgctgtggacaagcaaggtaacatccacagatgactagaaattttaacaaggtgccaaagcctgccacaccttttcatccactatgttttcccttcgagacaaagatctgagagagaacgtgggggaaacaagggcaatggttcggatttggccagtggttttttgcaaaaaaaaaa

SEQ ID NO: 21444 - DNA, 373 bp, Homo sapiens
atggaaactgattgcaatgtgctacttctcacttctgtgtggcccgaggaggctgggttaatgctgggcttggtaccttaagcaccctttctcccttccccatcttcattctcagaattacacctgtctgaagcaggcattttccaatgccctagatgggaatataagtgtaaggagatgtgaagcatttgcctgtgtgtcagaacattcactgaggatcctcataggcacttctagaaaccaaatccttgaagatgactaaccagaaatgcccgtcatagcactgtttacagttgcaaaaactgaagccaattgaaatgtccatcaggaggggattaaatgaattatggtacagttacaccgttgaatattt

SEQ ID NO: 21445 - DNA, 350 bp, Homo sapiens
  misc_feature 316, 321, 340: n = A,T,C or G
gggaacattactgccactgttggaagatgttgcaccaggaaattgggcctgttctcatggtaggtaggagaatgtttcagtggccacaaacttgagctattaatgagaatgaggccaggtgcagtggctcacccctgtatatgccaacattttaggaggccaaggcgggcggatcacctgaggtcaggggctcaagaccagcctgggcaacatggtgaaaacccgtctctactaaaaatacaaaaatcagctgggcatgatggcgagtgcctgtaatcccagctactcgagaggctgaggcaggagaatcgctcgnaccanggaggtggaaggttgcagntgagccaaga

SEQ ID NO: 21446 - DNA, 365 bp, Homo sapiens
caacaggtaaatacattgctagagatttaatcctggatattaactacacagatgttttgcttgcatacacatcatgatatttgttacatttatgatgcaaatcatggtgtctccctttcctgtgatgctactttttagaagctactaaattcaaatgaactatcctttttcatgtttaagtcagatgaaatcttatgagattaaacatttagtcatagttatataaacagactaagctggtttggtggattcatctttcacttatgaagaaagcagtttcaaaaaaaagtcactttaggctggtccaatggtagtcagttatctcaattgattgctcacagtcagttacaggtcaaactccttgt

SEQ ID NO: 21447 - DNA, 300 bp, Homo sapiens
  misc_feature 5, 8, 35, 212: n = A,T,C or G
cttgnaanggtctccttcatccctctccagaagangagaagaggaaacacaagaagaaacgcctggtgcagagccccaattcctgcttcatggatgtgaaatgcccaggatgctataaaatcatcacggtctttagccatgcacaaacggtagttttgtgtgttggctgctccactgtcctctgccagcctacaggaggaaaagcaaggctnacagaaggatgttccttcaggaggaagcagcactaaaagcactctgaatcaagatgagtgggaaaccatctcaataaacacattttgg

SEQ ID NO: 21448 - DNA, 353 bp, Homo sapiens
  misc_feature 201: n = A,T,C or G
gtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgnctaaaaccacagataataacaaaccttatacatactgttttttcctatgcatacatacctgtgattaagtttatgaattaggcaccttaaggagattgacaacaataactaataataaaatgtaaccggttatacctgtaaatggaaagtct

SEQ ID NO: 21449 - DNA, 334 bp, Homo sapiens
  misc_feature 13, 131: n = A,T,C or G
catgtgagccggncagaagtcagcagcaaccatgtcttgatttaccttgataaggtgtcaaatcagacactgagcttgttcttcacggttctgcaagatgtcccagtaagagatctgaaaccagccatagngaaagtctatgattactacgagacggatgagtttgcaattgcttgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaatgccaa

SEQ ID NO: 21450 - DNA, 365 bp, Homo sapiens
  misc_feature 4: n = A,T,C or G
aagnacacatgtattttaatttgagagattttagtttgtttatttttatgcttttaacataaaaagtgaagccacaagatggtatatgattgattgcctagcaaaaggttcaagtatgagtcttgaggtagggaaagaaggccttaaggtctggggcttttggaagaaggtagaacttgagctaagtttgaagatgagttggatttaggtaggtgaagagcctggccgggttgctgatgcctgtaatcccagcactttggggaggctgaggtgggaagatcccttgagcccaggagtttgaggttatagtgagctgtgactgtgccattgcactctagcctgggtgacagagtaaggccttgtct

SEQ ID NO: 21451 - DNA, 387 bp, Homo sapiens
  misc_feature 202, 206: n = A,T,C or G
atatgaaaaaggatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcattgcaagngtgnagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcg

SEQ ID NO: 21452 - DNA, 374 bp, Homo sapiens
ggggaccaatatttttaactttgcctatttgtttttgggtgagtttcccccctccttattctgtcctgagaccacgggcaaagctcttcactttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttccgtgtatttgtctgaattaatgacctgggatataaagctatgctagctttcaaacaggagatgcctttca

SEQ ID NO: 21453 - DNA, 349 bp, Homo sapiens
  misc_feature 1, 86: n = A,T,C or G
nctgatcgcattgaaaacattgatcacctgggtttctttatttatcgactgtgtcatgacaaggaaacttacaaactgcaacgcanagaaactattaaaggtattcaagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattatttttttaaagtcttctttcatgtaaagtagcaaacagggctttactatcttttcatctcattaattcaattaaaaccatttaccg

SEQ ID NO: 21454 - DNA, 371 bp, Homo sapiens
gaagaagcaagaattgtaagctgaactcagggaaatctacatttaagacatttcacaaataactttttaaaaattgactattataaatatcagaggaagtccctgggcatagttctttgggtctcgaattattgtatatttgtggtatacatgatcctacaatcctttacttccactgatagaggatggcaacttgatagccagattactcccatttaggttatactgtttcattttgttggagaaggttggcaatgcatcttagcctgttttaagtttctaagaaattcttaggaaagaaacctagtcacctttctttatcctctcacatactgaatttggttgctcacagaagccatttatggagtaat

SEQ ID NO: 21455 - DNA, 361 bp, Homo sapiens
  misc_feature 14: n = A,T,C or G
gtacacacaaactntatctatatttcctctttttacctacagagaaaacattatttttaagcagccatcacaaatttttaaatgtaatattttgtccacaataaacctcaataaattcctatattagaaatagtacataataaactgtctgacaatgatgcattaaagttaggaatgcaaaccatatatataaagaaacaatacaacagctgttgcaaattttttaatttactggaacaactctttagccaaaaagtaaatctaaatgaaaatttctagaaaaataataatctacaaattaattgccaaacctatgacacataaccagagctgtactcaggtccttaaaattgttttaatg

SEQ ID NO: 21456 - DNA, 386 bp, Homo sapiens
  misc_feature 332, 381: n = A,T,C or G
gactacaggccaggccaaccacacctggctaatatttaaaaaaaaatttttttttgtagatatgaggtcttgctgtgttgctcaggctggtctcaaaacgcctgggctcaagcgatgcccctgcctgggcctctcaaagtgctgggattacaggtgtaagccgctgcacctggccctagcaacatcttaagggttgatcttctgaaatctttataacatcaggtaaaaagcagataagagtgggattacctgcactttttgtgctgagcattcagttcccctctctagaagagtatcactaggatttacaatttttgtaaaacataaccggngtattgctatacaaaccagtaacttgtcaagggaaatatctgatagggngtttc

SEQ ID NO: 21457 - DNA, 386 bp, Homo sapiens
  misc_feature 291: n = A,T,C or G
ggaaaatctcccatgaccaaggaaaaattgtgaaaaatatttctgatattttgtctatgcattttatttttgagggtgttttttatattagtgtgactattttgtatttcctaccctgttgtaaactttttaaaaattgctcttacagttattactaagtatatgatttaaaatccctaattagggttcttaaacaagggagaagcactctcatacccctagaacaagatgaacaaaagaaggaggaaaaatcttgacctccgtaagatccaggatggcaccgtgcaaggnacttgacacagcatctgccgggcatcactgactctcctggaccccagaagcccagttccccaggctctgaaaccctgcagcaatgaaaaggaagc

SEQ ID NO: 21458 - DNA, 359 bp, Homo sapiens
  misc_feature 11, 15, 23, 54, 68, 108, 110, 131, 138, 149, 159, 174, 187,327: n = A,T,C or G
ggcccatggcntaanatcactgncagtttgtggtttcatttttagatggacgcnctgggcagcacctnacttctgaccagttaccaatcaaagaaggttatttcagancngttcgccaggaacctgtccantttgganaaataggtggncacacccaantcaattatgttcagnggtatgaatgtgngactacaattcctggaaaatgggagatgctgcacaaagttaccttctgtttcatcattgcaaacaaaaatcattgaaaatactatgccgcattcatttaaagctattttgtttactatgtataaaagtctacaatctacntaatagcagtacctagatggttattattaaaa

SEQ ID NO: 21459 - DNA, 134 bp, Homo sapiens
  misc_feature 24: n = A,T,C or G
gagaagaaggagtgggcatcagcnaaggcccctcacacaagcaagtctgatgtcaatttcatccactcattcattcaaccaatattcatcacatgctactgtgtagtaggcaccattctagatattaaggcaaa

SEQ ID NO: 21460 - DNA, 388 bp, Homo sapiens
  misc_feature 6, 7, 22, 24, 31, 34, 55, 65: n = A,T,C or G
agaaanntaagtagctcagaanantaagaangantggtataatgaacccccatantacccttccntctggattcaccaattgttaacatttttttcctctcagctatccttctaatttctctctaatttcaatttgtttatatttacctctgggcccaataagggcatctgtgcagaaatttggaaaccatttagaaaatcttttggattttcctgtggtttatggcaatatgaatggagcttattactggggtgagggacagcttactccatttgaccagattgtttggctaacacatcccgaagaatgattttgtcaggaattattgttatttaataaatattttcaggatatttttttcctctacaataaagtaacaattaactt

SEQ ID NO: 21461 - DNA, 361 bp, Homo sapiens
  misc_feature 2, 48, 66: n = A,T,C or G
antacaataacattccagtatctggcctccaatcaaattcaccaagcntgcaaagagatgaaaacntggcccctagtgaggacggtaataatgatttgaaactcatccaaacttaacatagatattattattagcagaggaggatagtaaaacattagttataactgtatttcgtattgctaagaaggtaagtacagcaatagaaagtattaaaaaaaattgagattctagggagaaaacctatattgcctgaaatgaaaatataccaggttaacagaagattagatttccagaagaaaagttgggtgaacttgaaggcatagcagtaaaactatccaaaatgaaatgcagagagaaaaaa

SEQ ID NO: 21462 - DNA, 371 bp, Homo sapiens
gatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtcctgtggaccctcgctctctgtctccagg

SEQ ID NO: 21463 - DNA, 374 bp, Homo sapiens
ggaaaaaactttcttctttaggattctcagtactggcgttttaccaatgatataaaagatgcagggtaccccaaaccaattttcaaaggatttggaggactaactggacaaatagtggcagcgctttcaacagctaaatataagaactgcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaa

SEQ ID NO: 21464 - DNA, 330 bp, Homo sapiens
  misc_feature 23, 57: n = A,T,C or G
cacaagtagcaatggacactacnaaataaatgagtttgtgtttcaatagaatttacnttacaaaaacaggcagtaggctgaatttggtccctggatcagtttggagttctcagataagtttaatagaggtgttaagttcaatgtctaatccagaagcaagtagtaatagatataaaattttcttcatggaagaaaagtgccaccgattgcaaatataaatgaaaaactggggaaatatatatatttgtgggagggggaggggtatgtgtagtcatatcacaaaaagaactcgttttgctaatacaaagagttcctaaaattcaacatgaa

SEQ ID NO: 21465 - DNA, 256 bp, Homo sapiens
  misc_feature 1, 205, 206, 208: n = A,T,C or G
naatgtctttgtaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacnngnataaattctgcaataaagagatgtagtttttttttaaaaaaaaaaagg

SEQ ID NO: 21466 - DNA, 355 bp, Homo sapiens
  misc_feature 8: n = A,T,C or G
gaaaaaantaacccattaaaagtggacaaaggacatgagcagacatttctcaaaggaagacagaggtgtggccaacaaacatgaaaaaaaagctcaacatccctgatcattagagaaacgcaaataaaaaccgcaaagagataccatctcacaccagtcagaatggctattattcaaaggcaaaaaaacaacagctgctgatgaggctgtggagaaaaaggaatgcttttacactgttggtgggagtgtaaattagttcaaccattgtggaagacagtgtgaggattcctcaaagacctagggccaaaagaattcaacctagcaatcccattactgaatatatacccaaaaaaaa

SEQ ID NO: 21467 - DNA, 306 bp, Homo sapiens
  misc_feature 3, 6, 35: n = A,T,C or G
ttntangacgtctaggccgggtgcggtggcttcanttccttgtaacccgcagcacttttgggaggctgaggcaggcggatcacctgatgtcaggagttcaagaccagcctggccaacatggtgaaaccccgtctctactaaaaaatacaaaaaaattagctgggcgtggtggtgggcgcctgtaatcccagctacttgggaggctgaggcaggagaattgcttgaacccgggaggcggaggttgcagtgggccaagatcacgccattgcactacagcctgggcaacaagagcgaaactccatctca

SEQ ID NO: 21468 - DNA, 238 bp, Homo sapiens
  misc_feature 69: n = A,T,C or G
gggcaataatgacactcctagtactttgggatcaaataacttagggccaagtcttgggtctgaatttantttaagttcacaacctagggcaagttactctgcctttctaagactcgcttacatcttctgtgaaatataattgtaccaacctcatagagtttggtgtcaacctaaatgagattatatgtggactaaatatctgtcatatagtaaacactcaataaattgcaacatatta

SEQ ID NO: 21469 - DNA, 392 bp, Homo sapiens
  misc_feature 2, 15, 23, 315: n = A,T,C or G
antcttaacagcatnctttctcntgtgcaatgaaaagaacaatcgtagctcttttgggcactcttaggtctttttcttctttctggatggcttacatcgaatccttgtgatttatttaaagacacatttttcctggagaggagaaagatcttctctaaaatagccttaacactgagaacatattaggcctaattttaaaagtccaattcagataactcctcagaagtaaatgcagcacactaaaattcattatcacaaaacttaatatttgttaatatgtttcctctgtgctaaaaggctgctgctaaccatggnagttaggggagggaggagaaagtaaaagacattagtgttcaaaaacttacatctttgggggtaaacaagacatatag

SEQ ID NO: 21470 - DNA, 392 bp, Homo sapiens
  misc_feature 15, 25, 33, 35, 89: n = A,T,C or G
gatcccaactgtcantgaaaaaccntgaaaacncntacctggaggtcaatcaactttgagaagtttgacctaaagagcttctgcaagangcctggggccacttactcctactccaagatcaagcatttgcgtttggatggcaatcgcatctcagaaaaccagtcttccaccggatatgtattgaatgtctacgtgttgctaacgaagtcactcttaattaatatctgtatcctggaacaatattttatggggtatgtttttctgtgtgtcagttttcatagtatccatattttattactgggttattacttccatgaattttaaaatctgagggaaatgttttgtaaacatttatttttttaaagaaaagatgaaaggcaggcctatttcat

SEQ ID NO: 21471 - DNA, 389 bp, Homo sapiens
  misc_feature 9, 17, 27, 39: n = A,T,C or G
cggaaaccncaagtaanttctcagaangccctccctttncaacctggcaaaatcttgttaatgtccttgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatatttcttatttcactaaatgtaaaatttggagtaaatatatatgtcaatatttagtaaagcttttcttttttaatttccaggaaaaaataaaaagagtatgagtcttctgtaattcattggagcagttagc

SEQ ID NO: 21472 - DNA, 399 bp, Homo sapiens
  misc_feature 2: n = A,T,C or G
tntttggccgggggaggaagtgtcggcgccgccactgtccggccacagcctaacgctcttcgctgtcgtttgtggtctcgcgcagggcggccccggttctggtgtttggcgtcggaattaaacaaccaccatgtcgagcaaaaaggcaaagaccaagaccaccaagaagcgcccccagcgtgcaacatccaatgtgtttgccattgtttgaccagtcacagattcaggagttcaaagaggccttcaacatgattgatcagaacagagatggcttcatcgacaaggaagatttgcatgatatgcttgcttctctaggggaagaatcccactgatgcataccttgatgccatgatgaatgaggccccagggcccatcaatttcaccatgttcctgaccatg

SEQ ID NO: 21473 - DNA, 390 bp, Homo sapiens
  misc_feature 5, 13: n = A,T,C or G
ctctntgggaganttctgtgaatacccaattgtacaggtggatttttaaataatagatttagggccaggcgcagtagctcacagaagtaataccatcacttttgggaggccgaagcgggtggatcaccctgaggtcaggagttcagaccggcctgaccaacagggtgaaatactgtctctactaaaaatacgaaaatgagccaggtgtggtgggcgggcaccttgtagtcccagctactcaggtgggtgagacagggagaattgcttgaacccacaaggcgggagggtgcagtgagcccgagatcgcgccactgcactccagccttcggtgatgaagcgagacaccatgtaaaaaacaaacaaacaaacaaataaaatatattttagaaa

SEQ ID NO: 21474 - DNA, 377 bp, Homo sapiens
  misc_feature 16, 128, 134, 256, 277, 327: n = A,T,C or G
gaagtaattcaagatnagagtaattaccaacttaatgtttttgcattggactttgagttaagattattttttaaatcctgaggactagcattaattgacagctgacccaggtgctacacagaagtggnttcagngaatctaggaagacagcagcagacaggattccaggaaccagtgtttgatgaagctaggactgaggagcaagcgagcaagcagcagttcgtggtgaagataggaaaagagtccaggagccagngcgatttggtgaaggaagctnggaaacaaaaagctaagggcaaaatgtacaaacttagaagaaaatttggnagatagaaacaagatagaaaatgaaaatattgtcaagagtttcagataga

SEQ ID NO: 21475 - DNA, 400 bp, Homo sapiens
  misc_feature 3, 6: n = A,T,C or G
tcngtnttattggccgggctcttgacagcggctgcttgctttccgctgaccaccagccatgagtatgctcagacttcagaaagaggctggcctccagcgtcttgcgctgtggcaagaagaaagtgtggctggacccaaacgaaaccaacgaaattgccaatgcaaactcccgccaacaaattcgtaagttggtgaaggatggtttgatcatcaagaagcccgtcacggttcactcccgtgctcgatgccgcaagaatactcttgcacgaaggaagggtcgtcacatgggcgttggtaagagaaagggtaccgcaaacgcacgtatgcccgagaagttgtgctggatgagacgcatgccgttattcctgcgtcgactttctgagacgttacagagaggcca

SEQ ID NO: 21476 - DNA, 372 bp, Homo sapiens
acaagaacacctctgattactcctgccatcatgacccttggccataatatgatttatctccacactagcagagaccaaccgaacccccttcgaccttgccgaaggggagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttgtcaccaagaccctacttctgacctccctgttcttatgaattcgaacagcatacccccgattccgctacgaccaactcatacacctcctatgaaaaaa

SEQ ID NO: 21477 - DNA, 392 bp, Homo sapiens
  misc_feature 3, 13, 22: n = A,T,C or G
gancttaattccnttaaaaacntgctgtgttcttttagtgcatggattccttgactagtacaatttatctaattcaactaaggcactttgtccatggcttgttttgaagaacaggttttctaatctatttggaaaagagtgtttgtagagataacttggagcttctttatctggttctccaaaaatcagtctaagccaattaggagttggtcataaaatcactgaaaatatcataagaactgggtgagtgggatgtggccactgttttccacactcccggtaccatgaccctctttccctcagtgttttcttacttgccattccatatcctaacaataatgctcgaagaccaatgggacataaacatatttataattcatagaaaactgttc

SEQ ID NO: 21478 - DNA, 400 bp, Homo sapiens
  misc_feature 4, 5, 27, 42, 57, 60, 61, 63, 73, 104: n = A,T,C or G
tttnntccccgggacctcggcccctcnggccgggaacccaanctggtactcaagacnccnncncagtactgcntttgttgaaagcagaaattaagacgattaanttgagttcaattcgcctcttccgcattgcctacttgatacactttactaatcatgaaattctaacctaaaaggaaaacattttcctgcttgtcttagaagaaagtggaataattccactgattgtgataatggtttcaatttctacacaatataaatatccagtataaaggaaagcgttaagtcggtaagctagaggattgtgaatatctttttatgtcctctagataaaacacccgattaacagatgttaaaccttttaatgtttttgatttgctttaaaaatggccttcctaca

SEQ ID NO: 21479 - DNA, 266 bp, Homo sapiens
  misc_feature 2, 26, 72, 122, 128, 139: n = A,T,C or G
gnaggtggccgaatcttccttcaggnatcaaggaaaccagactgtgatgactgggagagcgggctgaatgcnatggagtgtgcattacatttggaaaaaaatgtgaatcagtcactactggnactgcncaaactggccnctgacaaaaatgacccccatttgtgtgacttcattgagacacattacctgaatgagctggtgaaagccatcaaagaattgggtgaccacgtgaccaacttgcgcaagatgggagcgcccgaatctgg

SEQ ID NO: 21480 - DNA, 259 bp, Homo sapiens
  misc_feature 7, 14: n = A,T,C or G
gcctagnaaatagnaaaattagcaaaactagtaaatcgtctctgcactcatgggtatttcatgggagtgaaggaagaagacatactaagaaaatcacaaacattcatatgtacttggaactgtgatacatatcatggaggacatacataatgctttgacattatgtactgagatggtttgacctggttgaggagaatggaaaaggtattttgaggatgttgagctttgaagatgaataggagtttacgcttcacaaaaa

SEQ ID NO: 21481 - DNA, 398 bp, Homo sapiens
  misc_feature 2, 7, 62, 202, 311, 388: n = A,T,C or G
ancaatnctgtggattttataggttgatttcatggtaagaaaacttcatttttgtaaccagnggaaggataatcttagttttaaagtgctctataacatttttaggcattcctattacaaagattctattataatgcccatttacctttcccatcgttttggttacgttgtgctttttagtttatctgatatgctccagcgngggcgacagagcaagactccatctcaaaaaaagataattaaatataaagacatagatattagaggttatgacctgagatgtcatttatggtattggaaggttttgtggnaaaaagtgactaatttatgaaatgattaaataccactttggtacaaaaaggtgatttttttccccccagaagaaagnttttccaaaa

SEQ ID NO: 21482 - DNA, 246 bp, Homo sapiens
  misc_feature 11, 33, 52, 94: n = A,T,C or G
catctcatggnccggggagaattcaaaaggaanaagcatcaagcacgcagcnaatgcagctcaaaacgcttagcctagccacacccccacgggnaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcacccccctc

SEQ ID NO: 21483 - DNA, 388 bp, Homo sapiens
  misc_feature 2, 7, 28, 38, 196, 205, 206, 209, 279, 384, 386: n = A,T,C or G
gnccctnaacaagtcgggtgagcagganttgaaccagnaccctctcgctctttcaccatcttactaaagagcttatagttcataaccactggagtattccacttctcgtatacaagaacagctggaaggacagactttgctagttttttatcagagagtaaatctgaaatccacctgcagacctatgtctagtggnaacttgctnnggngatatctgacttactgtagttcagcttctctctagtagccccgtatgttttctgcttgttttttgtttgnttatacttgaagatctgctctgaagattttctcagacctctggtaactgtgagttacatgggaggctgcttagaattcttaaatgtcagtagtagctaccctagngngc

SEQ ID NO: 21484 - DNA, 365 bp, Homo sapiens
  misc_feature 5, 28, 40, 46, 50, 51, 53, 54, 56, 200: n = A,T,C or G
ttggngctgaccaggaattctttgtggncattggcccagngctgtngtcnngnnanatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagagaangaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttg

SEQ ID NO: 21485 - DNA, 130 bp, Homo sapiens
  misc_feature 17, 26, 59: n = A,T,C or G
aactgttttaataaaanattacattnccacaacagaaaaaaaaaaaaaaaagaaaaaanggaaaaaaaaaaaaaaaaaaaaaaaaaaaaaaaaaaaaaaaaaaaaaaaaaaaaaaaaaaaaaaaaaaaaa

SEQ ID NO: 21486 - DNA, 388 bp, Homo sapiens
gggaaatacttggttttcctcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtaggatcagtggatgagacactacgtttggttcaagcattccag

SEQ ID NO: 21487 - DNA, 388 bp, Homo sapiens
  misc_feature 21, 51, 52, 58, 61, 62, 185, 204, 364: n = A,T,C or G
gtaaaaaatgtatttaaaagnaaattgagagaaaggactacagagccccgnnttaatnccnntagaagggcaatgcttttagattaaaatgaaggtgacttaaacagcttaaagtttagtttaaaagttgtaggtgattaaaataatttgaaggcgatcttttaaaaagagattaaaccgaaggngattaaaagaccttgaaanccatgacgcagggagaattgcgtcatttaaagcctagttaacgcatttactaaacgcagacgaaaatggaaagattaattgggagtggtaggatgaaacaatttggagaagatagaagtttgaaggggaaaactggaagacagaagtacgggaaggcgangaaaagaatggagaagatggggaa

SEQ ID NO: 21488 - DNA, 389 bp, Homo sapiens
  misc_feature 46, 207, 208: n = A,T,C or G
gggccctgacattgagtccactgaaccccaaagcagtgctcaaagnaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcaggaagctnncaaggaaaatagagatatagaaatctctactgaagaggaaaaggatactggagatctaaaagatagctctctcttgaaaacaaaaaggaaacataagaaaaaacataaagagagacataaaatgggagaaggaagttataccattaagagtgctatcaaagtaagtctgtggtttaaattc

SEQ ID NO: 21489 - DNA, 395 bp, Homo sapiens
  misc_feature 10, 11, 58, 59, 202, 205, 207: n = A,T,C or G
gattcctgannctgacagcattcgggccgagagtctcgctccgtggccttagctgggnncgcgctactctctctttctggcctggaggctatccagcgtactccaaagattcaggtttactcacgtcatccagcggagaatggaaagtcaaatttcctgaattgctatgtgtcttgggtttcatccatccgacattgaaggngantnactgaagaatggagagagaattgaaaaagtggagcattcagacttgtctttcagcaaggactggtctttctatctcttgtactgcactgaattcacccccactgaaaaagatgagtacgcctgccgtgtgaaccatgtgactttgtcacagcccaagatagttaagtggggatcgagacatgtaagca

SEQ ID NO: 21490 - DNA, 224 bp, Homo sapiens
  misc_feature 3, 22, 60, 80, 82, 83, 123, 131, 152, 166, 206, 221: n = A,T,C or G
ggngcattgaggcagccagcgnagggcttctgctgagggggcaggcggagcggggagggnaccgcaaaaagtttttttcncnnggaaagatagagattaatacaactacttaaaaaatatagncaataggntactaagatatggcttagcgntaagtttttaacgnaattttaatagcttaagattttaagagaaaataggggggnggagaagagtagcangag

SEQ ID NO: 21491 - DNA, 331 bp, Homo sapiens
  misc_feature 207, 208, 287, 290, 320: n = A,T,C or G
ggaaaactgtttatttttttcagtgaaaaggaattctgctttcgtgtttttgggaaagcaggaactgagttcattacatctttaatttggcagaaattagcctttctgtgaaccagatgtggtttggggcaggatctgtagtaaacaatggggattttatttatttctactctctggaaaaggagataatacaattccagaaagggnnctcatatttctaaggttaagattcccttttattgcacctagaatagtgctatgcacagagcgggtgcttgagttgttgncgntttttgtttgttttttaaatgtaaactggnaaattttgggc

SEQ ID NO: 21492 - DNA, 314 bp, Homo sapiens
  misc_feature 212, 248, 310: n = A,T,C or G
ggtgggatgtagataaaacaatgcttgaaggaaaattataactttaaaatcttaggaaaaaaggtctagaatcagtgatctaaacttttaccttaaaagaggaaactagtgaaataggttatgcacaaatagagaacaatcagtaaaaccaaagctgattctttgaaaatgtttaaaaaaaaaaagccaacctgatcaaggaaatgaaaggnggtaggtcagaggtgaggtcagagggagacaggacncaaatgaccaaaatcaggattgaaagatcattcaccactacaaatcctacgacatttaaacngtgg

SEQ ID NO: 21493 - DNA, 223 bp, Homo sapiens
  misc_feature 2, 29, 59, 60, 82, 207: n = A,T,C or G
gntcaaagggacaagcatcaagcaccgcnacaatgcagctcaaaacgcttagcctagcnncacccccgcgggaaacagcagngattaacctttagcaataaacgaaagtttaactaagctatactaaccccagggttggtcaatttcgtgccagccaccgcggtcacacgattaacccaagtcaatagaagccggcgtaaagagtgntttagatcaccccctc

SEQ ID NO: 21494 - DNA, 388 bp, Homo sapiens
  misc_feature 204, 205: n = A,T,C or G
aacataccaactgtcaatgaaaaccttgaaaactattacctggaggtcaatcaacttgagaagtttgacataaagagcttctgcaagatcctggggccattatcctactccaagatcaagcatttgcgtttggatggcaaccgcatctcagaaaccagtcttccaccggatatgtatgaatgtctacgtgttgctaacgaaggnnctcttaattaatatctgtatcctggaacaatattttatgggttatgtttttctgtgtgtcagttttcatagtatccatattttattactgtttattacttccatgaattttaaaatctgagggaaatgttttgtaaacatttattttttttaaagaaaagatgaaaggcaggcctatttcatc

SEQ ID NO: 21495 - DNA, 380 bp, Homo sapiens
  misc_feature 10, 128, 179, 330: n = A,T,C or G
gccctcgaangctgttgagccacggcaaaaaaacccttcagtcagcacgtgagaaaactgcgagccagcattacccccgggaccattctgatcatcctcactggacgccacaggggcaagagggtggntttcctgaagcagctggctagtggcttattacttgtgactggacctctggncctcaatcgagttcctctacgaagaacacaccagaaatttgtcattgccacttcaaccaaaatcgatatcagcaatgtaaaaatcccaaaacatcttactaatgcttacttcaagaagaagaagctgcggaagcccagacaccaggaaggngagatcttcgacacagaaaaagagaaatatgagattacggggcagcgcaa

SEQ ID NO: 21496 - DNA, 352 bp, Homo sapiens
gcatgttttgatgttattgatatcctcttttctggttttggagtggatactttccctgctgtgacctctgtgctctgtagtggttctcctagggaattatattccagtaattctgggtatttctttaaggtgctttgtatttcttgaagtgccattttgatactttcagtgttctgaactgtacctagaacgtactttttataaaaaggaagcagagtccatccaggcagagagagtactgtgtgcctgtagtcttgtctattcgcaaggctgaggccagaggatcccttgagcccaggagttcaagtccaggctgggcaacacactgggaccatgtttcttaaaaaaaaac

SEQ ID NO: 21497 - DNA, 380 bp, Homo sapiens
  misc_feature 12, 378: n = A,T,C or G
ggtacataaagnagagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatacttttttggggttgacactgtattttttcacatttgatttactgggtgggggatagattttataaccctaacngg

SEQ ID NO: 21498 - DNA, 320 bp, Homo sapiens
ataggtttggtcctagcctttctattagtctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgcgccagccaccgcggtcacacgattaacccaagtcaatagaagccggcgtaaagagtgttttagatcaccccctccccaa

SEQ ID NO: 21499 - DNA, 400 bp, Homo sapiens
  misc_feature 2, 9, 71, 74, 206, 215, 218, 322: n = A,T,C or G
tnttatggnccgggggggtaaagtaggcggagcgcgggtacagcttttcgctgactacattcagcccgtcnggnaaacttgtccagattgaatatgctttggctgctgtagctggaggagccccgtccgtgggaattaaagctgcaaatggtgtggtattagcaactgagaaaaaacagaaatccattctgtatgatgagcgaagngtacacaanggngaaccaattaccaagcatataggtttggtgtacagtggcatgggccccgattacagagtgcttgtgcacagagctcgaaaactagctcaacaatactatcttgngtaccaagaacccattcctacagctcagcttggtacagagagtagctttctgtgatgcaagaatatactcagtcaggg

SEQ ID NO: 21500 - DNA, 388 bp, Homo sapiens
  misc_feature 6, 58, 208: n = A,T,C or G
aattgnctgcctttaaaatccttcctctttcttcctcctctattctctaaataatggnggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgtnctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattc

SEQ ID NO: 21501 - DNA, 387 bp, Homo sapiens
  misc_feature 29, 202: n = A,T,C or G
tgcctattccttggtaaagtgggcagggnagactgtagtctgccaacatgcaccctttcgaaggggctatcagtgaagaggtttcacttgtagctgtgtaagtatttctacagtgatggagggtctggggtcagtgctgagtcttcccagttcactgagattgggttgtacaattgggaccagctgtagttagtccattggntgtacttgcatgacactggagtttatgtaaatagctaagtgaagtattatggccagtgactccacttggattcttagcactattgaattttgtctccatgccttccccaggaccatgatgaagaagtgtcggattttggattaatatatttaaataagatgttttgtagaaatattttaaatata

SEQ ID NO: 21502 - DNA, 397 bp, Homo sapiens
  misc_feature 7, 10: n = A,T,C or G
aattcgnttnttatggcccgggactgtaaagagagtaaaaaggcaagacagtaatgggagaatatatatagtatgtatacaatcaatagagaggtttttttttaagaatacctacaaatcagtaagaaaaagaaaactcgacttttgaaaatgtgcatgagaacacatcacttcacaaaagaaatgtctgataaatgtgaagaaatgctcagtctcagtagtcatggaaatgcaaaattaaaccacaaagagagaacactgcacacccaccagaattgctaagatgaaatagatggtataccaaatattgacaaagctatgaaaaagcacaaactcatacactggtaatgggagtacaagttgttgcaaccatttggcattatctgcctaagctgca

SEQ ID NO: 21503 - DNA, 369 bp, Homo sapiens
  misc_feature 57, 58, 115, 202: n = A,T,C or G
tacatttaaatgtactttaaaaatgaaaaccctgagtcatctttctaatgaatgagnngcctgtaattgggcagtgacttaatgccatcgtaattatgttagacaactgggaggnaatgcaaatggagcaagccatactgcaggcattacttttaaaggaggcttaagaaccttgactatgaagtacaggatgggagatgtnaattcatccttcattatcatctcaagaacttcagtggtaggactgatttgagattagtcaaatggtttctgcctttcctagaccaggaagaataagttgcatgcatctttcttatgtggaatcaaatgccacaatattgatggtaaaaaaaaatctacaattagatt

SEQ ID NO: 21504 - DNA, 370 bp, Homo sapiens
  misc_feature 203, 207: n = A,T,C or G
gggatcaaatgatgaggagagtcctatgacaataatccttttatcaaaacactgtatgatggttgtgcggtgagtataagttctgcttgtctcccttcacagagatgataggcagcatgtcaccgtttcagtcggtccttagccagatttttctcatgaaatggacgtcagttgttattaacatttgttgcttaatcttgacntgtnaaactatggtatgtgagaaaccagtaatgttaacacacacacagttatgcacatagacactctgaaacatttttaaaggcatacagaaggtaatcttggattatatggttattttattctgacatttgaatcatatcacagctagttattcctaaaatgaaaa

SEQ ID NO: 21505 - DNA, 400 bp, Homo sapiens
  misc_feature 6, 216, 375, 395: n = A,T,C or G
tatggnccggggaggcattgaggcagccagcgcaggggcttctgctgagggggcaggcggagcttgaggaaaccgcagaataagtttttttctctttgaaagatagagattaatacaactacttaaaaaatatagtcaataggttactaagatattgcttagcgttaagtttttaacgtaattttaatagcttaagattttaagagaaaatatgangactgagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcnttttagattaaaatgaaggngactt

SEQ ID NO: 21506 - DNA, 389 bp, Homo sapiens
  misc_feature 207: n = A,T,C or G
gtgaataatttggctaagttgggattgagtttcaacagcatctctgctgttgacaatggctctctggccaacacgcctcatctgagggagcttcacttggacaacaacaagcttaccagagtacctggtgggcttggcagagcataagtacatccaggttgtctaccttcataacaacaatatctctgtagttggatcaagtgactnctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaa

SEQ ID NO: 21507 - DNA, 371 bp, Homo sapiens
  misc_feature 14: n = A,T,C or G
gaagcaccaaaagnagctatggtcacagtactcccaaaaggggcatacaaaatggctttggttcctgatagttctccagctctaggaaagctcaacttattgtacaatggttaaaattcctcaattttgatgagcctcactgattatatcttcccaaagtacattcacttttcataagtgaagtttctatgtcatacaaccaaaagagctaattagaattcactttaataaatgttactgttccttatcttaattatgacaacagatgaaatattttgttattgtcatacaactcttaccttattctttcagtgggaggtccagtgtaatgcaacgggttgagatattctctagagcaaaatttacctact

SEQ ID NO: 21508 - DNA, 379 bp, Homo sapiens
  misc_feature 203, 206: n = A,T,C or G
attctggaaaattttttctttggggttgatcattttctccagagagaaatctagcttctagctgagagtgctaggttggggagtgagttctctggctgttggcattctggaagccaggcagggagaaggattgttaagtacgtggacttttactaaaactttgttttctcagtatctcatgcctgccttttacttttcctggngtncataagtctagactatctccacttcagaaagttaacttttaggctgggcacggtggctcactcctgtaatcccagcactttgggaggccgaggtgggtggatcattttgaggtcaggaattcacaaccaggctgacaaacatagtgaaaccccatctctactaaaaataaaaa

SEQ ID NO: 21509 - DNA, 242 bp, Homo sapiens
  misc_feature 18, 239: n = A,T,C or G
gagggagaatgaattgtnatgaaaaattggggttgattttatgtatctcttgggacaacttttaaaagctatttttaccgagtattttgtaaatgctaattttttaggactctactagttggcatacgaaaatatataaggatggacattttatcgtctcatagtcatgctttttggaaatttacatcatcctcaagtaaaataaatatcagttaaatattgggaaaaaaaaaaaaaanggg

SEQ ID NO: 21510 - DNA, 368 bp, Homo sapiens
aacatagaattaaattgtatttgttaaaatacacacattggaggacaagagcagatgactacttttcgaagtaatgctgctccttcctaaaagtctgttttcaatcctggtaatattaggggcactgcggcacctaagaagtcttaaatgagagctaatccaatctagagagcgatggtgtcagcatttcggtctgcatatctgtgtgtccgtatctgcgtttgtgtgcgtgtacgtgtgcccctgtgtgtgggcccagttttcaggcatgtagaataagcatggagtcatattgaggaggactcacttcttgaagatatgcttgttgctttacaacatatgtaagctattctttagcataaatgcat

SEQ ID NO: 21511 - DNA, 169 bp, Homo sapiens
  misc_feature 2: n = A,T,C or G
gnattactaggaacttaatatagtggcatacccaggaaaatgcttagtaagtgttcccttcacattttaaaatttgagtatacaatcatgtttgacaatatagaaatttaatttttagtgaaacaattctaaaccccttttccatagacacaagaaagatggcaaattt

SEQ ID NO: 21512 - DNA, 366 bp, Homo sapiens
  misc_feature 115, 165, 203, 205, 208, 318, 337, 347: n = A,T,C or G
ggatggcaatcgcatctcagtaaaccagtcttccccggatatgtatgaatgtctacgtgttgctaacgaagtcactcttaattaatatctgtatcctggaacaatattttatggntatgtttttctgtgtgtcagttttcatagtatccatattttattactgtntattacttccatgaattttaaaatctgagggaaatgtntnggnaacatttattttttttaaagaaaagatgaaaggcaggcctatttcatcacaagaacacacacatatacacgaatagacatcaaactcaatgctttatttgtaaatttagngtttttttatttctactgncaaatgatgngcaaaaccttttactgggt

SEQ ID NO: 21513 - DNA, 389 bp, Homo sapiens
atcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttggtaagtcttttacattttaata

SEQ ID NO: 21514 - DNA, 288 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagc

SEQ ID NO: 21515 - DNA, 368 bp, Homo sapiens
  misc_feature 205: n = A,T,C or G
gaggcattgaggcagccagcgcaggggcttctgctgagggggcaggcggagcttgaggaaaccgcagaataagtttttttctctttgaaagatagagattaatacaactacttaaaaaatatagtcaataggttactaagatattgcttagcgttaagtttttaacgtaattttaatagcttaagattttaagagaaaatatgangacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgctttta

SEQ ID NO: 21516 - DNA, 381 bp, Homo sapiens
caatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacag

SEQ ID NO: 21517 - DNA, 364 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagttaaaaatgtatttaaaagataaatttaaacctgaaaagtaggaagcagaagaaaaaagacaagctaggaaacaaaa

SEQ ID NO: 21518 - DNA, 389 bp, Homo sapiens
  misc_feature 36, 207, 208: n = A,T,C or G
gataggagcctctctccctactgctgctacacaagnaccctgagactgacctgcaggacgaaaccatgaagagcctgatccttcttgccatcctggccgccttggcggtagtaactttgtgttatgaatcacatgaaagcatggaatcttatgaacttaatcccttcattaacaggagaaatgcaaataccttcatatcccctcagnngagatggagagctaaagtccaagagaggatccgagaacgctctaagccctgtccacgagctcaatagggaagcctgtgatgactacagactttgcgaacgctacgccatggtttatggatacaatgctacctataatcgctacttcaggaagcgccgaggggccaaatgagactgagggaa

SEQ ID NO: 21519 - DNA, 370 bp, Homo sapiens
  misc_feature 2, 7: n = A,T,C or G
gngtaantctttttttatggcgcgggataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcct

SEQ ID NO: 21520 - DNA, 381 bp, Homo sapiens
  misc_feature 27, 271: n = A,T,C or G
atatgtgaattcttccaaaagcccagnagagagataaaatttatttctcctatgtagctgaggtcgcttgaataattgaccctgggaacatctacacctgcatgcagaagcaccttgtgctaaacagaataatctgtgttcacataacacatacactagatgtgtggctttttaaaaagaaaaatgtctctgaactttttaatataatatttaaatataatttggttaatgaggcctactaatttaatataataatttaatataatttggntaatgcggcctcctatggtcaaaatttaatgcatccctcatctgcatagcccctttaacacatacttgtgatagcatgttatagggtctgaccaagcctgagcttgagat

SEQ ID NO: 21521 - DNA, 372 bp, Homo sapiens
atatccagcaattgaagaaatgtatttctcaagacacatcaaaaaattattaataattgaccacacaataggccatgaagcaagtctccagcatcaatgaatctgtatcttatagactgcattctttgactacattgttgactacaatgcaatgtaattagtagtaaaaatacaattaaaacctatacatttaaaatttagaatcacatttctaaagaatttattttttttagtcaaataagtcatataagaaaaaatgttagaactcaacagtaatgaaaatcctgtatattaaactgggatgcagctgcagcaggacttttaagaaactgagaatgcaagttttgagtggaatttgaaaatataaggggc

SEQ ID NO: 21522 - DNA, 196 bp, Homo sapiens
  misc_feature 48, 84, 92, 102, 147, 156: n = A,T,C or G
ggacggtcagtggatcggtgggtttatctcaaggcctgagtagccggnaacaaacgagggttcccgggattggaccgacgcagncatgcctntgcgacttgntatcaaaagaaagctaactgctagatctgatcgagttaagagtgnggatctgcntcctacagagccatggatgttggcaaagtctttacaatgg

SEQ ID NO: 21523 - DNA, 372 bp, Homo sapiens
  misc_feature 205: n = A,T,C or G
tatgagtaatttactaatgtgtaacgtgtcataatctggattgtaattctgggtgagaactgaatttttcatgtattggtgaatgattggaaagttccacattacatacttttttctaggaaggttgaaatatatgttttttttcagagataaaataacgtatttctgtttacaataaccaaatatgaaattgtgagtatttgcnatggtgcctaagtaaaattgacaatgtcaacaaacctgtgcttatggaagtctaatttgtttttatcattaaactgagtgctttcgtggcttccacaatattagctgtgaaatagttcaacatcatataccatggaatttctccagccagaagagttgtactaaaca

SEQ ID NO: 21524 - DNA, 382 bp, Homo sapiens
atgaatgaggaggccgaaggtcacagaagtacaataaatggcatgtttcctggttcaaccgcttgtattgactccaaaacccatttctttgggaatcattgtagtgggtcgccttctaccttgcaaactctctgtaagcctctctccaactagacaaattcagattcagaaatagtgagtagtttagttctgatgaatgcaagagcagaactattgggagactctttggagcatactcctaaagtgcacaggaagaaaatacagcttaagaatgctgctgctggcccgggcacagtggctcacgcgtataatctcagcactttgggaggccgaggcaggtggatcacaaggtcaggagttcaagatcagcctggccaagatg

SEQ ID NO: 21525 - DNA, 382 bp, Homo sapiens
  misc_feature 26, 206, 207, 297: n = A,T,C or G
gactgttttcatatgttatactcagnataaagattttaaatggtattacgtataaattaatataaaatgattacctctggtgttgacaggtttgaacttgcacttcttaaggaacagccataatcctctgaatgatgcattaattactgactgtcctagcacattggaagcttttgtttataggaacttgtagggctcattttggnntcattgaaacagtatctaattataaattagctgtagatatcaggtgcttctgatgaagtgaaaatgtatatctgactagtgggaaacttnatgggtttcctcatctgtcatgtcgatgattatatatggatacatttacaaaaataaaaagcgggaattttcccttcgcttgaat

SEQ ID NO: 21526 - DNA, 363 bp, Homo sapiens
  misc_feature 1, 11, 24, 41, 209: n = A,T,C or G
ntgtttaaagnaactgcaatgagnacagtgtgaccaaaagnagaacatgagtggggaaaatggcagagacaaattaggagaagcagtgggaagccagatctcatggttcttggttatcacatggtaaacctttaaaaattactgtctcactgagacaagaggcctttctagtgctttagaaaagagaagtaacataattttacttaggntttaggttttacaaagatcacatttcagtgaaaagattaacagatcacagatggaagtcaagggaagtgtcaagagcaaatggaagaggatggaagaagaatcatgatgagggatgggatgaaggcagcaaggggtaaccatcttgaccttctg

SEQ ID NO: 21527 - DNA, 388 bp, Homo sapiens
  misc_feature 206: n = A,T,C or G
gggactttattgactgagtaactagaaagcctagaagtagttctacttttagacacagctagacacagggaggtaaattatgtcattaggactcactctctccccctttggctctgcttttctttgtactggtgtcattcttaggcaggctttctcccatgtagtggcaaagaaagatatcagatttgggtatgcatcctaacagnttattgaaagatacaacaggcctggcatgttggttcaagcctataattctagcattttgggaggccaaggcaggtggatcacttgagcccaggagtttgagaccagcctgggtaacatgaggaaatcgcgtctctacaaaaaatacaaaaattagctgggcgtggtggcttgtacctgtagt

SEQ ID NO: 21528 - DNA, 377 bp, Homo sapiens
  misc_feature 206, 208, 324, 327: n = A,T,C or G
gaatcacttgttagttcttggtaggaattcagttgggcaatgataacttttatgggcaaaaacattctattatagtgaacaaatgaaaataacagcgtattttcaatattttcttattccttaaattccactcttttaacactatgcttaaccacttaatgtgatgaaatattcctaaaagttaaatgactattaaagcatatatngntgcatgtatatattaagtagccgatactctaaataaaaataccactgttacagataaatggggcctttaaaaatatgaaaaacaaacttgtgaaaatgtataaaagatgcatctgntgnttcaaatggcactatcttcttttcagtactacaaaaacagaataattttt

SEQ ID NO: 21529 - DNA, 387 bp, Homo sapiens
  misc_feature 1: n = A,T,C or G
nggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaggggcaatgcttttagattaaaaatgaaggggactt

SEQ ID NO: 21530 - DNA, 202 bp, Homo sapiens
gaagaaaaaaaacgcaggcaaacctgaggtcctcagaatggcgggcacaggtttggtggctggagaggttgtggtggatgcgctgccgtattttgatcaaggttatgaagcccctggtgtgcgggaagcggctgcagcgctggtggaggaggaaactcgcagataccgacctactaagaactacctgagctacctgacagcc

SEQ ID NO: 21531 - DNA, 382 bp, Homo sapiens
gattcctgagctgacagcattcgggccgagatgtctcgctccgtggccttagcagtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgag

SEQ ID NO: 21532 - DNA, 208 bp, Homo sapiens
gctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaatttcgaa

SEQ ID NO: 21533 - DNA, 362 bp, Homo sapiens
  misc_feature 35, 205, 328, 360: n = A,T,C or G
gatagacacaaaggcttcgaagcacaagccaaatntgtcaatattttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggnatgttcaacaaatttgtgtatacaaagaaatggataaatcactgctatataagggaaactaccttaggaaagaatgtttacctgaatggttattttattttatttttttttttactatagagngagggggtgttaacaaagaatatatatttggnca

SEQ ID NO: 21534 - DNA, 267 bp, Homo sapiens
ggtatgcgctttgtaaactgaattggttcagctgtttaagtacaaagagggttcaaagttagattatatagagaggaatttcttttacttgcttttacctcagatacttaaaatctccatctttgtacccagttataaaatagcaagaaaagttcaaatccaaaatgagaagaaatgcactcttctttgcatcactaacaaaaaaagtatccccaattctttaagtgtattcatgctgggccgaatgtagcaaagtgtaaagaaatt

SEQ ID NO: 21535 - DNA, 397 bp, Homo sapiens
  misc_feature 22, 46, 67, 69, 79, 90, 169: n = A,T,C or G
tgttcaggttggggagaaagangtaaaactgtttttctttgcaganaacctgatagtctacgtagantntctaaagaantctacaaaaantctacttagaacttactaactgagtttaaaaagtttgcaggatacaaaagtaatatacagaaatcaattgtagttctantatacttagcaatgagcaacctgaaaattgaaattaaaaatgatacttccaatagcaacaaaaatgtggcacgcctatgaattaaattaacaaaagatattcaatatctgcacactgaaaactacaaaaacattcctgagagaaattaaagaagacctaatgaagatacacttgtattgatgggttggaagagtcaatattgttaaaatgttacaatattgttaaaat

SEQ ID NO: 21536 - DNA, 385 bp, Homo sapiens
gagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttttggagatgattta

SEQ ID NO: 21537 - DNA, 308 bp, Homo sapiens
gaatggagtgataaaaaaacagtgaattaaattgttacatagtctgttggttagaattttaatgaaagttgtcattcaaatacatttgttttcccttgctttctcaaaggacagagtttaggcaagattctcttaggagacagttccaagaatatgtaggatacctccatcccgtttttaacctatcttgtcagctgaaaggattatatatgttgttttaaacataattttctcatttggttttcttaaggaaaaataatttgtgaaaatgatggagtaattagccaagaaggtagaatttaaacaga

SEQ ID NO: 21538 - DNA, 280 bp, Homo sapiens
  misc_feature 36, 64, 68, 273: n = A,T,C or G
gattagagctggttttagaccccccacccccaacanatagtggttgagagaacagcagtcatangtgnctggcagaggcaaggaaagaccagcagagagagagaaaggaaagagacagagaggaaaagaggaaaagagagagaggaagagacaggaagagacagacagagagtcaaggatagagagagagagagagagagagacacacacacacacagagagagagaggaagagacagaggcaaaaggaaagtcaaagagagagacaaagtcngggagag

SEQ ID NO: 21539 - DNA, 384 bp, Homo sapiens
  misc_feature 1: n = A,T,C or G
ntcattcttctgactctagatgggacacttgacagtggcttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaactcatgtttcccagtacacctgtagatattactgtacttttttatgttctcaagaataagttgttgcctattcagtgttacagatttctttgttt

SEQ ID NO: 21540 - DNA, 331 bp, Homo sapiens
  misc_feature 18: n = A,T,C or G
atggacgagaaggaagantttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcgttcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgt

SEQ ID NO: 21541 - DNA, 367 bp, Homo sapiens
  misc_feature 2: n = A,T,C or G
gnaccaactgtgcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatgggttatgtttttctgtgtgtcagttttcatagtatccatattttattactgtttattacttccatgaattttaaaatctgagggaaatgttttgtaaacatttattttttttaaagaaaagatga

SEQ ID NO: 21542 - DNA, 389 bp, Homo sapiens
  misc_feature 383: n = A,T,C or G
gaggcatttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggngactta

SEQ ID NO: 21543 - DNA, 398 bp, Homo sapiens
  misc_feature 36: n = A,T,C or G
acccataaatacctccggaaacattcccctcttggnaatttgtccttctacagaagcttcaaagattaaatcaaattaattttcaaaaaaaatttttttttagaaatgttattttccctgtgatagaggatgacttcccagtttcaccaaagtctgtttatatcaacacacacaaaatggaataattctgagtcactaggcaatcaatctactgtggttttactatgtaaggtgaaaattaactggaacgatgtttgtttgctatacttacatagtcaaactttacaagccatgaaattaattgcactctttgtatttgttgttaaatgcctaagaagttttctaaaaattttgtaaaggcactgtcaggagaatctggagttgaatgattattccag

SEQ ID NO: 21544 - DNA, 383 bp, Homo sapiens
gatcttcttttgatgaaattatctgaactcaacatctagcacatagaatgtgttcaacaaatgcttgttgaatgaataaattatgactgcagactggctctcctgccttaaactaatttcatcccagcctagtctcctgatgtctgtgctcgttatgctatgccatgttgcttcagtcaaacaagaaacacttactgagggcatattgtttgcccatcattgtgcaatatgctgtgggacatgggatgtcgtctcagtcttcaaggaaatggaagggttaagaaatgcatatgagattattaccaatgacaccgttaatttatatgatgctttaaaattatcagagcactttcatgtatttttcgtgtgactagcgaaaaaga

SEQ ID NO: 21545 - DNA, 202 bp, Homo sapiens
  misc_feature 9: n = A,T,C or G
atttctagnaatctcccttttattctaaggatatttcagaattatcagataaacttatgtttaatttattaaaaagaattatgtatcatacagtagttgtaggagggtatggggcaaagagcatgaaattagatatcattcaagtctgataagtctgagtactggctgcttcaaatgctcaaatctatcacaaaaaaaaaaa

SEQ ID NO: 21546 - DNA, 400 bp, Homo sapiens
  misc_feature 5, 10, 33, 36, 66, 214, 217: n = A,T,C or G
ccggngagcnacgtaagccaagcacacattcgnctntgagcaccaccatcaatgaccaccgccatncacaagtaactttgactgtttgaagggtgatcctgagactcttgaagtaatggctgatcctgcatcagcattgtatatatggtcttaagtgcctggcctccttatccttcagaatatttattttacttacaatcctcaagttttaggnggngtttaaatatttttcaatacaacagtttaggtttaagatgaccaatgacaatgaccacctttgcagaaagtaaactgattgaataaataaatctccattttcttcaatttatttcagtgtaatgaaaaagttgcttagtatttatgaggaaattcttcttcctggcaggtagcttaaagagtg

SEQ ID NO: 21547 - DNA, 277 bp, Homo sapiens
  misc_feature 208, 232, 245, 251, 262: n = A,T,C or G
ggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtctacatatacttttttttaatagcaangggtttttattaaacatgctgggngccacaggccagngttgtnggggaaatatntaaacatttatttaa

SEQ ID NO: 21548 - DNA, 386 bp, Homo sapiens
  misc_feature 1: n = A,T,C or G
ntgataaacggaaatagaaaaaagaacctacatttattttgctttagcatccttactctcaccttttatgagattgagagtggacttacatttccttttttacattttcgtatacttattttttttagccatcattatatgtttaagtctattatgggcaaccaatctttggaagctgaatactgaatttaaagaatgctatcttggaaaattgcatacgtctgtgcaattttttattctgcctagtgctattctgcttgtttaactagattgtacaaaataacttcattgcttaatatcaaattacaaagtttagacttggagggaaatgggctttttagaagcaaacaattttaaatatattttgttcttcaaataaatagtgt

SEQ ID NO: 21549 - DNA, 365 bp, Homo sapiens
gtctaaaaagggggagctggcctccaccctatgttccatggattcggaacaagatttcagacatctgcatgagtgacaaactttctgaacaccaccaccaccaataatacttatcagcatcataaagtatctcttaaacactgatcttggcagggacggaactcctattcagcagtttttgtggaaagcagtaatgcttgcaaaacgtgtgtgtcattcagcattttaagtggagactatgcatttcatagtatatttgacagattagtactgtgtcctgtgttttgttccagattcttcagtataaataagttctatatcaaaaagttgcctgtctaaatagaaaatgtcttgctgtgttttgt

SEQ ID NO: 21550 - DNA, 360 bp, Homo sapiens
  misc_feature 4, 12: n = A,T,C or G
agantgatttanaatcctttgggtatatacccagtaatgggatcgctgggtcaaatggtatttctggttctagatccttgaggaattgccacactgtcttccacaatggttgaactaatttacactcccaccaacagtgtaaaagcattcctatttctccacatcctctccagcatttactgtttcctgactttttaatgattgccattctacctggagtgagatgatatctcattgtggttttgatttgcatttctctaatgaccagtgatgatgagctttttaaaatatatttgttggccgcataaatgtcttcttttgagaagtgtctgttcatatccttcatccactttttgatgg

SEQ ID NO: 21551 - DNA, 370 bp, Homo sapiens
  misc_feature 57: n = A,T,C or G
gtagttccacaggcttaacaggaagcatgactgggaggcctcaggaaacttaaaatnatggcagaaggcaaaagggaagcaaggaccttcttcacatggtggcagaagagagagagagagatgggggaagtgccacacacttttaaaccgtcagatctcatgagaactctttcactatcacgagaacagtaaggaggaaatccaccctcatgatcccctcccctgacacagggggattacaattcgacgtgagatttgggtagggacacagggccaaaccacaccagatatagataaagataaaaaaaattaagaaagacaaagttagataaataaccctataaaggttaaataaccttaactctataac

SEQ ID NO: 21552 - DNA, 399 bp, Homo sapiens
  misc_feature 4, 28, 62, 63, 333, 372: n = A,T,C or G
gaanttcttttacccgggcattctgttnttatggccgggcaatgagtccctggaacgccagnngcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggntgatacccactcaaaaaggacacttctgattaagacggntgaaactagagatggacaggttatcaa

SEQ ID NO: 21553 - DNA, 360 bp, Homo sapiens
  misc_feature 17, 19, 32: n = A,T,C or G
atgtacaggctgacagnanaagattcccgagngtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgt

SEQ ID NO: 21554 - DNA, 381 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaagg

SEQ ID NO: 21555 - DNA, 372 bp, Homo sapiens
  misc_feature 2: n = A,T,C or G
anatacctataatttggtgccctgtttttccatttacatattatactttccatattagtacattgtctgatatttctgcataatactcaattcaacttacctgctattgtttttatcatatctctattacaaacattaggcccatttcccttttttaaaagaggaaagtttgaggttatgggcggtgttctgataaaataaataatattttgtcatgtttgttttttcattgattaggaaacattgttttgaatttaatgcctcaaatttggtgcacaataatttgaagggaaaaactgacaagtttgaaatgaacattgatattacataatttacattaaaatgatacatcttttgtaaatttgtaagaag

SEQ ID NO: 21556 - DNA, 398 bp, Homo sapiens
  misc_feature 31, 36, 45, 46, 53, 58, 59, 237: n = A,T,C or G
tccccgggacctcggcccctctggccggganctgcnaaaaactanntaaaagnctagnngcctggaaaacctaaactgcaatgtggatgttttacccacctgaactttacttctgccaaagccaaatttccagtttaagtaattgcctacaataaaaagaaattttgcctgccacctttcagaatcctcttttgaagctttctgttgatgttaactgagctactagagatattcttntttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgt

SEQ ID NO: 21557 - DNA, 358 bp, Homo sapiens
ggaggtggttacacttcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttagcctcatctgttaagttcccatgcctggagaagctaatgccaactcatcatgtgataattcaatttgtacaataaattatgaacctgt

SEQ ID NO: 21558 - DNA, 390 bp, Homo sapiens
  misc_feature 14: n = A,T,C or G
gaagacacaaattntcctatcctgtcaatgaaacaggggctatcactgcagactctgcatacatcaaaaagataataagggaatactgtaaacaactgtacacacttaaatttgtcaatttagatggaatataccaattccttgaaaaactcaaactattgccataaataaaatcaatataaaatagatcatttaaatatttctataactattgagaacttgaattcaaatgtagaaattcttcaaaaagaaatctctagacccaggtattttcactagagacttctgctagaggtttaagaaatcattaacatcaattctatacaatctcttctggaaaagagaagaggaaacacttcccaattctttacctcaaactagtattacctt

SEQ ID NO: 21559 - DNA, 176 bp, Homo sapiens
  misc_feature 7, 27, 29, 56, 140, 161: n = A,T,C or G
atggccnaaaacccaatggactgaacngnatgatttttatagaactgggcaccaanccgccgaagagctcaggaattgaaaatggggctttccagggaatgaagaagctctcctacatccgcattgctgataccaatatnaccagcattcctcaagggctntcctccttccctcac

SEQ ID NO: 21560 - DNA, 100 bp, Homo sapiens
  misc_feature 2, 8, 30, 39, 48, 49, 52, 81: n = A,T,C or G
cncagaangaatgcttactcagttttgtgngcagccagnataataaannccnggggagggacagaagattcaataagagantatgaagatgggatggagg

SEQ ID NO: 21561 - DNA, 124 bp, Homo sapiens
  misc_feature 4, 19, 27, 30, 33, 37, 39, 41, 51, 53, 54, 57, 59, 60, 64,94, 119: n = A,T,C or G
aacnccaattaacaccagntgtacacnttnttncggncngnaaaatagaanannaancnncatntcactcattttatgggggtattaacctgcnaccaaaaccagataaagacaggatnaacaa

SEQ ID NO: 21562 - DNA, 283 bp, Homo sapiens
  misc_feature 6, 13, 40, 162, 200, 218, 250, 265: n = A,T,C or G
ttttgnatggccnaaaacccttctgtcttgcacttcttcntttgaattagcagacagatgcattcccaggctgaattagttgttttcaggcctgaaagtgaagggagaagccaaggaatgtcatgaagacctcctttcctctccaccattaactttgacagnatttcttacctatgcagagaagagaaaacataggtatnggcaggcacccaaatccncagtagcatgaagggaaattaaaactacttgnggccagccgcattgngtcatgcccgtaatccca

SEQ ID NO: 21563 - DNA, 155 bp, Homo sapiens
  misc_feature 8, 41, 68: n = A,T,C or G
atggaccnaaaacccctcagattaatgaaataaagtctttngacaagattagagaaaaaaagacccanaagaaatgaagaaagccttcaagaaatatgggactatgtgaaaagaccaaatctacatttgtttggtgtacttgaaagtgatgggga

SEQ ID NO: 21564 - DNA, 126 bp, Homo sapiens
  misc_feature 6, 11, 46, 54, 61, 63, 64, 68, 107, 110: n = A,T,C or G
aaaccncaagnataatttttagacttaggttttttggggctatggncggttcanaaacccncnnaggnggagacctctgccgcaaaacatgctccgccagatcatcnggncaggccaagaagcatc

SEQ ID NO: 21565 - DNA, 179 bp, Homo sapiens
  misc_feature 3, 13, 38, 47, 52, 65, 80, 149: n = A,T,C or G
ccncttagacatnaacttgattttttaggatgatcgcntcaaaaaanacccngagggaggagcanctgggaacggaaatnaaacctattccgagcaacattgataagagcctgtatgtggcagaataccacagcgagcctggggaagangagaaaccttaacaagcatgctttgacaaa

SEQ ID NO: 21566 - DNA, 156 bp, Homo sapiens
  misc_feature 8, 13, 39, 53, 61, 68, 128: n = A,T,C or G
tatggccnaaacncctgcataattggctgcaattttttngggttaattggggnagaacaanccagagncagcaattcacaagtgccttaatataaacagaactgggggcacttaaaatgataatgatnaacttatattgcatggtctcttcctctc

SEQ ID NO: 21567 - DNA, 399 bp, Homo sapiens
  misc_feature 14, 42, 44, 64, 85, 216, 301, 331, 337, 346, 362, 382, 385: n = A,T,C or G
gtatggccgaaaanccataaaaagggttaatgaaaccttttntnggtttcttcaaaaaaactanccgcgttgttaaacctctggngaaactgaccaagaagaaagggagttgtcacaagtaacattaggaatgaaaaaaacaggcataactttatggcaaaacatttgaaagcagaaaagggaaaattcctttaaaaattataactcactaaattnattaaagaagaaatagatatctggagagggccataaccattaattaattgaatgggccatttaagatcttcccacaaagaaagtnccaagcccggatgattttacaggggtcgtnccaccnaacactcanagaacaggataatgtngaatctgtcttgcaaacctnttncagggagctagcag

SEQ ID NO: 21568 - DNA, 130 bp, Homo sapiens
  misc_feature 4, 10, 35, 40, 54, 57, 62, 64, 111, 118: n = A,T,C or G
aaanccccanaaaattaaatgaaattttttttttngggantcctttaaatgaanaangaccnantacaaatttattcttggggaagatgatacctgaagctgtcacctctngattatntaaactaagcgc

SEQ ID NO: 21569 - DNA, 141 bp, Homo sapiens
  misc_feature 3, 4, 11, 33, 47, 64, 65, 69, 95, 109, 118, 124, 127: n = A,T,C or G
cannaactcanaaaaaaaaaaaaaaattttttngaagagaaaaaaanaaaaaaaaaaacgcganngggnaaaaaaaaaaaaaaaaaaaaaaaaanaaaaaaaaaaaaanaaaaaaagntaaagnganagagaaagggaaaa

SEQ ID NO: 21570 - DNA, 201 bp, Homo sapiens
  misc_feature 8, 19, 27, 57, 60, 65, 71: n = A,T,C or G
tatggccnaaaaccccggnggtggccnctgcgcattttttgacttcgctcgtactcnagngcccnggtggngcttttcctccgcaaccatgtctgacaaacccgatatggctgagatcgagaaattcgataagtcgaaactgaagaagacagagacgcaagagaaaaatccactgccttccaaagaaacgattgaacagga

SEQ ID NO: 21571 - DNA, 125 bp, Homo sapiens
  misc_feature 3, 26, 28, 34, 60, 82, 95, 102: n = A,T,C or G
acncccaaaagaaaacataagctgtntntggganggatgcgtaacaaaaaccccgggggnacatgaaccccttttctggatngggtccataatcnaaacttngtccctgaaggcaggaagtccct

SEQ ID NO: 21572 - DNA, 245 bp, Homo sapiens
  misc_feature 11, 32, 35, 40, 45, 56, 67, 68, 73, 178, 196, 223, 226: n = A,T,C or G
atggcaaaaanccccctcgaactgacagaatncgnttttnaggangtctcgctccnaaaacaccccnnggggncgcgctactctctctttctggcctggaggctatccagcggactccaaagattcaggtttactcacgtcatccagcaggagaatggaaagccaaatttcctgaatngctatgtgtcttgggttncatccatccgacattgagggggggggnacngaagaatgggagagagaat

SEQ ID NO: 21573 - DNA, 251 bp, Homo sapiens
  misc_feature 3, 4, 29, 33, 35, 37, 40, 49, 54, 76, 93, 95, 105, 125, 138,147, 197, 202, 206, 229, 241, 244: n = A,T,C or G
aanncccaaattaaaaagactgactattntttngngntgnaaaatgganaaggncccacacctctcatatgctacnggtgggaatgtaaaatngnccacgcgcantggaaacatttttatagttncttaaaaaggcanacatacacnctaccacctgacccatccattccactctgggatggttaattttacgggtnaagcngacnagaggttgggttgcccagggatntggtaaggtatnatnttgagtg

SEQ ID NO: 21574 - DNA, 153 bp, Homo sapiens
  misc_feature 2, 30, 32, 34, 35, 44, 45, 48, 52, 53, 59, 62, 65, 75, 81,91, 92, 106, 108, 113, 125: n = A,T,C or G
ancccgattactctgttttttaagtttttnangnncaccgcaannaanaaannccccgnganganggtcaaaaanaattcnctataggccnnccaaaatacttacncngcagngtgcgcaggatnatacatattccgctcaaataagaggtcg

SEQ ID NO: 21575 - DNA, 187 bp, Homo sapiens
  misc_feature 2, 13, 29, 49, 59, 60, 61, 63, 107, 124, 143, 163: n = A,T,C or G
anaacccctgcgnactgaaagacctcagnttttgggattcatttgatgngaaaaacccnnngnaagtatggaattattagctatgataaaaatgttttgccgctagnttggggggactcatggnagcagtttcattaccttgnaatgcatgaacagaacaganggacatctattcctggctgtattc

SEQ ID NO: 21576 - DNA, 340 bp, Homo sapiens
  misc_feature 7, 10, 36, 39, 61, 218, 268, 284, 300, 310, 327, 339: n = A,T,C or G
tggccgnaanccctgaggaatttacctgtaaatttnagncgtacagaaagctgcctggccnatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgtnacctactttgactttttgcatttaaaacagacactggcatggatataggntttacttttaaactgngtacataactgaaaangggctatacngcatactttttaaatgnaaagatattttna

SEQ ID NO: 21577 - DNA, 138 bp, Homo sapiens
  misc_feature 7, 13, 36, 40, 53, 60, 68, 71, 76, 77, 78, 110: n = A,T,C or G
atggccnaaaaanccccgcaagcttctatagtacgngggntttttgggggttnatccgtnacaaaganccnggggnnnggggtcatggggccagcctgactgaaaaaagnacgctcccgggagacgaatgaggaacca

SEQ ID NO: 21578 - DNA, 398 bp, Homo sapiens
  misc_feature 11, 37, 39, 52, 54, 58, 60, 61, 62, 139, 175, 209, 210, 234,312, 357: n = A,T,C or G
atggccgaaanccttcggcgtaaatgttgagattttnangcccttttaattncngacncnnngcgggtgatctatttttctctcaagtagcttttataatctccttatccttgatattctgaaaattcatgatgctgtnccttattgcatatgtgtttcctttattgtgcagggngctcaatggtttctatcaatttgaagatacctgnncctgagtcctggagacactcttgngttctttgatagtttttaatagttttctctgtgctctctatctgaattcacatttattagctatgataacctcctgcnttagacccctaattttctcattttctacatcttttgttttcctgncttccaattcatttaacttctattaaattaagaaggttttg

SEQ ID NO: 21579 - DNA, 279 bp, Homo sapiens
  misc_feature 5, 23, 30, 37, 54, 57, 60, 65, 66, 71, 72, 88, 94, 98, 102,109, 114, 154, 163, 166, 169, 196, 204, 212, 225, 246, 254,258, 267: n = A,T,C or G
atggnaaaaaacccgcagctggngaaagcngcttttntggggaatacaaccganaanagnccggnngggtnngttaacaataatgganggaaanaggncagnggagaanatgcnggaaacaatttcttccttcaaagaagcagtatcgggcaanaaccgagcngangcngccagggaatccttacaagaataaaanagcgatgnctttgganggggggggggaanagagcccaaaaaaccttctanacaaggancccnaatttttcngggggttaacgg

SEQ ID NO: 21580 - DNA, 229 bp, Homo sapiens
  misc_feature 7, 14, 148, 153, 171, 176, 216, 218: n = A,T,C or G
atggccnaaaaccnttgaggcagccagcgcagggtttttttgctgagggggcaggcggagcccgaggaaaccgcaaataagtttttttctctttgaaagatagagattaatacaactacttaaaaaatatagccaataggttactaanatatngcttagcgttaagttttnaacgnaattttaatagcttaagattttaagagaaaatatgaagantnagaagagtagc

SEQ ID NO: 21581 - DNA, 288 bp, Homo sapiens
  misc_feature 2, 14, 44, 67, 71, 185, 216, 242, 243: n = A,T,C or G
tnatggccaaaaanccctatgattttctttaaggatgttttggnaatggaaaaatgtaaacaacccncggnaattattttggatctatcacctggcatcataactggcttctgcttgtcatccacacaacaccaggacttaagacaaatgggactgatggcactcttgagctcttcatttatttngactgtgatttatttggagtggaggcatggnggggaagaaaaacatgtcatgtaggnngtctaaaaataaaatgcatttaaactcatttgagagaatgccttt

SEQ ID NO: 21582 - DNA, 145 bp, Homo sapiens
  misc_feature 9, 42, 64, 66, 88, 91, 115, 135: n = A,T,C or G
tggccgaanaacccggagaaaaaaaaaagagagtttttgganataaggtagcaaaaaaaacccnancggaatgtgccccgcaaagaanatngctggaagaaccagctttatagcntagattcaaaaaaagatagngccatgcatg

SEQ ID NO: 21583 - DNA, 256 bp, Homo sapiens
  misc_feature 2, 15, 29, 67, 120, 215, 216, 217: n = A,T,C or G
gnatggccgaaaacncaagtacgtcttgnactcatgatttttgcccacattaggcttaaaaacccangcgattcccggacgtctaaaccaaaccactttcaccgctacacgaccgggggnatactacggtcaatgctctgaaatctgtggagcaaaccacagtttcatgcccatcgtcctagaattaattcccctaaaaatctttgaaatagggnnnggatttaccctatagcaccccctctaccccctctagagc

SEQ ID NO: 21584 - DNA, 219 bp, Homo sapiens
  misc_feature 8, 14, 37, 40, 58, 60, 61, 216, 218: n = A,T,C or G
atggccgnaaaacnccagcccgtctcaaaaaacaaanttntaaattaccaggtgtgangnnaccccgcctgtggtcctagccacttgggaggctgagtggagaattgcttgaacccagaaatttgaggttgcagtgagctgtggtcaaaacactgcgctccagcctgagcaacagactgagaccttgtccaaaaaaaaaaaaaaaaaaaaaaaaanana

SEQ ID NO: 21585 - DNA, 101 bp, Homo sapiens
  misc_feature 2, 11, 15, 43, 48, 69, 70, 71, 72, 73, 74: n = A,T,C or G
anggcgggagnaaanccaaaaaaaaaaaaaaaaaaaaattttntgggnaaaaaaaggagaaaaaaaaannnnnnaaaaaaaaaaaagggggggggcggggg

SEQ ID NO: 21586 - DNA, 114 bp, Homo sapiens
  misc_feature 10, 11, 12, 18, 21, 35, 37, 38, 42, 47, 48, 49, 69, 77, 87,91, 96, 102, 110: n = A,T,C or G
tgggggggannnaaaccntcngcacagcgaagggngnnaaanttttnnngggggggttaaaaggggaanaaaagccncgggggggcnaggnaaaanaaatanaaggcggnggaa

SEQ ID NO: 21587 - DNA, 332 bp, Homo sapiens
  misc_feature 11, 41, 43, 45, 63, 214, 312: n = A,T,C or G
atggccgaaancccagtaattgaaggaatcccagctttttngngngcctctgaatgtgaaagnccaaacagagtccaagaggttaaccattttggccaagaacattagctagtacatggcagatctgtttctcaaattgagatacttgatgtttttgctgggtaggaggagaaacaagagggacagtggccatgttcacggagactatagcagngggggttctggggcgatgttgccggggagcagcatgatttatcacaacccttctgtacccagagagtccccagggctgttttcttatccttcattagnccctcttcttgttcctaaaa

SEQ ID NO: 21588 - DNA, 219 bp, Homo sapiens
  misc_feature 8, 42, 47, 64, 69, 148, 196, 197, 216: n = A,T,C or G
tggccggnaaaacccctcgtttttaaatgcctggctttttcnctggnacaagccaaggaatggnccctnaggaattctatgttctgtgctacacattctctctttagctatgtattctccttctattaagttattgcaacataaaggngatttattaagatgagaagcagacattgctaaaacaggaagaaaagcnnaaaaaaaaaaaaaaaaaangga

SEQ ID NO: 21589 - DNA, 292 bp, Homo sapiens
  misc_feature 10, 18, 48, 51, 224, 225, 260, 291: n = A,T,C or G
ctcttttttnatggccgnaagacccgaaatacttccttgaaaattttntanaaaacaaacaaacaaacaaaaccccctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctnncccatttattgtttggccagctatgccaatgtggngctattgtttctttaagaaagtacttgactng

SEQ ID NO: 21590 - DNA, 315 bp, Homo sapiens
  misc_feature 5, 11, 27, 36, 41, 43, 44, 61, 68, 144, 217: n = A,T,C or G
ccggnaaaacncagtaggtgattaagnatgcatccnttttngnngggtgcggtggctcaanccccccnatccaaacactttgggaggctgaggcgagtggatcacctgaggtcaggagttcgagaccagcctgaccaacaaggngaaaccctgtctctactaaaaatacaaaaattagcctggcaaggtggcatggtgcctatagtcccagctactnggggaggctgagaattccttcaacccgggaggccgaggttgcgctgagctgaaatcacaccactgcactccagtctgggcaacagagcgagactccat

SEQ ID NO: 21591 - DNA, 161 bp, Homo sapiens
  misc_feature 9, 10, 44, 50, 53, 55, 62, 63, 70, 71, 76, 79, 80, 113, 120,129, 131: n = A,T,C or G
tggccggannaaccccaatgaaaactctaaagacgacttttttngccgtnaangntcgggannagccganngtgcnacnncaaaaaaccaacaggactcacggacacaactanaaatacngggcaaaanantatgaaaaataccataccatagccaggcac

SEQ ID NO: 21592 - DNA, 326 bp, Homo sapiens
  misc_feature 5, 18, 66, 225: n = A,T,C or G
ctctnttttgtggccggnaaaacccaagttaaagtgagtatactgttttttaggacttccaaatgnggagaccccagctatatcactgctcaacatcagaaaacctgacggctatgattactatgccttttctaaagatcaatactataacattgatgtgcctagtagaacagcaagagcaattactactcgttctgggcagaccttatccaaagtctgggacanctgtccttagactgatgagcaaaggaggagtcaactaatgaagaaatgaataataaattttgacactgaaaaacattttattaataaagaatattgacatg

SEQ ID NO: 21593 - DNA, 100 bp, Homo sapiens
  misc_feature 2, 9, 30, 44, 57, 59, 62, 83, 84, 88: n = A,T,C or G
anccctganacgacggagaaacagtttttngggggttacggccngaaaaaaacccgngnctnagctgcgtgcccaccaggaannaccngggagggccaag

SEQ ID NO: 21594 - DNA, 100 bp, Homo sapiens
  misc_feature 9, 10, 14, 16, 17, 22, 28, 29, 34, 36, 38, 40, 46, 63, 65,71, 74, 78, 90, 91: n = A,T,C or G
gggtcaagnnaaanannaaccncggggnnatggncnanancattgntctgccaaccctttagngnaaggcngcnggantcaactagtggnncccaaatac

SEQ ID NO: 21595 - DNA, 365 bp, Homo sapiens
  misc_feature 32, 53, 55: n = A,T,C or G
aaaagcctttaaattctatagctatcattttntgaaatacacgttttcacggntngcgttttcctaaccttaaaagatagatttttacctatattctagtaacctttgaaactatgaggtcttatatttggaacagatacctgacaattatattgcatagtgctataatgaccaaatatgtactctaagaagtcattctgctttgaatgagatcaagtctgcaggtaaaactgtagtgaaggcatttggtgggtagaagttgagcatgactatcacttcgttctggtaagcaagggtagctaatgcatatcttgcttccttggggctaattcagaataggagaaaaaggattctgggcagaaaga

SEQ ID NO: 21596 - DNA, 276 bp, Homo sapiens
  misc_feature 2, 7, 33, 56, 78, 87, 246: n = A,T,C or G
anaaccnaagaaagaggcatgtaggaagttttnggagtccctgtctaataggaacnggttttttctgttgagtggaangccagtganaagggtcaaggggatggcgaggttttgaggaacttggggaccattggaaatgagcactatggagtggagagtgaatgcacttggagaaaccctgaaatgtgggacctgttgtgggccacgtggaaatgggggcattccagtgaatctagtcggcttggntgtttgacctttttttccatctagcattgc

SEQ ID NO: 21597 - DNA, 342 bp, Homo sapiens
  misc_feature 1, 49, 51, 115, 167, 207, 208, 231, 254: n = A,T,C or G
nagccccatttgggacacaatcgttgttttctgaagaatctgaagtttntnttaccaccatctttttctactctgtatggaagtagatctttatggggaaaagagaatttggggngttctgcaagccagtcaaagtgggacagcaaatcatataaatcgaattaaanggacaacaccgttagatgtgtatgtaaaaattttctgggnnatatttttcctttcactttcggnttaaaacatgctatatgtactgnatgtcctgtagcccagtgcggctccacagcatggaatctgatgtatgatatgatagaatgtggcacctaaatgcaggttcagatttta

SEQ ID NO: 21598 - DNA, 118 bp, Homo sapiens
  misc_feature 4, 5, 7, 9, 20, 32, 65, 81, 84, 92, 97: n = A,T,C or G
ttcnntntnatcggcgcatngggcatcggccntgccgtggacatgatatttggcatgatcttcantatgatcttgtgctgngcnatccgcangaacngcgagatgggctagagacagc

SEQ ID NO: 21599 - DNA, 166 bp, Homo sapiens
  misc_feature 4, 30, 54, 67, 94, 123, 163: n = A,T,C or G
aagnccagagagctagcgaagcaaattttnagttagctagttttccggggactncgctgtaggtggntaaatacccagagggagattatccagngaccttgctactgctgagctgtaaatgtngctgtacagtttcctggaattatcagggctttaggctctngct

SEQ ID NO: 21600 - DNA, 220 bp, Homo sapiens
  misc_feature 34, 35, 57: n = A,T,C or G
gaaccctgaagtggaaaactggaagacttttttnngggaaggcgaagaaaagaaccnagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatag

SEQ ID NO: 21601 - DNA, 100 bp, Homo sapiens
  misc_feature 8, 18, 41, 42, 45, 46, 50, 59, 60, 63, 69, 72, 94: n = A,T,C or G
tggccggnaaacccgatntgtgctctggctcggatttttgnnggnncatnattcagggnngcnccgggntgncacaaggctcttcacagacgcntctgta

SEQ ID NO: 21602 - DNA, 192 bp, Homo sapiens
  misc_feature 14, 35, 37, 38, 40, 59, 65, 111, 166: n = A,T,C or G
atggccgaaaaccncctgttactttcctggccttntnncnttatagatatgaagaaggncccgancttgagatgggaagattactctaaattatttgagggggattactgnactcacaggggacttaaaagagggaggcaggagaatccggagttagaaaagatgngacaatagaagcagaggttgaaatga

SEQ ID NO: 21603 - DNA, 212 bp, Homo sapiens
  misc_feature 5, 20, 28, 29, 47, 62, 63, 64, 72, 73, 78, 84, 109, 121,140, 160: n = A,T,C or G
ctcgntttttatggccgagnaacccagnnaaaattgatagaatctanttttactaaagagcnnntacagggnnccggnagtttnaacagagaaaacagacaacctacanaatgggagaaantttttgcaaactatgcgtntaacaaaggtcttatatccngcatctataaggaacttacacaaatttacaaggaaaaaacaaccccattaaa

SEQ ID NO: 21604 - DNA, 284 bp, Homo sapiens
  misc_feature 4, 29, 51, 54, 55, 56, 60, 73, 144, 164, 204, 205, 247, 250,263: n = A,T,C or G
cccnaaaaatcgatggctaacagcttttntgatataacctatggaaaaggnccnnnaatntaaaaggtgaggngattggagttaagactgagtaatgtggccgggcgggggggctcgctcctgtaatcccagcactttgggagnccaaggtgagcagatcactngaggtcatggagttcgagaccagcctgggcaacatggggnnaccccttctctacaaaaaatacaaaaattagctgggcatggnggngcgtgcctgtagncctagctacttgggaggctga

SEQ ID NO: 21605 - DNA, 100 bp, Homo sapiens
  misc_feature 4, 21, 40, 42, 45, 48, 49, 52, 53, 63, 64, 66, 71, 80, 81,84: n = A,T,C or G
tttnatggccggaaaacccgntaatttaaaggatgcaaananttntgnnagnnctgaacttanngnccccncagcagagnnatnacattctcataggagc

SEQ ID NO: 21606 - DNA, 126 bp, Homo sapiens
  misc_feature 12, 17, 31, 34, 36, 37, 52, 53, 77, 87: n = A,T,C or G
attggaccgaanaaaancccatttatatagnaanannagatcttttttggannccttcgagctagaaaaaaaacccnggggcaaaanttgaaagataataaaaagaatccggcataaatactaacg

SEQ ID NO: 21607 - DNA, 314 bp, Homo sapiens
  misc_feature 10, 11, 60, 71, 73, 74, 75, 122, 156, 192, 196: n = A,T,C or G
ttttgggcgnnaaaaacccctcccctctctacaaccctctttttttagcgcttcttcttnaggggggcccngnnngactgctgaatggcgtgccctctggagaaggccctggatgtgatggngtccaccttccacaagtactcgggcaaagagggngacaagttcaagctcaacaagtcagaactaaaggantttnttgacccgggagctgcccaggggggggggggaaaaggacagatgaagctgctttccagaagctgatgagcaacttggacagcaacagggacaacgaggggggacttccaagagtactg

SEQ ID NO: 21608 - DNA, 331 bp, Homo sapiens
  misc_feature 8, 23, 24, 31, 35, 37, 49, 58, 62, 78, 129, 140, 180, 206,207, 233, 313: n = A,T,C or G
aaacacangcttagaggtgatcnnaattttntaananggaatgatacanaccacggtngaancctgtgaaaacataanattcacacggcttatgaaacaatgacacagtgaagaaaagaatagtatctnggtaacaatcnacattatgactgggatagtatctcacaatactaacattgnatggagatggtctaagtgctccattnnaagatacagattggcaaaatgaatanaatcgtcacaaaccaaatatctgctgtcttcaggagacacatctaacacaaggattcttatagacccaagggaaaagggnggaaaaagatatttcatg

SEQ ID NO: 21609 - DNA, 100 bp, Homo sapiens
  misc_feature 4, 19, 52, 56, 64, 66, 68, 89: n = A,T,C or G
gttngagaacccggcccangcttgtaaacgactgtgcgtccaaaataaatanaggntggatacngnangcctacactgcaatggcggangtttaacccac

SEQ ID NO: 21610 - DNA, 127 bp, Homo sapiens
  misc_feature 6, 24, 33, 39, 49, 54, 57, 58, 62, 63, 71, 78, 84, 85, 90,92, 109: n = A,T,C or G
ccgtantgatagaaatacacagancattttttngcaccntttctagganagggnccnnaaannaccagggnaatcctntcaccnnaagananacacagtaagatacaantgtaaggtatacggatgg

SEQ ID NO: 21611 - DNA, 256 bp, Homo sapiens
  misc_feature 21, 22, 34, 41, 42, 102, 205: n = A,T,C or G
taggacctgatcaagaatttnntgtggacgttgnccctganngctctttataaaaccaaactctatctgaaatcccaacaaaaaaaatttaactccatatgngttcctcttgttctaatcttgtcaaccagtgcaagtgaccgacaaaattccagttatttatttccaaaatgtttggaaacagtataatttgacaaagaaaaangatacttctctttttttgctgttccaccaaatacaattcaaatgctttttg

SEQ ID NO: 21612 - DNA, 229 bp, Homo sapiens
  misc_feature 5, 29, 49, 50, 54, 120: n = A,T,C or G
ggggnacagaaacatttggcatagaaagntatggatctgcagctgactnnagcnggatattattaccctgacttgggcaccaaaatcacgtttcaaaactcatttgctgccaagtatggnagctcaagcctgtaatcccagcaatctgggaagctaagatggaaggaacactttgaagctaggagtgcaagaccaggctgggcaacaaagcaagatcccatctctacca

SEQ ID NO: 21613 - DNA, 371 bp, Homo sapiens
  misc_feature 13, 27, 45, 47, 48, 55, 68, 115, 125, 157, 205, 350: n = A,T,C or G
atcccctgggagnttcctgagggtttntcataaatgagggctgcncnntgcctgntctgcttcgaagnattcaataccgctcagtattttaaatgaagtgattctaagatttggnttgggatcantaggaaagcatatgctgccaaccaagatgcanatgttttgaaatgatatgaccaaaattttaagtaggaaagtcacccanacacttctgctttcacttaagtgtctggcccgcaatactgtagggacaagcatgatcttgttactgtgatattttaaatatccacagtactcactttttccaaatgatcctagtaattgcctagaaatatctttctcttacctgntatttatcaatttttcccagt

SEQ ID NO: 21614 - DNA, 114 bp, Homo sapiens
  misc_feature 2, 10, 13, 23, 25, 26, 29, 32, 33, 36, 37, 39, 40, 42, 46,50, 52, 55, 60, 69, 71: n = A,T,C or G
anatccgcangangacacaagtnannaanctnnttnncnnanctgntgancntgngccantgttccctngngagaagcagtaccctggtcgacatatgtagtaaagcgaatgat

SEQ ID NO: 21615 - DNA, 316 bp, Homo sapiens
  misc_feature 38, 52, 108, 119, 209, 281: n = A,T,C or G
ggccctgaaaaaaaaatagaaaacgggtttttgaccantgtcttaccttagntctagaagaactgacattttccatattttcaatgctgcagatacaattctgtgaanctttccggcangccactctgatatagtcccagaagctacgaggactttcataaccaaaccaggttacttgaccttcaggagacaaattgcgatataaaatnttaaaaagtaaaataaaactagacttgaaaatgcaagaacaataaaattctgaaaaataaaggtaatatagngaattataatggcaagggcaccaccaatctagggg

SEQ ID NO: 21616 - DNA, 115 bp, Homo sapiens
  misc_feature 15, 28, 29, 30, 43, 50, 54, 56, 58, 64, 93, 105: n = A,T,C or G
gaaccaatgtattgngctttgatactannnatctgtaaaatgntagtttnggtncntntttttnctgctggaggatttacatattaaattttntctgctggtggntaaaccttaa

SEQ ID NO: 21617 - DNA, 358 bp, Homo sapiens
  misc_feature 51, 58: n = A,T,C or G
aggcactggcaaactagcctatctgaccacctgttttgtacactttaaggnggttggntgcctttttaaatggttgaggggaaaagaataccttgtgggatatggaatttaagttcgagtccagttttattggaacgtggctatgcttattcatttatggattgactgtggctgttgtcaagtgcatgagcagagttgtgtctaacagactagagcctgcaagtttgccagcccctgatttaaaagatgaaggtacacagaatgtgggctggctggtgggcaaaggggtaaaaatgttctctatattgtatctgaaaagatggggtgtctgaataagaaaatgcatctatttgacaga

SEQ ID NO: 21618 - DNA, 394 bp, Homo sapiens
  misc_feature 10, 11, 28, 37, 46, 51, 74, 75, 153, 380: n = A,T,C or G
cccttttttnntatggccggaaaccctnaaattgatnagtggaacnttttngtaaacccagaaacagacccacnnttatacagtcatttggttttcaacaaaagtgccaaagcaatacaacaagggaaaagaagtgtcttttcaacaaatggngttggcgaaactggatttccatgtgggcttaaaaaaaaaattgccccttcccacatactatacatagaaaataattctaaattctaactgaaaaagcaaaaactataaagcttctagaggaaaacatctttgtagcttgggagtcgacaaagatttcctaggacctacagcttttatagctaatgggaaaccttagctataaaagaaaaaaacttataaatacttgngacgaaaagacatt

SEQ ID NO: 21619 - DNA, 361 bp, Homo sapiens
  misc_feature 48, 69, 205, 206, 222: n = A,T,C or G
aacccaggtgaatttaaaacacagtatttttagttgatcttgacaagnaagcccgtcttactgtctgtnagaacattgtttcccagtctgaggtgttgaatatgatcctcacaaaaaaatattactttaaataagaataaaatataccaggtcttccaattagtaatccacaatgcatgtttttaaagactctgagaaaactttnnaaagaatttgcttatnagtctaaatagaacaagtagggataggagtaagagaaaaccttactcttttgcaccatttgcaatttgtgacagttttcatagtgataggagaaaggtagagatggggaggagtctgccgtaaagatatatatttaact

SEQ ID NO: 21620 - DNA, 238 bp, Homo sapiens
  misc_feature 13, 23, 40, 46, 50, 61, 62, 64, 71, 76, 81, 98, 104, 140,150, 152, 216, 220, 221: n = A,T,C or G
tttatggccgganaccccctganggaaccaggctgctatnttgganttanaggacactggnnancccgccntcctncaatntgacccatcgcctcgtngagggngagcctcatgtcacacggcgcaccccagactacttnctataaattncncctgggaaacctgcctttgtatgtggaagtatacctggctttttaaaatatatgtatttaaaangggnnagcaacagtaatctatg

SEQ ID NO: 21621 - DNA, 396 bp, Homo sapiens
  misc_feature 6, 11, 52, 69, 77, 134, 207, 226, 228, 269, 336: n = A,T,C or G
cccttnttttnttatggccggagaccctggagtcgatcaactctaggttttnaactcgttatgaaaagngggaagcncgtcctggggtacaagcagactctgaagatgatcagacaaggcaaagcgaaattggncattctcgctaacaactgcccagctttgaggaaatctgaaatagagtactatgctatgttggctaaaactggngtccatcactacagtggcnanaatattgaactgggcacagcatgcggaaaatactacagagngtgcacactggctatcattgatccaggtgactctgacatcattagaagcatgccagaacagactggngaaaagtaaaccttttcacctacaaaatttcacctgcaaaccttaaacctgcaaaatttt

SEQ ID NO: 21622 - DNA, 364 bp, Homo sapiens
  misc_feature 50: n = A,T,C or G
gaccccttagccaacctttacccttttaaagtataggcgatagaaattgncacctggcgcaatagatatagtaccgcagagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaa

SEQ ID NO: 21623 - DNA, 272 bp, Homo sapiens
  misc_feature 7, 15, 30, 42, 43, 48, 51, 59, 64, 65, 66, 71, 72, 83, 85,86, 90, 101, 110, 113, 119, 205, 206, 209: n = A,T,C or G
gccctcntcccgctnaactgaagtttttangatgggaaccannaaaangcnctggagcncaccnnnaaaanncggcaagggancnngctnttgaagagaanagaaaaaancgncacggnctgatccggaaatatggcctcaatatgtgccgccagtgtttccgtcagtacgcgaaggatatcgggtttcattaagttggactaanngcngttccttcagaggattatccggggcatctactcaatgaaaaaccatgataattctttgtatat

SEQ ID NO: 21624 - DNA, 261 bp, Homo sapiens
  misc_feature 80, 152, 204, 205, 206, 223: n = A,T,C or G
aacccaaaaaaattcaactccatatgttttcctcttgttctaatcttgggaccggggcaagtgaccgacaaaattccagntatttatttccaaaatgtttggaaacagtataatttgacaaagaaaaatgatacttctctttttttgctgtnccaccaaatacaattcaaatgctttttgttttatttttttaccaattccaannncaaaatgtctcaatggngctataataaataaacttcaacactctttatgataact

SEQ ID NO: 21625 - DNA, 286 bp, Homo sapiens
gagtatagttttccaaaattatttcttcttcagctttccataaaaactattttagttcatttccactgcagcagtggttatttgtttgaccaagtgtaaatatgttacatgactaaatagaaaaggattgatgggaaaactggtgactaattggggtcggggggagggaatcaggtgcacacccaagggtcattatagagtgtagaaacaacaaattgcaattctacgcaaacaactggaaaacgggatatatcatcgtgtgttagagagaataacagaaccataa

SEQ ID NO: 21626 - DNA, 100 bp, Homo sapiens
  misc_feature 3, 7, 29, 31, 35, 60: n = A,T,C or G
agnaatnctatatataccattacctttgncnaganttatgtaattccccacaacttcgcngagttatatgttcgggggacttttgccaaatttgtctgct

SEQ ID NO: 21627 - DNA, 128 bp, Homo sapiens
cactgtttctggagagtccatagtatatagcaaacacatataatttttgtacttgccactttattttacatttatttgcatacttgcatgtctttcaaggatggatattatacctttgggaatttggg

SEQ ID NO: 21628 - DNA, 371 bp, Homo sapiens
  misc_feature 70: n = A,T,C or G
gagtccgagtggagagcagcgagctgagtggttgtgtggtcgcgtctcggaaaccggtagcgcttgcagnatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctata

SEQ ID NO: 21629 - DNA, 235 bp, Homo sapiens
  misc_feature 24, 67: n = A,T,C or G
tcgcggccaagtcaggtgcttacntgcctagaaaaaatctaggtaagcaaggccgggcacggtggcntcatgcctgtaatcctagcactttggaagtccggggcaggcagatcacttgaggtcaggagttcgagaccagtctggccaacatggtgaaacccttctctactgaaaaatacaggaattggccgggtgtggtggtgcatgcctgtagtcccagctactcagttggctg

SEQ ID NO: 21630 - DNA, 109 bp, Homo sapiens
gatgcttagatgcttatattagaaagttaaatggacgttaagtaaattgagcaatcaactcaagaagctggaaaaaacaagagcaagcccaaaggaagtaaagggacag

SEQ ID NO: 21631 - DNA, 341 bp, Homo sapiens
ctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctat

SEQ ID NO: 21632 - DNA, 310 bp, Homo sapiens
gggatttggagaaagtccatataaactgaactctgcagcaggtgattaaataaagagataaccacagtagtgataatttcattgctgggttaggaaccaaaaagctagttgcaaagtttacatctgctgttcagcagtacaaattgttgaataaatgaataatactgtaagtttgaaaaaaccaactgattctgtcaagaaatataatactgaaaatagaatcaatagcatcagatggaaatctagaaaatgataacctgcttttgtcaaacattttacatttttgccataaataagactatttatattg

SEQ ID NO: 21633 - DNA, 302 bp, Homo sapiens
  misc_feature 243, 286, 292: n = A,T,C or G
aggctaagtagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcttcaaggtagaaatgtctatgttttctactccaattcataaatctattcataagtctttggnacaagtttacatgataaaaagaaatgtgatttgtcttcccttntttgcncttttgaaat

SEQ ID NO: 21634 - DNA, 254 bp, Homo sapiens
  misc_feature 1: n = A,T,C or G
natggaaagcagagtgggtggatctcttcagctcaggagtttgagaccagcctgggcagcaaggcaaagccctgcctctacaaaaaatacaaaaaaaaacagaaaaattagccgggcattgttggtgtatgcctgtagtcccagctacttgggaggctgagggaagaggatcacttgagcccacgagtctgaggcttcagtgagctctggttgtgccactgcactccagcctgggtgacagagcaagaccttgt

SEQ ID NO: 21635 - DNA, 123 bp, Homo sapiens
gtagcacctatgcacaagtattcactgtatgacaaggctctgtgatgaacttctagtccagcatgaagggccaacattagaatgattataatttttagtgggaacaatgtaaataaattagga

SEQ ID NO: 21636 - DNA, 370 bp, Homo sapiens
gccttttggctctctgaccgcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaa

SEQ ID NO: 21637 - DNA, 374 bp, Homo sapiens
gatggcagcagtattcatgatcataccaactcccactgctttctgaagatgctacagggaaatctaaaggagacattatttgcctggcctgacaaaaaatccaatgagatggtcaagaagtctgaaagagtcttgagggaaaaccagtgtgcctacatcaatgattccattggcttacatcgagtagagaacatcagccatacggaacctgctgtgagccttcacttgtacagtccaccttttgatacatgccatgcctttgatcaaagaacaggacataaaaacaaagtcacaatgacattccatagtaaatttggaatcagaactccaaatgcaacttcgggctcgctggagaacaactaaggggcaccaaa

SEQ ID NO: 21638 - DNA, 360 bp, Homo sapiens
  misc_feature 5, 11, 48: n = A,T,C or G
ctcgngagcantatggtccggggttcagcaatagtatctacagtcagnaaaaactcaacttcagtctttcagccaatatattgagaatagaccagagtatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgc

SEQ ID NO: 21639 - DNA, 373 bp, Homo sapiens
  misc_feature 4, 15, 22, 27, 32, 37, 42, 98, 100, 106, 144, 169, 329, 358: n = A,T,C or G
gtanttaatgtgtcncactaantaagntactnttgangaaantatgcgcattgttatgacacataatgagtgggttccaaactctaaagataaaatanangcactnctatgggcggctgagatgaataccttttttgtggctgnatgaatctttactctttaaatgtgnactttacaatgtttacaaggagcttctctggtttgttatcccagcaatgcccttggtgagagcttcattctgcatttgtttaattcatatgctttgcttttggcatatgcttgctttttgcactagtagaattttaacttacctcattattatgtttgtnatcatttgtctagcttctgtaatgtatcngatataggctaaaca

SEQ ID NO: 21640 - DNA, 124 bp, Homo sapiens
  misc_feature 3, 7, 17, 28, 65, 73, 123: n = A,T,C or G
aanatancaggctaccnacccacacacngtaacatgctacgcacaactgcaaggatacccacacncattcaanaattactacttcttaaaacaactacttcttgcacccaaagtaactacccnc

SEQ ID NO: 21641 - DNA, 247 bp, Homo sapiens
  misc_feature 4, 242, 243: n = A,T,C or G
gacnttatggtccggggtgaccctgtggtgaggtgaagggcactctatataaggagcgattcaaacaaggaacctcaaagaagtgtatacagagtgaggataaaaagtggttcactcccagggaatttgaaattgaaggagaccgtggagcatccaagaactggaagctaagtatacgctgcggtggatataccctgaaagtcctgatggagaacaaatttctgccagaaccaccaagcgcnnaaaa

SEQ ID NO: 21642 - DNA, 378 bp, Homo sapiens
ggacaactcggtggtggccactgcgcagaaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcg

SEQ ID NO: 21643 - DNA, 368 bp, Homo sapiens
ggagtgaaaatatatcctaactaaattaatgtggaaagagcatttttttagacaatttcaattttaaacacataaaactttcaagatcttcaggactttttaaagcacatttgaaattattttagtaagaattttgttttatcaatagatgttgaattctgttttttaattaaatacaaagcttagatttcagaaagagagggaaaatagctggtggtcccagagtgtgctgctgttaattgtttaacaaaggggaaaatgtacataaacagataaagttaccataaattccatgaacttaaatctgtgattcattgccttaaaactttctctcttagaatttccataccgcatgccaaaccagtaaa

SEQ ID NO: 21644 - DNA, 192 bp, Homo sapiens
atgagattgtccaaaacaaagtaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaatagaaa

SEQ ID NO: 21645 - DNA, 366 bp, Homo sapiens
attctaatgtatagtttcaagtcttaatagacaatctgaattccactacatttcttttggctccaacattccttttagcttgaccagtctaatttaaaatgtgtttgttggaggtcattaacgttacttgtacaatgctgtcactgtgtgacatccatatgaattttgattgattatgcttagaaatactatagtaactagatgcagtgtgaattttttccattaacaaacaaacaagtcagtggcttaaatgtgattatggtcctgcaaggtgattcttgctaaaatatctaaacttttgttttgttttaactgaatcattttttaacttaaaaagctggaaaatatcaaatgctgttttttttt

SEQ ID NO: 21646 - DNA, 400 bp, Homo sapiens
  misc_feature 9: n = A,T,C or G
tttgacccngggaattcggccttatggccgaggcatggcgttggaacttgctagaaggagccctggaaatagtcaaaaagttggaaatcaggagtactatctaaaatcttgtttttgccattttttaactgtataactttcagcaagtgttttgaagtcccagaggctccatttcttcttgtgtaaaatggagataataccaatcttacaagttaaggctttacatagtgacctgatgcttaagtgatacccacttaaggtgggtaggattttctagctgtggtgcttttccacatgtgaccattgccatttagctaacatttagtgagcatttactatgcgccaggtattgtttgcaaagtcacctgtttgactcctttattccctggtaaccatatga

SEQ ID NO: 21647 - DNA, 370 bp, Homo sapiens
ggagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactg

SEQ ID NO: 21648 - DNA, 252 bp, Homo sapiens
catcctggacaaaaaagtgagaccctgtctctacaaaaaataaaaaaatcagctgggcatggtggctcatgcctgttgtcccagctccttgggagatggaggcagaagaatcatcttagcccagttggttgaggctgcagtgagacaaggttgtgcctctacactctagcctgggcagcagagcaagaccctttctctcaaaaaataaagataggctgggcacagtgactcacgcctgtaatccctgtctct

SEQ ID NO: 21649 - DNA, 263 bp, Homo sapiens
gttattatcgaaacctcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaacacacaaaaaaaa

SEQ ID NO: 21650 - DNA, 275 bp, Homo sapiens
atgattaagagggacggccgggggcattcgtattgcgccgctagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggagtatggttgcaaagctg

SEQ ID NO: 21651 - DNA, 275 bp, Homo sapiens
  misc_feature 72: n = A,T,C or G
accgtgaggatggtgtgaccccatatatgattttctttaaggatggtttagaaatggaaaaatgttaacaanatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaac

SEQ ID NO: 21652 - DNA, 345 bp, Homo sapiens
agcattaggcaattcagttcacttgatttatattctcttaatatttgtagactgctgtatgggctacagaagtatctaataaagttcttgccttcagggaacttagaatttaattgtaggcgttagacttagtcatataaaaggtaattctagacaacataaaatcaagaaatacaaaaacaaaatataaatacaggtaaaccgttaagaaaattctacattactgatggccatgtgtatctttaaggtccagtggaagattggggcttggggtttcccatagaagggctaatattttgacagctggagaggaagcaagaacccgttctatgaaggaaaatcatc

SEQ ID NO: 21653 - DNA, 400 bp, Homo sapiens
  misc_feature 7, 9, 395: n = A,T,C or G
attcggntnttatggcccgggggtaggtaggagttgagtagtaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaangcaca

SEQ ID NO: 21654 - DNA, 280 bp, Homo sapiens
gaaaaacaaataatgaccatttaaggcatatatctgaaacatcaaggatgaatgaacatgaatttgaagcctcagtagaaaggttctacatgcactaacagtttgaagagtgaattatttgtacgcttgtgttcagtctaatgtttaatgtgcttttatatttttgtaaagttgtattttacagtatttatattaatttattgtcgaaggccatattttcttgaagactgtttattaaaattgtttcttttttgtaataaaagtgaccctatgcgaccaa

SEQ ID NO: 21655 - DNA, 400 bp, Homo sapiens
  misc_feature 2, 3, 31: n = A,T,C or G
gnnatctatggtccggggaacttaccagaanaaattttaggattaggtgtctagtcctcaatataaagttatttgccttatttccatcaccccagacttttagttaatacttccataatgactttcgtagtatgttggggatggaaatcaaggaacagggataagtccctggacaggacaaagaggaaaagagcagccttgccgggtaggatagataccagtaagactaggcattcaggtcaggtgtggtggctcatgcctgtagtcccagcactttgggaggccaaggcaggcagatcacttgaggtcaggagttccgagaccagactggacaaagtggtgaaaccctgcccctactaaaaatacaaaaattggctgggcatggtggcggggtgcctgt

SEQ ID NO: 21656 - DNA, 371 bp, Homo sapiens
ggctgtagtggcttcgtcttctgtttttctcttccttcgctaacgcctcccggctctcgtcagcctcccgccggccgtctccttaacaccgagcaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaat

SEQ ID NO: 21657 - DNA, 370 bp, Homo sapiens
caatacaaccgtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtatttta

SEQ ID NO: 21658 - DNA, 346 bp, Homo sapiens
attatttttaaatttgaattaattgacttaaaataatacagttaagaagtataaccagcaggattatggagaaaggtttctttttccttaaaaaaaacagtgctctcagtgttacacttaagatgagattgaaattttcttttttacgccaggtgccccgttctaagattcagagcagcaatgtgaatattcatccttgcagtggagctgagagaagttgtagggcaaatcctgggaacaaggtcactttaaacaaaaaagttctccaagtttcccatgcttataaggctggctgggcttaattaaagtcaatggatgaccaaaaaataaataaataaatagagag

SEQ ID NO: 21659 - DNA, 151 bp, Homo sapiens
ggggcttcacctgtgttgcccgggctggagtgcaatggtgccatcacagctcactgcagtcttgaactcctgggcccaagcaatcctcccgtctcagcctcctgagtagctgggtttactggcacatgcctccacacttagctatttaaaa

SEQ ID NO: 21660 - DNA, 362 bp, Homo sapiens
  misc_feature 329: n = A,T,C or G
tcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctntgggaatgggagaggggtaggatgtacaggggt

SEQ ID NO: 21661 - DNA, 175 bp, Homo sapiens
taaagataaaggccttaccctaaataatcaaagatattattaacaaggagatatattactgtaacttatacatatacaacaacatggtccaaaatatataaaacaaaaaattgatatatttataaaagaaatgggcaaatagatgatttttaagaagcatctctaatgaaaaaaa

SEQ ID NO: 21662 - DNA, 372 bp, Homo sapiens
atgcaaagtattattaaagccctggtggtactcttgaactgaactgccgcatatagctgtgtggaacatatccagagttgcttcctatctgctatgtactggataaagggagttccccggctccaagcagtactgaagattctgtggcctgtggtgtagacgatgggaaacaaaggactatgggtgagaatttactgagtactggggcatgctgctgaggtaactcttaggaatatttgacagttgcagccagctttccaatcaccatctttcttttccttctaagtagtccaggaatcagtttggttaaattcctttcttctgcaatttgaccaagactcctttcttccctggtccccactgtgggaccaa

SEQ ID NO: 21663 - DNA, 100 bp, Homo sapiens
  misc_feature 2, 16, 39, 41, 42, 44, 61, 73, 79, 81, 91, 92: n = A,T,C or G
tnttatggaccggggntagtgcattgaggcggccagcgnanncnactcgctgctgaggggncaggcggagctntgaggnanccggaggatnngttttttt

SEQ ID NO: 21664 - DNA, 368 bp, Homo sapiens
  misc_feature 173, 307, 333, 335, 358: n = A,T,C or G
gtgtatagtatataaacatgtaaaaataggttgtattttactctatgtatgatgctaatcaatgaacactttatttattttacagagaaaacttatctgtgaactttactatatatctgtttattttactttattttttttttaaataaaaagggttttaaatgctatgcagncattagtagaaaattttttaggactctgcctgctctgtaactatcttaatatgatctggcagaaactcgcatgtatccaagtaaagtagtttagctaaagaaaggttcttcattgcttttctgttcacagttgnggctctgttttttaagaatgtaactngnttttagattatacttgcatctgngactttacta

SEQ ID NO: 21665 - DNA, 368 bp, Homo sapiens
  misc_feature 102: n = A,T,C or G
atttctgggcatttgtaatatggtattctactggtatatatttttaaagtttgcgtttagattatggtaaagaaatttcaagcatatttcttctaataaagnattaagacagtgtttcagaatatcaaggcacacctccttagttgttttagattagaactctagaaacaattttgtgaacattgaaagcattttgagttaagcctaagctgattaatcacacaatacatacttttcctgcattttctttcagtgacatttgagaattgggtgacattttaaaatgtgttttataccatttagtttttgcaaacaagttctaaagttttggagaaaaagtgatgtggtcaagagttgaagtctcatat

SEQ ID NO: 21666 - DNA, 372 bp, Homo sapiens
atttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaaccttcccacatgccgtgactctgg

SEQ ID NO: 21667 - DNA, 263 bp, Homo sapiens
gaatggagaccaacctgataaagctgacactctggaagggttagactcccaggaagaaagttaagaagggagaaggataacatctgcacaaaggcaaacacaaagcaacatcctttgtcagcaacatccttaggcacctggaagaagcagacacacaacttccaggaataatgtccctgaacctgggcttctgatgattcccaccaatatgaccatcaattagaatgcgtgcacacacacaattccaaataaatcatcaagac

SEQ ID NO: 21668 - DNA, 115 bp, Homo sapiens
  misc_feature 9, 23, 35, 85, 94: n = A,T,C or G
ggcagaagncctggtaatctggnccttgttcccgnctggataccagcttccttcagcagcgcaggcggtggtccctgaggcccgnggaaggagncaaacttgcgggaattttgca

SEQ ID NO: 21669 - DNA, 376 bp, Homo sapiens
  misc_feature 9, 13: n = A,T,C or G
ggagcaganaagnaggagaaagcagcatcttgcctggatgagccaggggacgcagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttggaaaagaagtattgcaataatttatcttcgta

SEQ ID NO: 21670 - DNA, 100 bp, Homo sapiens
  misc_feature 9, 22, 43, 44, 45, 69, 70: n = A,T,C or G
tttcggttnattatggaccggngatttgcctgttagtgcgagnnntgcgacaaggcgagcagctgcaannggccaggtgtcgggcgctgtttctcgtttt

SEQ ID NO: 21671 - DNA, 371 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaggaaaattgagagaaaggactacagagccccgaattaataccaatagaagggcaatgcttttagatt

SEQ ID NO: 21672 - DNA, 376 bp, Homo sapiens
  misc_feature 82, 259, 359: n = A,T,C or G
cacatctgtaatcccagcactttgggaggccaaggcaggcagaacacttgaaggagttcaggaccagcgtggccaacgtggngaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcancatgattagtgttggagcaaaacaaggaagcaaagcaaatactgtttttgaaattctatctgttgcttgaactattttgtaataattaaactttgatgtngagaaatcacaacttta

SEQ ID NO: 21673 - DNA, 376 bp, Homo sapiens
ggttgaatgaacaaattatttcgtgtgacagccatgactcaagttccaattagtctgaaaagggtactttggaattgtcccatattaatcagagatggcaaaagaaaaagttctcatattaccaggttgattttgtgtctcatttcaaattttaatttaaaattatggttttcatttttgtttaccttaaagtgatgcttaaaagtggcatgtaattaggacacttaggtttgttgaaagcattttcgacatttgtataaaagaatttgtgataaatatatccaggtgctcaccaaagaaacatgtattaacaacttaaattagatttttctaactgatagttttcactcatttataatcagtaggagagactgtc

SEQ ID NO: 21674 - DNA, 370 bp, Homo sapiens
  misc_feature 2, 11, 36, 84, 282, 300, 322: n = A,T,C or G
gntttttcgcnccgatagcgctcacgcaagcatggntaacgtccctaaaacccgccggactttctgtaagaagagtggcaagcnccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggntattaaaagatgcaagcnttttgaactgggaggagataanaagagaaagggccaagtgatccagttctaagtgtcatcttttattatg

SEQ ID NO: 21675 - DNA, 310 bp, Homo sapiens
  misc_feature 1, 102, 134, 183, 190, 302, 305: n = A,T,C or G
ngagcagtactgtaaacaagaaaaaaaaatcatgcattcttagcaaaattgtctagtatgttaatttgctcaaaatacaatgtttgattttatgcactttgncgctattaacatcctttttttcatgtagattncaataattgagtaattttagaagcattattttaggaatatatagactgncacagtnaatatcttgttttttctatgtacattgtacaaatttttcattccttttgctctttgtggctggatctaacactaactgtattggtttgttacatcaaataaacatcttctgnggnccagg

SEQ ID NO: 21676 - DNA, 120 bp, Homo sapiens
  misc_feature 7, 8, 10, 41, 45, 58, 59, 86, 91, 106: n = A,T,C or G
ggggagnntnagggaagacgaaccttgacgctgcagatgcnggtncacagatcgatgnnagatctttatttctagccatgcgctgnggtgnggaaaaattacctgncttgactgccatgt

SEQ ID NO: 21677 - DNA, 395 bp, Homo sapiens
  misc_feature 4, 8, 19, 20, 21, 23, 27, 28, 37, 44, 49, 54, 57, 59, 60,66, 70, 78, 83, 87, 90, 100, 104, 110, 120, 152, 155, 159,163, 164, 167, 169, 170, 172, 178, 181, 215, 217, 220, 221,231, 233, 236, 238, 241, 251, 276, 358, 359: n = A,T,C or G
gatngaantggggcacatnnngnctanngtactgtangaatgcnataancattngcnannatattnattnaataaacnagtcngccngtnctagaaaaangaanctaagntgatgcctgntgattgatttttgcttgattctcacgggctcngcncacntacnntcntnnantatacngcngtgatgctcaccattgactctgcccacattggcntngcnngctgtacccncnccnanatntgcataatcnattgggtcaagaggcttggatatgnatatttacttaaaaaattagtacatatcccatatacaggtgtccttaatgttttaaaaattaatgtaatattttaccatggnntagatctcaatctttttttaagcttttcctttattc

SEQ ID NO: 21678 - DNA, 294 bp, Homo sapiens
  misc_feature 3, 9, 14, 20, 29, 34, 43, 77, 119: n = A,T,C or G
gtngaaaanaaggncaaggnaggtgcggnggatnacgcctgtnatcccagcactttggaaggccaaagcggcagatnacctgaggtcaggagttcaagaccagcctggccaacaatggngaaacccagtctctactaaaaatacaaaaaattagccaggtgtggtgaccgggcgcctgtaatcccagctactcaggaggctgaggcaggagaatcacttgaacccaggaggcagaggttgcagcgagccaagatcacaccactgcactggatgacagagcgagactccatcttt

SEQ ID NO: 21679 - DNA, 174 bp, Homo sapiens
  misc_feature 5, 73, 76, 130, 169: n = A,T,C or G
aatgngaatgattaaggtcttggggggggtgtcccctatcagactacaggtgtttagaggcacagaaaaaggngcngttgggttcttaatgtgaaatgatgagaagcacaactccagtgtgtctctttgngtcgaatgtcagctgacaccccctgctggatgtgctggntcatg

SEQ ID NO: 21680 - DNA, 300 bp, Homo sapiens
  misc_feature 22, 153, 157, 192, 270: n = A,T,C or G
tgctcagcagatgatgcaccanccaattacttaagaacattagttgcttatattttcttcttgttttaagaaaaaacattttaagtggaaatctagttgaaatataaatcaagtgaacttttgtctaatagaacctgacttgttttgcatgcntgcntctgtttgtggaatttaagaacaacaacataggtngcagaagagatagctatccctgattattttgtactaggaactttaaaatagctgaatttttgtgaaaccccccatggngagaaaccaaccttgcttctcactccttaa

SEQ ID NO: 21681 - DNA, 362 bp, Homo sapiens
  misc_feature 150, 280, 357: n = A,T,C or G
tacatagtagtgatgtgggaaatatcagcaagaaacaagtcaacgtcaagatatttgggaatgatttcaagagactttgaagtaaatgtgaatatcacatactttttatgaaaattagcctgttggagtgaaacatttacattttatgancaatctttcttcagtcaaatatcaaaaaaatttttctgttttctaccaaaataggcaaagccgactaacaatttaagatcttcaggatagggtgtattaagaaattaacaccaaatggcaattactatgntaaatatccttttattttatgccaggtactatgtcattctattgcatctctatttttctgctcaattttcagatggntaaag

SEQ ID NO: 21682 - DNA, 395 bp, Homo sapiens
  misc_feature 25, 287, 331, 380, 392, 395: n = A,T,C or G
gtacctgaaaacaacgatggcaccnaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcgccaccatcttcaaagaaagcacctccaccttcaggagcatctcaaaccatcaaatcancaaccaaacgttcacccaaaccaccaaacatgaagaagactaanaaagttatagaatcagaggaaataacagaagaacattctgtttctgaanatcaagagtccnccn

SEQ ID NO: 21683 - DNA, 356 bp, Homo sapiens
  misc_feature 287, 298, 309, 335, 348: n = A,T,C or G
tacccaccttccggcggccgaacacactgcgactccggagacagcccaaatatcctcggaagagcgctcccaggagaaacaagcttgaccactatgctatcatcaagtttccgctgaccactgagtctgccatgaagaagatagaagacaacaacacacttgcgttcattgtggatgttaaagccaacaagcaccagattaaacaggctgtgaagaagctgtatgacattgatgtggccaaggtcaacaccctgattcggcctgatggagagaagaaggcatatgtnccgactggctnctgattacgangctttggatgttgccaacaaaattgngatcatctaaacngagtccag

SEQ ID NO: 21684 - DNA, 276 bp, Homo sapiens
  misc_feature 25, 32, 178, 208, 231, 263: n = A,T,C or G
ctacggtcccatcaagtcctgaccngggaagngagtgaaactgcaatggaagtagatactccagctgaacaatttcttcagccttctacatcctctacaatgtcaggctcaggctcattcgacatcatctcccacagaaagccctcattctactcctttgctatcttctccagacagngaacaaaggcagtctgttgaggcatctggncaccacacacatcatcagtctgntaacaataatgaaaagctgagcccccaaaccnggggacaggtgaa

SEQ ID NO: 21685 - DNA, 112 bp, Homo sapiens
attaaaaattgtgccttagaaaacgcaaagctgttgcacatggcgataaattatggatgcagtacattgaagagagatgaagtcacttccaagtttccaagacttctcatgg

SEQ ID NO: 21686 - DNA, 243 bp, Homo sapiens
  misc_feature 3, 150, 156, 200, 205, 227: n = A,T,C or G
gcncctattattcctggctttgtgctctgccaaacccttctttagcccttcacacatcgcactgaagaatatgatgctgaaggatatggaagacacagatgatgatgatgatgatgatgatgatgatgatgatgatgatgatgaggacancggctntttttccaacaagagagccaagaagccatttttttccatttganctggntccaatgtgtccatttggatgncagtgctattcacgag

SEQ ID NO: 21687 - DNA, 205 bp, Homo sapiens
taacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaactt

SEQ ID NO: 21688 - DNA, 374 bp, Homo sapiens
  misc_feature 211, 350, 355: n = A,T,C or G
ggacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgnggaagacaaaaagctcaaggagcgccttgatactagaaatgagttggaaagctatgcctattctctaaagaatcagattggagataaagaaaagctgggaggtaaactttcctctgaagataaggagaccatggaaaangctgncgaagaaaagattgaatgg

SEQ ID NO: 21689 - DNA, 175 bp, Homo sapiens
  misc_feature 25: n = A,T,C or G
agggaaacaaaaagtctaagggcancaatgtacaaacttagaagaaaattggaagatagaaacaagatagaaaatgaaaatattgtcaagagtttcagatagaaaatgaaaaacaagctaagacaagtattggagaaatatagaagatagaaaaatataaagccaaaaattggct

SEQ ID NO: 21690 - DNA, 285 bp, Homo sapiens
  misc_feature 22, 49, 191, 203, 208, 227, 269: n = A,T,C or G
actggggaatggagcaaaacantttttgaatatcgaacacgcaaggctncgagactacctattgtagatattgcaccctatgacattggtggtcctgatcaagaatttggtgtggaccgttggcccctgtttgctttttataaaccaaactctatctgaaatcccaacaaaaaaaatttaactccatatgngtccctcttggncggantcttgccaaccagtgcagngaccgacaaaattccagttatttatttccaaaatggttgggnaacagttaatttggac

SEQ ID NO: 21691 - DNA, 400 bp, Homo sapiens
  misc_feature 24, 173, 249, 290, 385, 386: n = A,T,C or G
gctcagcagggagctgctggatgngaaagagcctgaagtcttgcaggactcactggatagatgttattcgactccttcaggttatcttgaactgcctgacttaggccagccctacagcagtgctgtttactcattggaggaacagtaccttggcttggctcttgacgtgggcngaggtaaaaaggacgaagaagaggaagaagaccaagacccaccatgccccaggctcagcagggagctgctggaggnagtagagcctgaagtcttgcaggactcactggataggatgntattcaactccttccagttgtcttgaacaggcctgactcctgccagccctatggaagttccttttatgcattggagggaaaaacatgttggcctnnttctccttgacggg

SEQ ID NO: 21692 - DNA, 400 bp, Homo sapiens
  misc_feature 3, 7: n = A,T,C or G
ttngagnatgtctcgctccgtggccttacctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcattt

SEQ ID NO: 21693 - DNA, 360 bp, Homo sapiens
  misc_feature 282: n = A,T,C or G
aatcgtgtttgcagggagatttccgatgcctctgtgggtgtgtgtaagttaaagtggccacatttaagaaggccaagctttgtagtggttgcacagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttggggttttgcttctgtctgtctgtttattggaaacttgnacttcaagtagggggaatcctaattctaataactccttagctaagttttattattcaggcaataaacatgttttcatg

SEQ ID NO: 21694 - DNA, 320 bp, Homo sapiens
cctgtgtcgggtagaaagggtccttcctggaccgggaccctctgccacgaccatggaccgtaggaaaaagcctttggacgtcacggcctcctcgttggtagatcttaaggctgaactcttccgaaagcaagaagaattcaaacaagaaaaacttctaaaagattctggagtttttggaaaaccaaaaacaactaacaagaaaccaagtatctggagcaaacagaatgtaggcgtttcaaatcgagctgagaaggatgctgaacagaagattgaagaacagaagactttagacaaagcaagggaaaaattggaagaaaaag

SEQ ID NO: 21695 - DNA, 355 bp, Homo sapiens
  misc_feature 3, 16, 302: n = A,T,C or G
tgnaaaagaatacagntcttttttacataattagtgaaattttattttttattaggaaacactaaatagtgtaatatttcttttgcttttaaaaaaattcctggtagcaaatcaagataaataattgcttcattttcttgagcaatactgaagcaggatgaagtaagaggaatgcattcatttaaacatgctttgctttatgaattttgtctcttttttggtctctttttcttatattcaagttacaaatgtacaagtatccttactaagagtgctccttttgtattttacatatatacggnatgaaaatacattggaacactaggaaagtttttaaataacagttctaatttat

SEQ ID NO: 21696 - DNA, 400 bp, Homo sapiens
tcctctgatgctaaggattagacccggagcttgtttttgtcctgagtggacccaactggatctgtaactctgttaacacgtctatttttcagcagtctcatcagggtgttcaacatataaaagagattaaaggggtattttattagcataaaacattttatgtttacatattcaatatttatatattattttgtcagaccaacgaagctgttctgctaaacacaaacactggaagttagagtttatgggtgattgtctcatcgctttcagtattcagtttattactgtatttcattttgactggatgttaggaaaatcctgagttacagagataagttaaaaatatccatagtttttacgcaaaaattagctgggtgtggtaggcacctgtaatcccgct

SEQ ID NO: 21697 - DNA, 228 bp, Homo sapiens
  misc_feature 26, 188: n = A,T,C or G
actcgatatagttaagatgacacccnctacccaatgtgatctaaaaattctgtgtaatctctatccaaatcttaatggcatttttttgcagcttagaaaaaatccattctaggccgggcgtggtggctcacgcctgtaatcccagcatttgggaggctgaggcgtgtggatcatgaggtcaggagatnaagaccatcctggctaatacactgaaaccctgtctctact

SEQ ID NO: 21698 - DNA, 399 bp, Homo sapiens
  misc_feature 17, 146, 250, 256: n = A,T,C or G
gctatgaacatcaaagngaaaccgggatgttgtttaacttgatgttgaccttttggattaagaggactatcagattaaagcaaaatgtaattttaattcaatgaagatatcattaccaggttactcttgagatttttcaacggtgntagaactctcaaccaagacctgaaaaccaagtatgcaaggtttctgaatctctctggtagattaactattgacaatgattttctgttatctttgttcaaaaagntcatgncttctcaaaatatgaaatattgataaatggaagagcatacggtgacaagtctcctttccaaccccaggttccctacaccctgctctcagcaggcagtgagtgtcacacacctgttaatccatcttgagcaggacagtactata

SEQ ID NO: 21699 - DNA, 330 bp, Homo sapiens
  misc_feature 84: n = A,T,C or G
ttcatgattgaaaggaagcagtcttggccaggcacggtggcttacacctgtaaccctggcattttgggaggccaaggcgggcangattgcctgagctcaggagttcgagaccagccagggcaacatggtgaaaccccatctctactaaaatacaaaaagttagctgggcttggcggtgtgcgcctgtagtcccagctactcaggaggctgaggcaggagaattgcttgaacccgagaggcggaagttgcagtgagccgagattgtgccacttgaactccaacctgcactccagcctgggcaacagagcgagactccatctctaaataaac

SEQ ID NO: 21700 - DNA, 400 bp, Homo sapiens
  misc_feature 24: n = A,T,C or G
gcttcagagagaggaagccgaccncaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctc

SEQ ID NO: 21701 - DNA, 383 bp, Homo sapiens
  misc_feature 328: n = A,T,C or G
agggacaataaagcaaaaagtatcagtaaggataggtggctgagacccactgccctgagctactagtgtggctgtgcctgtgggtctctagaaccatctgcattggacgtgaagccacagcaggtggctggactgctggcctgttcctaatgagctacgctgggctttgaggtagaggttggggtttatgaaccccaactctggcttaaagatcttgctgtggctctgttatgttctgaggccttgggattagcctcttcctcattatggagctgattttctagtctgtggatcagctatgcctttggacacttctcttttccattgngccttttgaatgttgtcttctcactcagcatcagcacttcgatctaaatgcagac

SEQ ID NO: 21702 - DNA, 400 bp, Homo sapiens
  misc_feature 172, 176, 363, 365, 385: n = A,T,C or G
attatttttttaaacaaaatttccagttctgtaatgtaggcacttttattttcattgtgatttatatataaggtaatgtagggttatatttgggagtgactgcaagcatttttccatctgtgtgcaactaactgactctgttattgatcccttctcctgccctttcccaggnaatntaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgngnttagctacctttttatattnaaaaaattaaaaatg

SEQ ID NO: 21703 - DNA, 195 bp, Homo sapiens
  misc_feature 22: n = A,T,C or G
aagatgggacagagaccttgancatattcacacacattcaggaacctgttttgatgtattataggcaggaagtgtttttgctactgtgaaacctttacctagatcagccatcagcctgtcaactcagttaacaagttaaggaccgaagtgtttcaagtggatctcagtaaaggatctttggagcccgaaaaaaaa

SEQ ID NO: 21704 - DNA, 270 bp, Homo sapiens
  misc_feature 24: n = A,T,C or G
aaagtttcccagaattctaagaancgcagtatcctgtaccctaaaatttttcaaggtgactcctgttgtcgtctgttgataactttaataaaggtcatttaaggacataagtttttaaagactcccaaagtgaaacttaaacattttcgggattatcgattgcatatatcagtttatgctgtgtgctgaatcactatgccatgtgctattttagtgtttggggaaaatgaaaaataaaatttgttctttagcttaataaatatgtcttat

SEQ ID NO: 21705 - DNA, 400 bp, Homo sapiens
caggctgcggaggagactgctttccgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacattgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattc

SEQ ID NO: 21706 - DNA, 312 bp, Homo sapiens
  misc_feature 25, 26: n = A,T,C or G
gcaaaaccacaagcacgcaagtatnnaataagagcaagctgtcctgagcccatacctaatgaatttgcgtcttaaatattgtacattgtgtttgaggcttgtcaaaactgggattatggcaagaaaggttgcctaactcatacctttctgcctcaaattccaggtgctaaaggctaatggcattttaaacatcttacatttttaaaaatttatatcgcctctgccaaacaggcctaatagttaaaagcaagttgagacaaaccaggcagattcagtgtgtggaacaggaaggatgtgctttaaaaaaaggtg

SEQ ID NO: 21707 - DNA, 400 bp, Homo sapiens
  misc_feature 176: n = A,T,C or G
ctggaaggggaaactgaaacagacagaggttacttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgnggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcaggaaataggagctgatggcatc

SEQ ID NO: 21708 - DNA, 362 bp, Homo sapiens
ctggatgagccaggggacacagaccagaagcccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaattttggag

SEQ ID NO: 21709 - DNA, 398 bp, Homo sapiens
  misc_feature 21, 22: n = A,T,C or G
aaaaggaacctcttcgcgtannaccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctatgcggcaggccagaaggctgtcgaacccttgtatacagaggtatacatcaagagctggtgaatgcagcacgtatgtgggctctcacgcaaacgtgccttcttagtggagggcccagacttactacttacaactgatcatagaaagttgagttaaccaaactgccttttgcagttatcat

SEQ ID NO: 21710 - DNA, 198 bp, Homo sapiens
  misc_feature 26, 173: n = A,T,C or G
attaaactaaagtaccttctgcatcncaacaataaactgtcatcagagtgaacagacagtctacagaatggaagaaaatttttgcaatctatccatctgacaaaggtctaacatccagaatctacaaggaacttaagcaaatttacaagaaaaaaagaaccccattaaaaagngggcgaaggacataaacagacattt

SEQ ID NO: 21711 - DNA, 400 bp, Homo sapiens
  misc_feature 23, 25, 149, 385, 387: n = A,T,C or G
aacaagctcagggctaccactgncnctacattatgatcaactgcatggggtcctacaggagaagaccaagagacagagacagagaccagggaaaatgaccgataccattccttctcagggatgctacacacccatggggcagaggatangaggttcctgaaggcatcacccctctggccatggctggtgtgcagacaaagctggagatttggagtagcctgttgtcccactgactcttagactgccccagctaagaagaaccaactcctcctattacagatgaaataaacaaagctactcaagctctctggcatcgccctgacggtcatcatgtgcttcacatttccctcctgccccccctgattttctggaaaagggagaaagngngtgaaaaaaaatg

SEQ ID NO: 21712 - DNA, 343 bp, Homo sapiens
  misc_feature 24, 177, 320: n = A,T,C or G
ttttgtttgttttctagacttaanccaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgntggattcccttccttgctatttttattcagtagatttttgtttggcatcatgttgaagcaccgaaagataaatgatttttaaaaggctatagagtccaaaggaatattcttttacaccaattcttcctttaaaaatctctgangaatttggtttcgccttactttt

SEQ ID NO: 21713 - DNA, 333 bp, Homo sapiens
actctggaggctgaggcacaagactcacttgaacctggagggtggaggttgcaatgagctgagattgtgccactgcgttccagcctgggtgacagagggaggccaaggcgggtggaacacaaggtcaggagttcaagaccagcctggccaacatggtgaagccccatctctactaaaaatacaaaaattagccaggtgtggcggcagatgtctatagtcccaactactcaggaggctgaggcaggagaattgcttgaacccatgagcagaggttgcaggtgtaccaagattgcgccactgcactccagcctgggtgacagtgcaagactctgt

SEQ ID NO: 21714 - DNA, 190 bp, Homo sapiens
  misc_feature 3, 126, 141, 151: n = A,T,C or G
ganaagaatcagactgctgagaaggaagaatttgaacatcaacagaaagagctggagaaagtttgcaaccccaccatcaccaagctgtaccagagtgcaggaggcatgccaggaggaatgcctggnggatttcctggtggnggagctcctncctctggtggtgcttcctcggggcccaccattgaagagg

SEQ ID NO: 21715 - DNA, 400 bp, Homo sapiens
  misc_feature 17, 27, 327: n = A,T,C or G
ctcacgattgccatggncataggcccncagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggnggcttcctgcctgtgatcctagcactttgggaggctgaagctgaaggatcacttgagctcaggagttggagac

SEQ ID NO: 21716 - DNA, 116 bp, Homo sapiens
  misc_feature 10, 18, 29, 33, 38, 49, 51, 57, 75, 80, 84, 101: n = A,T,C or G
ttttttcttngccttttnaaccttaagcngttnaagtngaagcattctnanatgttnggggggaaacatcctctnaaaangggnccttgggcttgccttcnggggaggcggccctg

SEQ ID NO: 21717 - DNA, 117 bp, Homo sapiens
gctagagaattcacttcccctgtgtaaacctctatttccttggctataaaatgagcacattaagtgaagttaaggcccttctacctttaaaagtttatgaatctacatcttttataa

SEQ ID NO: 21718 - DNA, 400 bp, Homo sapiens
  misc_feature 23, 177, 322, 387: n = A,T,C or G
gaagttgcaggagagagaggcanccgacccaagccagtgcacttgatgttcatggacatatattttttttaaataataaattaaaacattttaaatagaagcataaattgagttgtttgttggcgctgagatactgcccactgtgaaacaaagctttgactagttttttgtttgttnactttcttcaggggggaggggggcaagtttgggtaggaaagaaagcataaatgaacgtgaccctgaggtgaagaggtatatgaacagcctttgcaatgtacaaaaagaaaaaaaaacaaaaaacaacaaaaaaaatagagcaagngaaaccaaaaatgatgttcttggggtttttctataatgtagtcttgttagcttttttgttactgnaacaatgctgatc

SEQ ID NO: 21719 - DNA, 386 bp, Homo sapiens
  misc_feature 22: n = A,T,C or G
taaggttcgggaagaggttgtncccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcaga

SEQ ID NO: 21720 - DNA, 338 bp, Homo sapiens
  misc_feature 1, 330: n = A,T,C or G
naaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccggcatgggtgctgaaatccggcatgttcttgtcacactgggtgagaagatgacagaggaagaagtagagatgctggtggcagggcatgaggacagcaatggttgtatcaactatgaagcgtttgtgaggcatatcctgtcggggtgacgggcccatggggcggagctcgtccgcatggngctgaatg

SEQ ID NO: 21721 - DNA, 361 bp, Homo sapiens
  misc_feature 6, 55: n = A,T,C or G
ggcccnatagatatagtaccgcaagggttttatgaaaaattataaccaagcatancatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacacta

SEQ ID NO: 21722 - DNA, 129 bp, Homo sapiens
  misc_feature 22, 23: n = A,T,C or G
gctgagggggcaggcggagctnncaggaaaccgcagataagtttttttctctttgaaagatagagattaatacaactacttaaaaaatatagtccaatagggttaactaaagaaatatttggcctttaa

SEQ ID NO: 21723 - DNA, 398 bp, Homo sapiens
agaaaaactaccacatgtatgtgtctcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaa

SEQ ID NO: 21724 - DNA, 399 bp, Homo sapiens
  misc_feature 122, 124: n = A,T,C or G
tttgaagggtagtggtggagctggcttcacagatgttatcaggaatctttctcatttctacagtctctcaccttttgcagatagatactctctacgactcgaaagcactacacagacagctncnggcttacttcagtccaactgagcaactcctctccatgtctcaagaacaagacattgtctttgcttgtataattgaccatttctagactgattaatcattgtagtcagaggggatgaggtactcttatttggctaagactgcatcacatgtccttacccctttgagctttaccaaagccatacagaatggcgctgaaggtaattccccaaagggaaagagggaagggatgctgggcaggtagatgctgggtaagtgctatcactaccctattttac

SEQ ID NO: 21725 - DNA, 219 bp, Homo sapiens
  misc_feature 25, 49, 172: n = A,T,C or G
agaataaggagcctttcttatggcngaaatgggagaagagagacagggntcttttcagcagagtctagtagtttctctgtaaggcaaaataatctaaaaagactaacctgcccacccactccttatattgctgtgagattgcccctatcttgtgctcttctgtctgcagtgngcgcgggccttgttctaacccggaataaaggtgattgattgtattgc

SEQ ID NO: 21726 - DNA, 400 bp, Homo sapiens
  misc_feature 19: n = A,T,C or G
ttcccacctaattgaaagnatcacggataccagcttgctgattttttaattgtagtaaaatatatataatgtaacttttaccatttttaccatttttaagcatacagttctttggctagcttgctgatttttagatttttaaaaattttctgttgcttcaatataatatgtggtatcaaacaccagttattgcaccaataatgacatatgtgctatgaaatttaaaatgtgctctcagactgaaagaatcttaaaatccatttggggaacagttttatacatctaataatttgatagaacagatgagagtttgacagtatggttctctgaaagttcagtagttcagagaaaagaaaaatccttgggaactttagtagttacaagaggaagtggagcttag

SEQ ID NO: 21727 - DNA, 389 bp, Homo sapiens
  misc_feature 4, 29, 54, 55: n = A,T,C or G
cagnccagtttaaatgtctttctgttagntctttctttcttacaatgaagaganncattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttggaactaaatttttttttt

SEQ ID NO: 21728 - DNA, 307 bp, Homo sapiens
  misc_feature 25: n = A,T,C or G
gacactggatcgcaaagtgcccacntccggaggcgtttctgggcaaaccctggtcctcctggatcgacgccgccaaattacactgctccgacaatgtagatttagaagaggctggaaaagagggtggaaaaagcagggaggttatgaggcttaataaagaagcatggaaatacggtacctgaaatgggacacactgagtagataggtcatcccagaccaagatatgcaagagaagccacaacctgctgcaattgggcatcaaacacatatggtcgtcataaataaatcatatcctgttctcatttac

SEQ ID NO: 21729 - DNA, 262 bp, Homo sapiens
  misc_feature 1, 2: n = A,T,C or G
nntttgtatcttgtaaggccacaggtttacatgtttcatgatagcatgtacctggcatgattgcagcacctgagcctgcaaacgtctttgtttaattccctgcagcaccaccttgcatgtaatcagctccatctgcaaagtatttggcaaaatcaacattcttctccttctgactttttccacattgtgcccagagccactaggagccttgtattagattgaactacatgaaatcaccatttgggggagataaaaaatagtc

SEQ ID NO: 21730 - DNA, 119 bp, Homo sapiens
  misc_feature 53: n = A,T,C or G
actatgaagagctcgcccgcatggttgcttgaatggctgaggaccttcccagnctccccagagtccgtgcctttccctgtgtgaattttgtatctagcctaaagtttccctaggctttc

SEQ ID NO: 21731 - DNA, 400 bp, Homo sapiens
  misc_feature 3, 25: n = A,T,C or G
agntgaagttggtgaagacattccngatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcact

SEQ ID NO: 21732 - DNA, 148 bp, Homo sapiens
ttactactcgttctgggcagaccttatccaaagtctggtacaactgtccttagactgatgagcaaaggaggagtcaactaatgaagaaatgaataataaattttgacactgaaaaacattttattaataaagaatattgacatgacta

SEQ ID NO: 21733 - DNA, 400 bp, Homo sapiens
  misc_feature 23, 48, 328: n = A,T,C or G
tgaagaagtaaccgggtccattntccacgcggcgccagttctccggcnggaaggaaaaccgcgcagagaggcagcaatgaatgtggatcacgaggttaacctcttagtggaggaaattcatcgtttgggttcaaaaaatgctgatggaaagttaagcgtgaaatttggggtcctcttccgtgatgataaatgtgccaacctctttgaagcattggtaggaactcttaaagctgcaaaacgaaggaagattgtaacatatccaggagagctgcttctgcaaggtgttcatgatgatgttgacattatattactgcaagattaatgtggnttacatatctttatgtactgccattttttgtttctggtaaactggaatataaagtgaaagaacaaacatttg

SEQ ID NO: 21734 - DNA, 400 bp, Homo sapiens
gctttgaacgtgctataggaccctctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatga

SEQ ID NO: 21735 - DNA, 193 bp, Homo sapiens
  misc_feature 4, 8, 32, 41, 45, 46, 49, 51, 52, 87, 159, 168, 171: n = A,T,C or G
acantgtntgcagcctcttgtattcttgagcncattagggnagannacncnnattagtagtgggattaggcattgacatatatagcntagtgtcattatcttatatagaacgttaccggtgcatagttgccagatagtgcactcacattattttggtanatagcaccnaanaaacacagtatttggtaaaggc

SEQ ID NO: 21736 - DNA, 400 bp, Homo sapiens
  misc_feature 19, 23, 71, 75: n = A,T,C or G
cttcttgactccagggccnctanctttttatggcgcggggatcccaagggacaagcatcaagcacgttttntgcngctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacaatagctaagacccaaactgggattagataccccactatgcttagccct

SEQ ID NO: 21737 - DNA, 172 bp, Homo sapiens
cccgtctctactaaaaatacaacaacaattagctggccatggtggcgtgcacctgtagtcccagctactcgggaggctgaggcaggagaattgcttgaacccgggaggcagaggcggcagcttgagattgtgccactgcactccagcctagcgacagggactccatctcaaa

SEQ ID NO: 21738 - DNA, 379 bp, Homo sapiens
  misc_feature 28, 50, 53: n = A,T,C or G
gacccattgaggcagccagcgcagggtnttctgctgggggggcaggcggngcntgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaa

SEQ ID NO: 21739 - DNA, 400 bp, Homo sapiens
  misc_feature 23: n = A,T,C or G
ctgctgagggggcaggcggagcntgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaat

SEQ ID NO: 21740 - DNA, 400 bp, Homo sapiens
  misc_feature 273: n = A,T,C or G
ttggttttggtttttgagacggagtctggctctgtggcccaggctggagtgcagtggcacgatctcggcttactgcaacctctgcctcctggcttcaagtgattgtcctgcctcagcttccgagtaactgggattacaggtgcacaccaccacaactagctaatttttgtattttcagtagagatggagtttcaccatgttggtcaggctggtctggaactcctgaccttgcgatctgcctgccttggcctcccaaagtactgggattaccgngcctggtccgttctttgttttaaaatgtttcagactcttacaagcaaaagatactcaagttagatcaaattggtgggggcagggagtgtgcagggccttaacaacaatacatcatgtatgttagtac

SEQ ID NO: 21741 - DNA, 162 bp, Homo sapiens
aagtcgtgagtttattgcatatgcaacaaaatgaacctgacctcctgggcccagcctgctgtacaatcactgtttgttttgtgtttccagctggttccataaccacattaaatagaactagtatttcattaaatacttttgattttgacatggaaaaaaaaa

SEQ ID NO: 21742 - DNA, 283 bp, Homo sapiens
  misc_feature 23: n = A,T,C or G
ttatttctaaaataagatgtgtnctagctaattagtcactattttaaaaggaatttaaatatagttttcattgaaattcaaatatttaattgcatgtgtacctaatgcctaattatttacatgttggctgatgttctctattatctaactgctgtgctgttcttaattgctgctagttcatctccgcccatctcccttggtgatgatagtcctgcatttcatggcaattttcaatagcagtttaatggtcttaagtgggtagcataatagccaggtgaacaac

SEQ ID NO: 21743 - DNA, 364 bp, Homo sapiens
  misc_feature 25: n = A,T,C or G
tagcaaactgatttatatgtgcacntataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttgtttgtaaaaggatgccaatgttttacctgatatcttagtgacacttcagttatctatgcattctttagatctgtgattcggtaaacaggcagccatgttcacgatgccttctatgtcttaccatatttttaattaacctgttaaatacagcttaaaatatc

SEQ ID NO: 21744 - DNA, 399 bp, Homo sapiens
  misc_feature 17, 26: n = A,T,C or G
tttgaggaagacgcggncgttttttnctgaggatttttggtccgcacgctcctgctcctgactcaccgccgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacag

SEQ ID NO: 21745 - DNA, 239 bp, Homo sapiens
  misc_feature 23: n = A,T,C or G
ctaacatgtctctgttgagaaanctatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaaaaaag

SEQ ID NO: 21746 - DNA, 400 bp, Homo sapiens
  misc_feature 25: n = A,T,C or G
cttcctcttcctggaggagttcccntgggctgctgcgggccctgcaaggagaactattgtcttatgatcacgtttgccatctttctgtctcttatcatgttggaggaggtggccgcagccattgctggctatgtgtttagagataaggtgatgtcaagagtttaataacaacttctggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgggggattaatttcaacgagaaggcgatccataaggagggctgtgtggagaag

SEQ ID NO: 21747 - DNA, 400 bp, Homo sapiens
  misc_feature 16, 19, 60, 64, 65: n = A,T,C or G
cttctttggacccagngcncctcttttcttatggcgcggggacccaatcaagtccacagnaagnnggtttttgtgctttcactctgaacctaaccttatgccaattcatttggcaattaagtgaaatgaacacattccttgaaagagataaactatcaagattcactcagaaagaaatagattatctgattaatcctatatctgttaaataaattgaatttatagttaaaaaaaaatctttcacaaatgaaatgccagacccagattatcttgggtgaattctaccaaacatttaagacaaaaagtcaccaattttatgcagtatcatccagaaattgaaaaggatacaacagtttctatcttactttatgaggctgacatttttctgatatcaaaatca

SEQ ID NO: 21748 - DNA, 400 bp, Homo sapiens
tctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttggattaaaatgaaggtgacttaaacagcttaaagtttagtttaaaagttgtaggtgattaaaa

SEQ ID NO: 21749 - DNA, 324 bp, Homo sapiens
cactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctctgcataagcctgcgtcagattaaaacactgaactgacaattaacagcccaatatctatcaaccaacaagtcattattacccccactgtcaacccaacacaggcatgctcataagg

SEQ ID NO: 21750 - DNA, 100 bp, Homo sapiens
  misc_feature 22, 29, 41, 46, 47, 60, 66, 84, 85, 90, 93, 97, 98: n = A,T,C or G
tacaagcaccctgagactgacntgccggncgaagccatgangagcnngatctcttcttgncatacnggccgccttagcaggacnnaactntgngatnnga

SEQ ID NO: 21751 - DNA, 400 bp, Homo sapiens
  misc_feature 22, 48: n = A,T,C or G
attggtggaaatgcctccgctntttgccccgagggcgaaggtaccgancgcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttgga

SEQ ID NO: 21752 - DNA, 349 bp, Homo sapiens
aaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagatt

SEQ ID NO: 21753 - DNA, 400 bp, Homo sapiens
  misc_feature 4, 13, 30, 35, 58, 64, 71, 76: n = A,T,C or G
tggngggggaccngattctaagtatttggnttggntttaataggaaagcatatgcagnccaccnagatgcnaatgntttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttact

SEQ ID NO: 21754 - DNA, 324 bp, Homo sapiens
gattttctcttcagtagatatatgagtaaacatgatgagttaatgttacacagcatacccagttaggtctcttattcttaaagcatctttctttagaagtctgcacatattttcaaatgcatcatattaaaggcacaagtcaagaggaggtggagttgcctacttcagtggcctttattcccactataccagttctcagtcttgattttgatactttctggcaactgtatcatctcttcactatcaagtattttaagaaaaagctaaggtgatttctttacatttgaacatgtgtagatcaatgagagaatggtgagggatagc

SEQ ID NO: 21755 - DNA, 294 bp, Homo sapiens
attatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtg

SEQ ID NO: 21756 - DNA, 335 bp, Homo sapiens
  misc_feature 204: n = A,T,C or G
tatggtgacatgtgcctgtagtcccaactgctcaggagtctgaggtgggaggatagtgtgagtccaggaggtggaggttacagtaagctgagatggcgccactgcactccagcctgggcgacagagtgagaccctgtctcaaaacaaaacaaaacaaaaaaagtttagagaaataaatggagagagagattgtgtatgggtcangaagactcaatattgtaaagtttttgggtctcccccatatttatccatagattcagtgcaattccaataaaatcccagcaggcattgttgaagaaaatgacaagcttattttcaaattcacgtagaaatgc

SEQ ID NO: 21757 - DNA, 341 bp, Homo sapiens
  misc_feature 46: n = A,T,C or G
ggtccttcccttgatacatgggaattatagggattataattccagnatgagatttgggtggggacatagagccaaaccatattaacaaggaatgttctgaaagaaaggaaaattgtaaggtggtggaatgtttagttatccaaatcaaagcagagtctacttgtaggcactttatttttagaaaataatcacttcttatttattatcagcaggtttctaccataattcgcaaatggcaaacacttcagaagtttataataaaaaaagtgactttttagactagcttaatgagtagtctagcctttctcttgtaaatgtcaaacttacataattgagttttg

SEQ ID NO: 21758 - DNA, 306 bp, Homo sapiens
  misc_feature 11, 21: n = A,T,C or G
ggagctacagnatagtaaagnatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtg

SEQ ID NO: 21759 - DNA, 371 bp, Homo sapiens
gttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatatttt

SEQ ID NO: 21760 - DNA, 344 bp, Homo sapiens
  misc_feature 82, 124, 216, 268, 305, 339: n = A,T,C or G
ggtaactttttaatgctctggattcctagatttaataataagaggaggacaggtgtttgaaaaaaaaaggctaccttgctgnttttcctcaacagccctttggcttgctaattttgtatattgntacctttttttccccgtctataacttttctttatccttcttcactgatagatgttcattcatgaaactgatagttcttaaatgtattggggnaaataactttacttctggctcacatttgaagaagtatcattccttcactggnaggaattagtaacagttttggcttttgttaagcttgngcttaagggaaagggtttaagatgttcctatggnttggc

SEQ ID NO: 21761 - DNA, 369 bp, Homo sapiens
  misc_feature 11: n = A,T,C or G
gggggaaaagnaatatttccgggaagttaggaggcctggttgagtcttggatcttcagtgactgatgctgtgaccatgagatactcactcacccctggtgggtctcagtttcctcatccataacatgaggagagggacacagtgctctctccggccccccagctgtcaggtctctaaatctattactgcgccaccgtgaggagatggctgtcacgtgagttctgcacggtattggcatgttcccttatacgagggtggctttacacatttgagcatggcaaagtttaagtggcccctctttcaaccaaaaatgaaaacttttcatacatgatttttagcagaatgtatacaaacgaccatcaaaatgga

SEQ ID NO: 21762 - DNA, 369 bp, Homo sapiens
  misc_feature 10: n = A,T,C or G
ggagctaagnaaaagaaaaattgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttt

SEQ ID NO: 21763 - DNA, 349 bp, Homo sapiens
  misc_feature 60, 294: n = A,T,C or G
ttacaacgaactggctgatagtggaatacctggaaattctttcaatgtgtcatccctggntgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagncactcttaattaatatctgtatcctggaacaatattttatggttatgtttttctg

SEQ ID NO: 21764 - DNA, 370 bp, Homo sapiens
gaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcagtgctacaaatgggaagtcagagaccatcacagctgatgtcaatc

SEQ ID NO: 21765 - DNA, 371 bp, Homo sapiens
  misc_feature 6: n = A,T,C or G
gaggcnttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcacggagtaaaaaatgtatttaaaagaaaattgagagaaaggactacagagccccgaattaataccaatagaagggcaatgcttttagatt

SEQ ID NO: 21766 - DNA, 386 bp, Homo sapiens
  misc_feature 3, 19, 67, 92, 100, 110, 168, 242, 287: n = A,T,C or G
acnaaccgtttcttaaacnattaggtctacatcctaactggcaattcgttgatgtatatggaatggntcctgaactccttagcatggtaccnagaccagnctgtgcagtnttacttctctttcctattacagaaaagtatgaagtattcagaacagaatgaggaaganaaaataaaatctcagggacaatgatgttacatcatcagtatattttcatgaagcaaacaatcagcaatgcctgnggaacaagttggactgattcatgctattgcaaacaataaagacangatgcactttgaatctggatcaaccttgaaaaaattcctggaggaatctgtgtcaatgagcccctgaagaacgagccagatacctggagaactatgatg

SEQ ID NO: 21767 - DNA, 220 bp, Homo sapiens
  misc_feature 12, 17, 32: n = A,T,C or G
tcccggggtaanctcgnttttatggccggcgnagctggcaaggtcaccaagtctgcccagtaaagctcagaaggctaaatgaatattatccctaatacctgccaccccactcttaatcagtggtggaagaacggtctcagaactgtttgtttcaattggccatttaagtttagtagtaaaagactggttaatgataacaatgcataaatgagaaaaaaaa

SEQ ID NO: 21768 - DNA, 370 bp, Homo sapiens
  misc_feature 1, 2, 13, 287: n = A,T,C or G
nnacacgaatagnacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttacctctcttgcaccaaattatcttgatacattcaaatttgtctggttaaaaaataggtggtagatattgaggtcaagaatattgcaaaatacatgaagcttcatgcacttaaagnaagtatttttagaataagaatttgcatacttacctagtgaaacttttctagaattatttttcactctaagtcatgtacgtttc

SEQ ID NO: 21769 - DNA, 161 bp, Homo sapiens
  misc_feature 4, 16, 25, 27, 38, 59, 73, 91, 96, 119, 133, 149, 159: n = A,T,C or G
gggnagatttataggnagaggcgananacctaccgagnctggggatagctgggtgtccnagatagaatcttanttcaactttaagatttgnccacngaaccctctaaatccccttgtgnattgaactgctagnccaaaggggaacacgntctttggacnct

SEQ ID NO: 21770 - DNA, 267 bp, Homo sapiens
gaccatcattccccctaaataaattaaaaaaactattaaacccatataacctcccccaaaattcagaataataacacacccgaccacaccgctaacaatcaatactaaacccccataaataggagaaggcttagaagaaaaccccacaaaccccattactaaacccacactcaacagaaacaaagcatacatcattattctcgcacggactacaaccacgaccaatgatatgaaaaaccatcgttgtatttcaactacaagaacagc

SEQ ID NO: 21771 - DNA, 330 bp, Homo sapiens
  misc_feature 11: n = A,T,C or G
gccaacagaanctgtggttggtgtggtggctggaggtggccgaattgacaaacccatcttgaaggctggccgggcgtaccacaaatataaggcaaagaggaactgctggccacgagtacagggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgcct

SEQ ID NO: 21772 - DNA, 385 bp, Homo sapiens
  misc_feature 2, 49: n = A,T,C or G
cnttatggccgggggtaggagcctctctccctactgctgctacacaagnaccctgagtactgacctgcaggacgaaaccatgaagagcctgatccttcttgccatcctggccgccttagcggtagtaactttgtgttatgaatcacatgaaagcatggaatcttatgaacttaatcccttcattaacaggagaaatgtaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggacc

SEQ ID NO: 21773 - DNA, 376 bp, Homo sapiens
ggtaggagcctctctccctactgctgctacacaagaccctgagtactgacctgcaggacgaaaccatgaagagcctgatccttcttgccatcctggccgccttagcggtagtaactttgtgttatgaatcacatgaaagcatggaatcttatgaacttaatcccttcattaacaggagaaatgtaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatg

SEQ ID NO: 21774 - DNA, 116 bp, Homo sapiens
  misc_feature 7, 22, 28, 31, 33, 41, 46, 58, 62, 78: n = A,T,C or G
ctggggnatagaaaggcccggngccagnatngnaatcttantgcancctttaagattntggnccacggtaacgcctcntaaattcccctgtgtgggattgtaactgctagcgccaa

SEQ ID NO: 21775 - DNA, 120 bp, Homo sapiens
  misc_feature 4, 5, 35, 73: n = A,T,C or G
aaanncagaataataacacacccgaccacaccgcnaacaatcaatactaaacccccataaataggagaaggcntagaagaaaaccccacaaaccccattactaaacccacactcaacaga

SEQ ID NO: 21776 - DNA, 304 bp, Homo sapiens
  misc_feature 19, 153, 177, 251, 292: n = A,T,C or G
tggaggtggccgaataganaaacccatgcttgaaggctggccgggcgtaccacaaatataaggcaaagaggaactgctggccacgagtacagggtgtggccatgaatcctgtggagcatccttttggaggtggcaaccaccagcacatttggnaagccctccaccatccgcagagangcccctgctggccgcaaagtgggtctcattgctgcccgccggactggacgtctccggggaaccaagactgtgcnggagaaagagaactagtgctgagggcctcaataaagtttgngtttatgcctaa

SEQ ID NO: 21777 - DNA, 399 bp, Homo sapiens
  misc_feature 25, 47, 176, 287: n = A,T,C or G
aggaccctgagtactgacctgcagnccgaaaccatgaagagcctganccttcttgccatcctggccgccttagcggtagtaactttgtgttatgaatcacatgaaagcatggaatcttatgaacttaatcccttcattaacaggagaaatgtaaataccttcatatcccctcagcngagatggagagctaaagtccaagagaggatccgagaacgctctaagcctgtccacgagctcaatagggaagcctgtgatgactacagactttgcgaacgctacgccatggnttatggatacaatgctgcctataatcgctacttcaggaagcgccgagggaccaaatgagactgagggaagaaaaaaaatctctttttttctggaggctggcacctgattttg

SEQ ID NO: 21778 - DNA, 386 bp, Homo sapiens
  misc_feature 19, 22: n = A,T,C or G
ctgtaactactatttaggntgnccgattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtca

SEQ ID NO: 21779 - DNA, 114 bp, Homo sapiens
  misc_feature 49, 83, 89: n = A,T,C or G
atatactaggtgctatgaaaataccatggaataatagggattttagggnggatacctttattttcttttatgtttctatatgngtgcgntgggatgacattatcttttaaatta

SEQ ID NO: 21780 - DNA, 400 bp, Homo sapiens
  misc_feature 13, 17, 172, 173, 318, 358, 374: n = A,T,C or G
tttaagacttgtngggngacctaacatatgatctaatctcgagaatgtttagatcattcatgctataatgatcagatcctctacatgctgaggaaaagaaagtgtattctgcaaccattgaatgaaatgttctctaaatatctattaggatcatttggtctgtagtaaagannaagtctgacgtttctttattgattttctgtctggaagatctgtccaatgatgaaagtggggtgttgaagtatccagctgctattttttttctctctcttttttttgagacagagtcttgctctgtcacccaggggggagtgcagngggcatgatctcagtacactgcaacctctgcctcccgggnttaaagcgattctcgngcctcaacctcccgagtagctgggat

SEQ ID NO: 21781 - DNA, 100 bp, Homo sapiens
  misc_feature 6, 19, 29, 36, 40, 43, 46, 56, 59, 79, 81, 85: n = A,T,C or G
cccccntagaaaacagttngggggtttancaaaaanctgnaantgnaattatcatntgncctagcagccccctgctggntncatnttcagaaaaaaggaa

SEQ ID NO: 21782 - DNA, 123 bp, Homo sapiens
  misc_feature 2, 7: n = A,T,C or G
anatccnaattttagatacctgcatttttaaatgattgtatttattacgtatgaattttagaaaaaatattaaaagaggggaaccaaaaaaagttatatcttgcttttttttcttggcctttc

SEQ ID NO: 21783 - DNA, 316 bp, Homo sapiens
  misc_feature 26, 27: n = A,T,C or G
aaatagaaatagataaatatcaaacnngcacagaataaataagcaaatacataagcaaaataaataaatatcaaataagcataagactgctatcaaatagaataaatatcaaataagcataaataagtaaataaatatcaaataagcataagactgctatcaaataaatatcaaataagcataaataaataagccaaataaatatcaaatatgcgtaagactgctatcaaataaattagaactgactgctatcaaataagcataagactgctataaataaaatagataaatatcaaacaagcacaaataaataagc

SEQ ID NO: 21784 - DNA, 352 bp, Homo sapiens
  misc_feature 2, 5, 331: n = A,T,C or G
gntcnggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggngacttaaacagcttaaagttt

SEQ ID NO: 21785 - DNA, 400 bp, Homo sapiens
  misc_feature 17, 68, 90, 93: n = A,T,C or G
acttctttggacccagngcccttcccttttatggcgcgggaaacacaccatttaatatgccccgtatntttcttcagtgttcttcagggnagncgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgat

SEQ ID NO: 21786 - DNA, 400 bp, Homo sapiens
  misc_feature 25, 175: n = A,T,C or G
aataaacatgcagtctcagtgtgcnctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgntgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccgg

SEQ ID NO: 21787 - DNA, 365 bp, Homo sapiens
  misc_feature 29: n = A,T,C or G
atgcccgtagaagactaaaatactaagtnttttaacctccatagagcatgtggtcacccgctcaagagaaaaaagacctgccaatctctcagtcagtgaccctggatactcatgttccaaaaacagtaaaataagaggtggattgaatcttaaaacagtaactcagtcctgacccaactcagtctctgactggatcaaagggaccaccccctcgccctggttgtctaagagaaaatgggaaatacttgtagtagaaaatattgtttggagctgctacaatttgtttatccacagtgtccaacataaaataaaaaaaattagacattcaaagaggctggaaaaggtggctaaaaattaagagaata

SEQ ID NO: 21788 - DNA, 398 bp, Homo sapiens
  misc_feature 22: n = A,T,C or G
ttggtgtggctgttttctaacncgtcatcaattaatattaaaactgtcattcttccatcttcacttttcagttagttttgctgagaggtattcatataatctgttaagacatcctaggacaggccgggcccagtggctcacgcctgtgaccccaacactctgggaggccgaggcaggtgcatcatctgaggtcgggagtttgagaccagcctgaccaacatggagaaaccccatctctactaaaaatacaagaattagctgggcgcagtggcacatgcctgtaatcccagctactcggtaggctgaggcaggagaatcgctggaacctgggaggcggaggttgcaagtgacccgagatcacgccattgcactccagcctgggcaacaggagcgaaact

SEQ ID NO: 21789 - DNA, 400 bp, Homo sapiens
  misc_feature 21, 26, 46: n = A,T,C or G
actcggtggtggccactgcgnttttncagacttcgctcgtactcgngcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagaagcaaagaggttggatcaagtttaaatgactgtgctgcccctttcacatcaaagaactactgacaacgaaggccgcgcctgcctttcccatctgtctatctatc

SEQ ID NO: 21790 - DNA, 370 bp, Homo sapiens
  misc_feature 10, 105: n = A,T,C or G
gattaaaganacaacccagggcaacacattgagactacaaaaatatgaataatgctcaattatattcatcacactttttttcataccatttcaagaaacgactanacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatg

SEQ ID NO: 21791 - DNA, 400 bp, Homo sapiens
  misc_feature 37, 43, 224: n = A,T,C or G
attgatggtgcggcaatttcaatcagaccaaattagntcagtngccttatctcagttatgagtataatacattagcatgtaaaattaagtgtgtgtacacctgtaatcgtgctattttttatcattgaaacatttataaactagaataataatgcccttaatgtgagggtttgtaatggtgcttatgaagaccaaagacttgttaaatgtatacaccaagtggnaatgaaatttctgtgactggcccacacgtgcatagaggtctgggaggaccaggaaacagcctcagtggccaggaggatcaccagtgcatccttcatcacagcatgtgcaatatgccaagattaccctcggtcattcctgtcaacaaggggtcaatgtcataaatgtcacaataaaa

SEQ ID NO: 21792 - DNA, 388 bp, Homo sapiens
  misc_feature 8, 14: n = A,T,C or G
ctgacagnacaacnctcaccaaccagctcattgagaacgtgtccatatacaggatctcctattgcacagcagacaagatgcacgacaaggtgtttgcatacatcgcccagagccagcacaaccagagcctcgagtgcctcgccttcctctgcaccaagcggaagatgagatcctgactaatacgccaaggcccagggctgcatgcccaggactcaggaagagtctcgaagaatcctctgcacacaagaacactgctatccgccgaagctgatgtcagctattccctgcagactggcctggtccagcagagccagctctgctaaactaccacaggcaggaaggaaaatgagccaccaggggcctccacactttgtctctcataaaagat

SEQ ID NO: 21793 - DNA, 400 bp, Homo sapiens
atctatggtccggggtttggcatttactccatatgatgagtagggcggcaggattcctgtgattcccattttgcagatcaagaaactgaggcttagaaatggaggaggacctaaggtcatgatgccagccagtagcaacaatcacttgatttaatccaggcttctttgcattgcacactgctttgcttactttaataggacatgaagagttcggttttagaaattttatacagggccaggtgaagtggctcatacttgtaatcccagcagttgggaggcctaggtgggaggattgctcgagcccaggagttggaggctacagtgagctatgatcatgccactgcactccagcctgggtgacagagcaacacccgtgtctctaaaaaaaaaaaaaaaaaaa

SEQ ID NO: 21794 - DNA, 241 bp, Homo sapiens
ggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccatggcctccatgactttttcaaa

SEQ ID NO: 21795 - DNA, 386 bp, Homo sapiens
  misc_feature 5: n = A,T,C or G
gcatnccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagt

SEQ ID NO: 21796 - DNA, 375 bp, Homo sapiens
tgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacgagatgaaataatagataaaagctatactccatctaaaataagacatgcctgaaatttggcaagaaggggcaaaaacgtgactattaatgattgataagcaccagtggaagaagttctaacttttagcatgctgcacagaaactggtataacatgccttcagtatactaacactc

SEQ ID NO: 21797 - DNA, 376 bp, Homo sapiens
  misc_feature 238: n = A,T,C or G
gaggtgagcctccagagttttcattcttcacaaatatatgtacctattgtgtgctgggcactgcttaagttgcgaggggatattgcgaagaaagtaagcaaaacccctttgtttgtagaatttcagtgagcatagtcctgggttaacctgacaacagtcctactgtttattgatgcttataggtgagcctatttctctttctagctttcttccacttaatttactttcttttggaatntcttgaatttaataataataatattgatgttattagtcatcactataactttttattgagtatgtattttatgtcagacacagtgtggctaagtgctttacatacattatctcatctaatccttagaaaaaaccctgg

SEQ ID NO: 21798 - DNA, 294 bp, Homo sapiens
  misc_feature 290, 293: n = A,T,C or G
gccaacagcgtggctccaggaaggaagcctgactgctgcagaacaagaaatgcattatgactttatcttttttctaaaccattagctgaaattactaaattattaacccagccatataaatgaattataaacatagcatatgtgcatttgattaatctgtttttcatgtcaagtgttatacagacctggggtacaaactcatggggatacttaagtaacacacagatgaagtataaagggtgtaaaccaagggagaggcaggaagtgtggcaaagtggtgattgccaaancanc

SEQ ID NO: 21799 - DNA, 112 bp, Homo sapiens
  misc_feature 3, 12, 49, 72: n = A,T,C or G
ttncttaaatanttaaaacatgtaatgtatttctgatgaatatagacantaaaattccactgctataattcnaatatatccccctttgcgggctactataatgcatgaggga

SEQ ID NO: 21800 - DNA, 181 bp, Homo sapiens
  misc_feature 18, 131, 167, 181: n = A,T,C or G
gcctacttgacccacaanttcaacataattctcatcaatatcctagcaggttacattgcatatatggaaatattgattctaaattttatatgtaaagggaaaagacccacaatagtcaacatgacatagangaaaaaaaaaaaaaaaaaaaaaaaaatttttttttngggccccccccccn

SEQ ID NO: 21801 - DNA, 100 bp, Homo sapiens
  misc_feature 14, 15, 32, 37, 42, 45, 58, 59, 61, 71, 78, 82, 85: n = A,T,C or G
ctccctttattatnntattacgatgcgcaagntgaanggcgngantttgtcgagtgcnngntcgaaaactnaggtgtnacanccngtgcgcctgctcatc

SEQ ID NO: 21802 - DNA, 313 bp, Homo sapiens
  misc_feature 6, 19, 164, 174, 217, 237, 248: n = A,T,C or G
atgggnacaggcctcaagnagaaaaaagacctgccaatctctcagtcagtgaccctggatactcatgttccaaaaacagtaaaataagaggtggattgaatcttaaaacagtaactcaggcctgacccaactcagtctctgactggatcaaagggaccaccccngcgccctggntgtctaagagaaaatgggaaatacttgtagtagaaaatattgnttggagctgctacaatttgnttatccacagnggccaacataaaataaaaaaaattagacattcaaagaggctggaaaagggggctaaaaattaaga

SEQ ID NO: 21803 - DNA, 377 bp, Homo sapiens
attgtaggataaagcagccctaaagattgtttggtgtggctgttttctaacaagtcatcaattaatattaaaactgtcattcttccatcttcacttttcagttagttttgctgagaggtattcatataatctgttaagacatcctaggacaggccgggcccagtggctcacgcctgtgaccccaacactctgggaggccgaggcaggtgcatcatctgaggtcgggagtttgagaccagcctgaccaacatggagaaaccccatctctactaaaaatacaagaattagctgggcgcagtggcacatgcctgtaatcccagctactcggtaggctgaggcaggagaatcgctggaacctgggaggcggaggttgcagt

SEQ ID NO: 21804 - DNA, 367 bp, Homo sapiens
ggacaactcggtggtggccactgcgcagaaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagaagcaaagaggttggatcaagtttaaatgactgtgctgcccctttcacatcaaagaactactgacaa

SEQ ID NO: 21805 - DNA, 378 bp, Homo sapiens
gcttttttgaggaagacgcggtcgtaagggctgaggatttttggtccgcacgctcctgctcctgactcaccgccgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggggaaggttctaagacgtgggatcgtttccagatgagaattc

SEQ ID NO: 21806 - DNA, 383 bp, Homo sapiens
  misc_feature 8, 22: n = A,T,C or G
gatgaatnaagtcccagaaganggtttagtgctttcactctgaacctaactttatgccaattcatttggcaattaagtgaaatgaacacattccttgaaagagataaactatcaagattcactcagaaagaaatagattatctgattaatcctatatctgttaaataaattgaatttatagttaaaaaaaaatctttcacaaatgaaatgccagacccagattatcttgggtgaattctaccaaacatttaagacaaaaagtcaccaattttatgcagtatcatccagaaattgaaaaggatacaacagtttctatcttactttatgaggctgacatttttctgatatcaaaatcagtcaaagaaagtagaagaaaacaaaca

SEQ ID NO: 21807 - DNA, 256 bp, Homo sapiens
  misc_feature 5, 48: n = A,T,C or G
taaanttcaatactataacattgatgtgcctagtagaacagcaagagnaattactactcgtctgggcagaccttatccaaagtctggtacaactgtccttagactgatgagcaaaggaggagcaactaatgaagaaatgaataataaattttgacactgaaaaacattttattaataaagaatattgacatgagtataccagtttatatataaaaatgtttttaaacttgacaatcattacactaaaacagatttg

SEQ ID NO: 21808 - DNA, 172 bp, Homo sapiens
  misc_feature 15, 18, 28, 34, 52, 67, 100: n = A,T,C or G
aagagatatacctcngcngaggcgcagngggctnacacctgtgaatcccagnacttagggaggccanggcgggcaagatcacttgaagttgggaagtcgngaccagcctgaccgacaagttgaaaccccatctctactaaaaatagaaaattggctgggcgtggtgcgcatg

SEQ ID NO: 21809 - DNA, 400 bp, Homo sapiens
  misc_feature 2, 80, 95, 188, 356: n = A,T,C or G
tntattaccaaaaaagccaggttagccatttgcttataataaattttgccttcttttaggaatttttaagagtcagtttnatgggactcctgagntgacagctgtgcagtctgaattgcttagactctggaaatgcttcagatttaaaatactaccaaccaacatggagtactgatcttcccacttgntgcaaagaggctagttaggaaaactagggcaggctgtctcttgcaattcaaaactgaacataaactgaaattgagagaaagcatattaaatcctcatgtctgccatgtttgcagaggtcagctatacaaatatgaatggtaatttgaacttcaagaaaaggacactgntaaaatataatcatcttgaaaatgaagatgcctctctacttgtt

SEQ ID NO: 21810 - DNA, 399 bp, Homo sapiens
  misc_feature 25, 44, 81, 349, 381: n = A,T,C or G
aaataaataaaagctagatactggnaacctaactgcaatgtggnttttttacccacatgacttattatgcataaagccaantttccagtttaagtaattgcctacaataaaaagaaattttgcctgcattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagtagctcatttgagataaagcaaatgccaaacactagctctgnattaatccccatcattactggtaaagcctcanttggatgtgtgaatcaat

SEQ ID NO: 21811 - DNA, 200 bp, Homo sapiens
  misc_feature 2, 60, 82: n = A,T,C or G
tnggattgagacacattgtatagtcttagaagaaattaaatgcttattttacctgaaaanattcttgaaatttcagaaaatntgttctatgtagagaatcccaacttttaaaaacaataattcaatggataaatctgtctttgaaatataacattatgctgcctggatgatatgcatattaaaacatatttggaaaactg

SEQ ID NO: 21812 - DNA, 395 bp, Homo sapiens
  misc_feature 54, 311, 359, 368, 394: n = A,T,C or G
gaattgcccggatctggattcattcctcctcatttcctggagtgactgtgatcnttttgactacaggattgagctctgagtatcagattgacacaacatatgtgccatggccattaatgttacacaaccatactagtatccttcttctgaagagcaacagctcctgctccttggaggtggtgggaactgcttttcctttggtacctacttcaacccccatacagcacattagacctttcttcttaaggctgggcagtaaggactggctaatattcaggacccactaaagtagacaataaagttttccacanataggatgaccctctagctatagatactgcactcctcctttccccatnctttttttnccttagcactattcagtgcaaaaagng

SEQ ID NO: 21813 - DNA, 216 bp, Homo sapiens
  misc_feature 11, 20: n = A,T,C or G
tcccagatggnccatgacantagaatataaacagagcagtgaccgctcatccccacatgtagggagtggcctggactttctacgatgtggacaagaggactgtggggtggagacacattcaaaatgtctttccaaaaggagatactccaacactcatacaaactccttcaggcattccaacaggcattcccatttataatggaagccaagcttttt

SEQ ID NO: 21814 - DNA, 282 bp, Homo sapiens
  misc_feature 44, 244: n = A,T,C or G
tgatggcccggcgactccgcaagttcatactatttgatataagnacaccttcgggggaaataattcctgtgaatattctttttcaattcagcaaacatttgaaaatctatgatgtgcaagtctaattgttgatttcagcacaagattttctaaatcagttgctacaaaaactgattggtttttgtcacttcatctcttcactaatggagatagctttacactttctgctttaatagatttaagnggccccaaatatttactaaaattgctagtttaccgttc

SEQ ID NO: 21815 - DNA, 399 bp, Homo sapiens
ttatggccgggaaatataaaacagtacccaggatgaagaaaagtaaacagctaactgcactccgagacttaataaaatcctctcttcaactggatcagaaagaagattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctgaccatctcacatgccacatctaacaggcaaccagccaagttgaaccttctcacctgccaagtaaaacctaatgccgaagacaaaaaatcttttgacctgatatcacataatagaacatatcactttcaggcagaagatgagc

SEQ ID NO: 21816 - DNA, 400 bp, Homo sapiens
  misc_feature 19, 20: n = A,T,C or G
tgaccccgggaattcggtnnttatggccggggtatatagtgaggttatatgattgaatgctttttgaacaatggttttagtaaaacaaatactttattattgttcacataaacatttcttactaagcaataatgtactatgttgtgtgaatttctattgttaaaaaaaatgaaatgttgatttagttttaattcttaggcataactaacttttctcaaataaagtgtgaaagaaagtatttttaaaatttcatctcttaaccagatgttttaagaatatatccctaggccgggtgcagtggctcacacctgtaatcccagcactttgggaggccgaggtggggggaccacctgaggttgggagttcgagactagcctgaccaatatggagaaaccccatt

SEQ ID NO: 21817 - DNA, 385 bp, Homo sapiens
ttatggccgggggttgaccgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttattttttttacc

SEQ ID NO: 21818 - DNA, 272 bp, Homo sapiens
cttatggccgggcagcaaaataactacaatggagagatctggaagatcaccttaaacaagtgatcaaacttagcattatgagccacctgcaatcacgaggcaggaaggatatatcacctatgcagtatttttcccaaaaatgcttaccttgaatctcatcatgtggaaacagacaaatccagattatgggacaatttacaaaacaactatctctgactcttaaaaaatgccatgtcatgaaagatcaaaaaaagtagaggaatgttttagat

SEQ ID NO: 21819 - DNA, 325 bp, Homo sapiens
  misc_feature 14: n = A,T,C or G
ttatggccgggggnactgaactactttgcgcaatggggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcc

SEQ ID NO: 21820 - DNA, 302 bp, Homo sapiens
  misc_feature 2, 9: n = A,T,C or G
antcggccnttatggccgggtaagcaatgggctgcttctccccaatacctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgac

SEQ ID NO: 21821 - DNA, 381 bp, Homo sapiens
  misc_feature 20, 35, 37, 327: n = A,T,C or G
ttatggccgggcatcatagnacttcatactggagnanaaaccttacaagtgtaataaatgtggtaaggtttttaatcaacaagcacaccttgcatgtcatcatagaattcatactggagagaaaccttacaagtgtaatgagtgtggcaaaaccttccgtcacaattcagtccttgtaattcataagacaattcatactggagagaaaccttacaagtgtaatgaatgtggcaaggtttttaatcgaaaagcaaaacttgcacgtcatcatagaattcatactggaaagaaacattagaaatatgaagaatgtgacaaagtttacangttgtaaatcaagtcttgaaagacaggagaattcatactggagagaaagcttac

SEQ ID NO: 21822 - DNA, 162 bp, Homo sapiens
  misc_feature 47: n = A,T,C or G
tatggccgggcatggtggtggatgcctataatcccaaccactcaggnaggctgaggcaggagactcgctagaacctggaaggcggaggttgcagtgagccaagatcgcaccactgcactccagcatgggcaacagagtgagatttcacctcaaaaaaaaaaa

SEQ ID NO: 21823 - DNA, 399 bp, Homo sapiens
ttatggccgggggtgattgggtagtaagcaatttaacaactatatattttactggatgacaataatttatttaactagtccctgttgggttgtttttctagttttctgctgttataaataatgcttcaggctgggcgtggtggcacacgcctataatcccagcactttgggagactgaggtgggcagatcacttgaggccaggagtttgagaccagcctggccaacatggtgaaaccccgtctctactaaaaatacaaaaattagccaggcgtcatggcgtacacttgtaatcccagctactcaggaggctgagcagagaatcgcttgaacctgggaggcggaggcttgcagtgagccaagactgtgccactgcctggatgaaagagcgagactccctc

SEQ ID NO: 21824 - DNA, 140 bp, Homo sapiens
cttatggccggggatcagaatcttaagtgctactgaaggacagtcctgatcctgccctcaaaacatctggtgacccgggaggcagagcttgcagtgagccgagatcccgccactgcactccagcctgggcgacagagcga

SEQ ID NO: 21825 - DNA, 303 bp, Homo sapiens
  misc_feature 15, 27, 32, 155, 170, 214, 219, 290, 293, 302: n = A,T,C or G
cttatggccgggcanactattccctgnttgcngaagacatgattcctatatctagtaaaaccccatcatcccagcgccaaacatttcttaagctgataaacaacttcagcaaactctcaggataaaaaatcaatgtgtaaaagtcactagcattnctatagaccaacaanagttaagccaagagccaaatcaggaatgaactttcattcacaantgccncgaaatgaataaaatacctaggaatacagctaactagggaggtgaaagatctctacgaaaaaaaaaaaaanctncgtcccttng

SEQ ID NO: 21826 - DNA, 368 bp, Homo sapiens
  misc_feature 12, 18: n = A,T,C or G
tggacccagggnattcgnccttatggccggggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattg

SEQ ID NO: 21827 - DNA, 400 bp, Homo sapiens
  misc_feature 5: n = A,T,C or G
tcggncttatggccggggaggaagtagagtgaaactcatcattctgtaatctctgtgaaagcttccaggttcgttcatttccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgtcattgttgaaaggacaccgcagggaccactggcagtacctatgtggaataagcatggatgctagttcactgtggagttgagatgcattttacataattatgagtttgttcatataaagaa

SEQ ID NO: 21828 - DNA, 400 bp, Homo sapiens
  misc_feature 6, 10: n = A,T,C or G
cacccngggnaattcggccttaactttttattttaaggacagtatcttttatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttc

SEQ ID NO: 21829 - DNA, 252 bp, Homo sapiens
  misc_feature 8, 14, 66, 234: n = A,T,C or G
ttgacccngggaanttcggccttatggccgggatctgtctgtgttaaaataatcaaacaaaaaatngtcctgtgttgtcagcatgattcatgtatttatatagatttgattattttaattttcctgtctctttttttttgtaaattttatgtacagatttgatttttcatagttttaactagatttccaagatattttgtgcatttgtttcaactgaattttggtggtggtagngccattatctagcaccct

SEQ ID NO: 21830 - DNA, 399 bp, Homo sapiens
  misc_feature 7, 30, 38, 57, 102, 132, 150, 266, 283: n = A,T,C or G
tcggttnttatggccgggcttccttatttncctttagnttccttccttagccgtttngagtggtgggaatcaatgctgtcttcactcaaaagtgctgcatgnaaacacttctctttattctgcatttattgngatttttggaaacaggtntcaaccttcacagttgggtgaacaagtgttgtcctacagatgtccaatttatttgcatttttaaacattagcctatgatagtaatttaatgtagaatgaagatattaaaaacagangcaaattatttgaagcnctctaatttgcggtacgatattgcttattgtgactttggcatgtatttttgctagcaaaatgctgtaagatttataccattgatcttttttgctatatttgtatacagtacagtaa

SEQ ID NO: 21831 - DNA, 399 bp, Homo sapiens
tctatggccgggcaagcaggatgtgcagcccaccagggttaaaagtgtggtctgatccatttggcaggaaatgagagggctgtcatcagctctgattaagaaaggagatttcttcatgctttcgattctgcatggggtacagccagtcacctcaccagagaatgacggctggagaagaagactctgtaataccataaataagagtgcttgtaataaaagactgtgcacaaggattaatatttcccttcttaagtatcaaaagaactctggaacaaattataccattaggaaggttttcatgattcagttgattttccaaaaatgaagctatctcacccagctgggtttggaggagcaatctgcttattattctgtcgttaccacttactcaagcgagct

SEQ ID NO: 21832 - DNA, 400 bp, Homo sapiens
  misc_feature 3, 11, 35, 62, 67, 75, 82, 89, 92, 93, 94, 96, 100, 115, 116: n = A,T,C or G
ggncccagggncttcgttcttatggccgggataanacagcttacactatcaaaaactgttgnctagnatacctgntaatttntggcttntgnnntngttnaaaaaattgcagcgnngaatgggatgtttgtgtttatggctatttgggcacctttagtagaaacagacaaaagtaaggaaacgataataggacaagcatacttgaaaatttctgaatacttaaacaaaagcgcaacatcttgaaaaccagtcttagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgc

SEQ ID NO: 21833 - DNA, 292 bp, Homo sapiens
  misc_feature 12, 18: n = A,T,C or G
tgaccctggganttcgtncttatggccggggtgtacagtcgtgtcatttaacagtagggatctgttgtgagaaatatgtcattaggtgattttgccatgctgacatcatatagtacttacataaatgtaaatgatacagacttctgcccacacctaggctatattgcacagtctattgctcttaggctacaacctatatagcgtgttacttgtaccaaatactatagacagttgtaatacaatggtaagtattgtgtctaaacatagaaaagatacagtaaaaatacagtat

SEQ ID NO: 21834 - DNA, 400 bp, Homo sapiens
  misc_feature 13: n = A,T,C or G
ttatggccggggnggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaa

SEQ ID NO: 21835 - DNA, 400 bp, Homo sapiens
  misc_feature 19, 22: n = A,T,C or G
tgtacccagggaaattcgnttnttatggccgggctacaagaatccggggagtatcgcggacgggttgtgcctggaggtggtaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtga

SEQ ID NO: 21836 - DNA, 400 bp, Homo sapiens
  misc_feature 2, 18: n = A,T,C or G
tnacccagggaacctcgnttcttatggccggggcccgtaggaagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatccccccagcagagatggagagctaaagtccaagagaggatccgagaacgctctaagcctgtccacgagctcaatagggaagcctgtgatgactacagactttgcgaacgctacgccatggtttatgggtacaatgctgcctataatcgctacttcaggaagcgccga

SEQ ID NO: 21837 - DNA, 400 bp, Homo sapiens
  misc_feature 2, 8, 30, 34, 43, 47, 54, 55, 65, 73, 91, 103: n = A,T,C or G
anttactnggaaagactttagaaagggctntacntatgcggantatnaacagtnnattctagagntggtacanatgcgtaaaagctataantatatgattcanaaaccatctaagaattttaaactgtggtctaattattatggaagcttactggagcctatccttgtgatttgttagaacattggttcatatgccattttattcgtaatctcttccaattcttattaagactagcactgctgttatgaatttcatggctttttttttaagttgctggatataagccaggttatcatataatgccctttactacctgtagtcactttgggataggtactgtgccttcaaccatctttgaaatcctacaactcgtaggctaggtttagatgccaaatagct

SEQ ID NO: 21838 - DNA, 400 bp, Homo sapiens
  misc_feature 12, 19: n = A,T,C or G
tgacccaggganttcggtnttatggccggggcccagcttgtcctctatgacttacccagaaggcaacgcttctctttctggtcaaaatggcgggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagggcagtggaccaaatatgaagaggaaaatttctaccttgaaccgtatctgaaagaggttattcgggaaagaaaagaaag

SEQ ID NO: 21839 - DNA, 400 bp, Homo sapiens
ttatggccgggtacgccaaccaggacagaaatattatcttagccccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttagctactacgttgacactgct

SEQ ID NO: 21840 - DNA, 400 bp, Homo sapiens
  misc_feature 8, 21: n = A,T,C or G
ttttcccngggtaattcggtnttatggccggggctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaagggaagttcccaactataaacttataaccccagctgtggtctctgagagactgaagattcgaggctccctggccagggcagcccttcaggagctccttagtaaaggacttatcaaactggtttcaaagc

SEQ ID NO: 21841 - DNA, 104 bp, Homo sapiens
  misc_feature 11, 12, 38, 42, 53, 84, 87: n = A,T,C or G
gggacttcggnnttatggccgggattcattttgacagntatnaaagatgtacnttcccagtgtaaatttacattacatggcagnttntgatacgttttatggct

SEQ ID NO: 21842 - DNA, 100 bp, Homo sapiens
  misc_feature 12, 18, 48, 56: n = A,T,C or G
acccagggaaantcggtnttatggccgggggactttccactgtacagnatttcagncatcattcactatgactcttttttcttgactgttgcttgttctt

SEQ ID NO: 21843 - DNA, 400 bp, Homo sapiens
  misc_feature 7, 21, 47, 75: n = A,T,C or G
tcacccngggaaattcggttnttatggccgggatctgaaacactttntttatattgtatttataataaataatanctacactgttgtaagcactttacaagtaataactcatttaatccttatagcagtgctatggggtaggcagtgttataatctatggtttaaatgtaagtaaactaagtcacagactgattgtattaatataatttactaattgtcacagggctagtaattgactgaaccatgattaaaaccctggaaatgtggccctagggtctgtgctcttaattaatattaccttttgcctcagagagtctctaaaaatccccttgatatggggaatattattcctgttttataaacaaaggctaaataaagattaagtggcttactgaatatc

SEQ ID NO: 21844 - DNA, 400 bp, Homo sapiens
  misc_feature 33: n = A,T,C or G
ttatggccgggggcagagttgagtgtcctgagnagtcagattgctgtcagacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcattagtggtttcttaactctccaaaataaga

SEQ ID NO: 21845 - DNA, 400 bp, Homo sapiens
  misc_feature 12, 14: n = A,T,C or G
gggaaattcggntnttatggccggggacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggc

SEQ ID NO: 21846 - DNA, 400 bp, Homo sapiens
  misc_feature 7, 20: n = A,T,C or G
tttcccngggaattcggctnttatggccgggcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcaggctgcacctatgattggttatccaatgccaacaggatattcccaataagactttagaagtatatgtaaatgcctgtttttcataattgctctttatattgtgtgttatctgacaagatagttatttaagaaacatgggaattgcagaaatgactgcagtgc

SEQ ID NO: 21847 - DNA, 252 bp, Homo sapiens
  misc_feature 4: n = A,T,C or G
ttgnacccgggaaactcggccttatggccggggatataaatatgtaaaatatataaatatataaaagtataattaatatcatctccaagaagaagagccttttaatctgttggttttagtttttgagaaactaaaactttctctggagaggcatgatgcttgatgcaaaggtttctccttttatctcttgcttaatcattttcctttgacttttaaaactctatccatagagaataacatgaaaaaaaaaaa

SEQ ID NO: 21848 - DNA, 246 bp, Homo sapiens
  misc_feature 2, 9, 29, 38, 45, 72, 81, 93, 114, 166, 205, 212, 216: n = A,T,C or G
cngggaaantcggttcttatggccggganaggcaaaanatagcangaaaaattttcagtagtataaaatganaaaaaattntacccagatatnaaaattcaagctgtgatgacnagaaatgatcttgcctatatagtgagtcataatttccaacatgtggtttatnaccaccatgttgtatggtatgtctgaagtacttctgccntgaaagnaacncctactctgaaagaatttatccatgataaa

SEQ ID NO: 21849 - DNA, 100 bp, Homo sapiens
  misc_feature 16, 22, 32, 36, 50, 55, 57, 62, 67, 86, 90, 96: n = A,T,C or G
tatggccgggcatgcncgcagnggtagtaacnattnataactttgtaganaattncntagtnatttntaaataacctagagtttgntgantgatgngagt

SEQ ID NO: 21850 - DNA, 261 bp, Homo sapiens
  misc_feature 9, 11, 31, 41, 51, 54, 57: n = A,T,C or G
agagtactngngcctgtaatcccaccctgcnaatagatganttgaacccanggnctnaaggaccagactgagcaacatgacaaaaccctgtctctgcaaagagtttaaaataattagccgggcatggttgtacacctgtggtcccagttattcggaaggctggggtgggaggatcccttgggcccagaagattgaggctgcagagagctatgattgcacaactgcactccagcctgggcgacagagtgagaccctgtcacc

SEQ ID NO: 21851 - DNA, 400 bp, Homo sapiens
  misc_feature 3, 9, 39: n = A,T,C or G
gantcttgnacccagggaaactcggccttatggccgggnattacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattggattttgtaggtaatattcca

SEQ ID NO: 21852 - DNA, 400 bp, Homo sapiens
  misc_feature 6, 14, 43, 51, 56, 80: n = A,T,C or G
gggaanttcggttnttatggccggggagcatttaagaagcatnctctgccngaccnaaaggaaagaagtaaaaagggccnaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtat

SEQ ID NO: 21853 - DNA, 136 bp, Homo sapiens
  misc_feature 5, 29, 35, 55, 62, 89: n = A,T,C or G
tcggncttatggccgggggaagtaaagancattgngcaaatgtcttatcaggcantatctgnaacgttttgatgttatatacaagactntgtctttttcatacgctctatatatgcccaccttttatgcatgcacg

SEQ ID NO: 21854 - DNA, 400 bp, Homo sapiens
  misc_feature 5, 11: n = A,T,C or G
acccngggaantcggtcttatggccggggtcttaggaaaacacatttataaacatggatacctgataatagatattgaaacccatttcctgtgtgttaaaatatttaaaaagtggatattccaggaatgtttgcagctttgtacaagtaacataaattggacacctcagaatgaaagttcatgttggttctgaatggttcgctgcagctcctgtcacaggctgggatggatttatcacactgagttgtgaaattacctggttctaagaatttttgagtggcaaaaatagaaaatagtcttcatttgaaaacatccctaagcttgaataaatggataccatagatagcttctcttttttattctggtgtcattaccagcatctgaatttcaagttcttaaa

SEQ ID NO: 21855 - DNA, 400 bp, Homo sapiens
  misc_feature 6, 11, 37, 57: n = A,T,C or G
gggaantcggncttatggccgggcaggaatgccaagnaggtttaacgtacaaaaatnagtcagtataattttctgtattagcagaataaaggataaaattatatgaatatttcaatcggtgcagaaaaagcatttggcaaaatttaagatatatttaactctgaacaaactaggaatatatggaaacttcctcagcttgataaagggtatccacaaaaagcctatagtagcttaactaatggtaaaggaacaaattgctttgctccgaagatgctaaggcaaagatatactcttgccaatttcattttgtttgagtttttgttgttttgtttgtttgtttttgttttgttttgttttttaagacagagtctcactctgtcactcaggcaggttggagtgc

SEQ ID NO: 21856 - DNA, 243 bp, Homo sapiens
  misc_feature 14: n = A,T,C or G
tttgcaccccgggnaattcggccttatggccgggcgtgtcagaattgactttgaaaagcattgctttttacagaagtatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtg

SEQ ID NO: 21857 - DNA, 241 bp, Homo sapiens
  misc_feature 12, 232: n = A,T,C or G
gactttgtcccngggattcggtcttatggccgggatttgtcataaggtttggatattaatttcaggggagttgaaatagtgggagatggagaagagtgaatgagtttctcccactctatactaatctcactatttgtattgagcccaaaataactatgaaaggagacaaaaatttgtgacaaaggattgtgaagagctttccatcttcatgatgttatgaggattgttgacnaacaaaaaa

SEQ ID NO: 21858 - DNA, 325 bp, Homo sapiens
  misc_feature 7, 9, 321: n = A,T,C or G
cagaccngnattaaaacaatttacctcttgctataggaatacaaacggtcctacaatttcaaattattcacaaattctgccccccactcccaatcacattacctggtttgacaggtgtggactgagaaggtggaatctgcaccgtaaatctttggcttggactgacattggagttgcaactttatttgggacagacaccgtttgtggggttgctgtagttacaataaacagaccatgtttgttaggtgacttatacagatttatattctacactcagcttaccgcaaactatcttcaaagcaaaggaaactaataaaaggngagg

SEQ ID NO: 21859 - DNA, 223 bp, Homo sapiens
ttatggccgggggaatcgcttgacctctgggtttgagtaccagcctgggcaacaaaccctatttctacaaaaagtagaaaaattagccaggcttggtggtgcacgcacatagtcccctctactcaggaggctgcggtgggagcatcgttggtcaaggctgcagtgagctgtgatcgcgccatagcactctagcctaagtgacagagtgagactctgcctcagc

SEQ ID NO: 21860 - DNA, 400 bp, Homo sapiens
  misc_feature 10, 22: n = A,T,C or G
ttttgacccngggaattcggtnttatggccgggaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacag

SEQ ID NO: 21861 - DNA, 400 bp, Homo sapiens
  misc_feature 2, 9: n = A,T,C or G
antcggttnttatggccggggagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctgg

SEQ ID NO: 21862 - DNA, 213 bp, Homo sapiens
  misc_feature 40: n = A,T,C or G
cttatggccggggatgcttataactagtattttcttaatntagaatagtattaacatcccatgaaaaaatgaaaacatgttctaatatattaagactttgaaaaacattttaagggtgtgtagtacacatacattcgtaggtatacagatgtagagtggtgttgcattatatgtacttttaatttaatgcaaatttagctacccatacttgac

SEQ ID NO: 21863 - DNA, 400 bp, Homo sapiens
ttcacccagggaattcggttcttatggccggggggaagcggcgagggtagccatgacggcctccgtgctgcgaagtatctcgctagccctgcgcccgactagcgggcttctgggaacttggcagacgcagcttagagagactcaccagcgagcgtcattgttgtctttctgggaactcattcccatgagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaagagagcggcctcaggtggagctcacctttgaggagactgagaggagagctctg

SEQ ID NO: 21864 - DNA, 268 bp, Homo sapiens
  misc_feature 7, 15, 45, 122: n = A,T,C or G
ccttgtnccgggacntcggccttatggccgggcaagctccactgnggcataaagccaacctgactgcaaattttgtcaggttgcagctaggagagtgacaaggcagaatgtgttcagaaganggaaatttttactcaaaagctgttaattctagaaggaatattggagataagagtgtggtgaacagctggcactttagcctgacttgtatagcctccctatgtcactaaaatggctgtcagctctttggtgttaggcaaaaaaaaaa

SEQ ID NO: 21865 - DNA, 400 bp, Homo sapiens
  misc_feature 10, 22: n = A,T,C or G
ttttgacccngggaattcggcnttatggccgggatccctcctgaccgcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagcgtccacttctgcacttggtcctgcgcttgaggggggggtgtctaagtttcccct

SEQ ID NO: 21866 - DNA, 179 bp, Homo sapiens
  misc_feature 23, 39, 46, 61: n = A,T,C or G
gctggctgactggatgacttacngctccttatgtgctgnagactanccaggagagcgagantctgaccctaatccttacttctatcaggtaagaaaaaataggaagcttataagtttattttgcatttgctggctgacatatgcctaaatcagtgatacttaaccatttggccgttgag

SEQ ID NO: 21867 - DNA, 400 bp, Homo sapiens
  misc_feature 12, 22: n = A,T,C or G
ttatggccgggnagccattgancattattcctgtattttctctgaaactgattataaaaaccaatgtccagctactcttttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagcca

SEQ ID NO: 21868 - DNA, 268 bp, Homo sapiens
  misc_feature 2, 6, 130: n = A,T,C or G
cncccngggaattcggccttatggccggggaggtgggtggatcacttgaggtcaggaatttgagagcagcctggcccacatgatgaaacccccatctctactaaaaatacaaagattagctgggcttggnggggcacacctatagtcccagctactgggctgaagcaggagaattgcttgaacccgggaggtggaagttgcagtgagccaagaccatgccactgtactcaagccttggcgacagagcaagactttgtctcaaaaaaaa

SEQ ID NO: 21869 - DNA, 400 bp, Homo sapiens
  misc_feature 5, 8, 33: n = A,T,C or G
ttcgnttnttatggccgggcaatcaacttgagnaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactca

SEQ ID NO: 21870 - DNA, 400 bp, Homo sapiens
  misc_feature 2, 22, 36, 38: n = A,T,C or G
antcggttcttatggccggggnacagccgcccgggnanaagaggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgcttaagtaat

SEQ ID NO: 21871 - DNA, 400 bp, Homo sapiens
  misc_feature 4, 11, 29, 62, 63, 347, 356, 360: n = A,T,C or G
ttcnttagganctacctcctggtgaagangctgtgcaaattgtggaaatcaatgatttaganntcttccctaaatactaattgataaagcagtggtaggatttgagaggagtgactacagttttgaaagaagtcctactgtgggtaaagtactatcaaacaacatcacatgccacagagaaactttttgtgaaagaaaagtcaatcaatgtgactcttcattgttatcttaagaaattggggccggcgcagtggctcacacctgggattacagtcgtgagccaccgcacccagccaacataacttttatatgcactgggaaaccaaaaatgttgtgtgacatgcttnattgtgggngggngtggaactgaacccacagtatctctgaagtatgcctgtgt

SEQ ID NO: 21872 - DNA, 400 bp, Homo sapiens
  misc_feature 10, 11, 43, 55, 78, 79, 91, 93, 105, 127, 202, 246, 342: n = A,T,C or G
tggccggggnngttataagtatcggagccgcaagtatcttttnttgtatttttangtgtctaaaaaatataataccannaaatccctgtantntattgatttttnaaagaactaacaaaattgacanatctttagctagatgaactaagaaagtaagagagatgacaaataaataaaatgaaattaaatggaaatattacangtgatactacagaagtaaaaaggataagagattttatacacagntatataccaattaagaggaaaatctggaaaaaatggacaattcctggacatatataacctactaatattgaatgaagaagaaataaaaacgctgancagaacaataatgaataataagataagtacatatatgtctcccatcaaataggagccc

SEQ ID NO: 21873 - DNA, 400 bp, Homo sapiens
  misc_feature 3, 7, 28, 31: n = A,T,C or G
acntcgnttcttatggccggggagaatnagnggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggattttgattcatgagatctatactgttggaaaacgcttcaaagaggcaaataacttcctgtggcccttcaaattgtcttctccacgaggtgg

SEQ ID NO: 21874 - DNA, 400 bp, Homo sapiens
  misc_feature 2, 18, 48: n = A,T,C or G
tncttatggccgggggantcctgaagctgacagcattcgggccgagangtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgaga

SEQ ID NO: 21875 - DNA, 261 bp, Homo sapiens
  misc_feature 6, 15, 60: n = A,T,C or G
attttntcccgggantcggccttatggccggggaacctgaatattgccttatgcttgacntggtttccaaaaatggtactccacctacttcagtgagggtaagtattttcctgttgtcaagaatagcattgtaaaagcattttgtaataataaagaatagctttaatgatatgcttgtaactaaaataattttgtaatgtatcaaatacatttaaaacattaaaatataatctctataataaaaaaaaaaaaaaaaaaaaa

SEQ ID NO: 21876 - DNA, 400 bp, Homo sapiens
  misc_feature 3, 9: n = A,T,C or G
acntcggcnttatggccgggatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgcctggcccgcaatactgtaggaacaagcatgatcttg

SEQ ID NO: 21877 - DNA, 400 bp, Homo sapiens
  misc_feature 9, 12, 89, 155: n = A,T,C or G
tacccgggnacntcggccttatggccgggccaaaatcctgttttaagactaggataattgaaatgtaagttctgaagcaaaagtttgcngagaatttctctttgatttacctgaaggagtttccctctaattgcacagaaatgaaggcaagcgcncacaaagaggccctctgttctcgggtgtctatgaatgctgggggctgatgtggcctctcttgagtaggtttctattctagataacagagcggtccctgaagcaaaacgggatagagctgggcagatagagtgaacctaaaaatgtgtgtctttagggaaaagtgcccttagcaaatgttttccctggtgtgcgtgttcttagtattgtgcctggcatatgtggtaatacacattcagttaccaat

SEQ ID NO: 21878 - DNA, 400 bp, Homo sapiens
  misc_feature 25, 26, 38, 40, 55, 70, 75, 80: n = A,T,C or G
atccttgtccccgggacctcggccnntatggccgggananttaaactgtctaacntgtctctgttgaganattanttaantgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacatttaatgtatgaatagatgtgaatttgggatttcaaaatagatgaataacaactattttatagtaaagttattgaa

SEQ ID NO: 21879 - DNA, 398 bp, Homo sapiens
ccgggcactcttccttatggccgggtatgaaggagtatattatttacagcaaagtaataacaatgacacacacaaaaaactatgaactgatctcataaattttttttacaattctaaataaaatattaagtctattagcatattaagagagtaattattcatgaaaaagtggcgattattccacaagtgcaaaataattgactattaaggaagctattaataaaaataattatcttaacagatctatgaagagaaagtatatgaattctttcataattaaagtaaaagtatttgacaatgatcagtaaatacttttgataaagacagttactaacttggtaataaatgatactaacataatacaatatttacatctcaacttaaaagtttcattatgc

SEQ ID NO: 21880 - DNA, 243 bp, Homo sapiens
  misc_feature 3, 9, 63, 70, 71, 76, 82, 107, 130, 135: n = A,T,C or G
ttnctctantggtcgcgggggcgcaaataagtatttaagtacccgcaaggggaaaagatgaanaaattannaaccnagcatnaatattagcaaggactaacccctantaccctttctgcataatgaaatnaactnagaaaataacttttgcaaggaagagccaaagctaagacccccgaaaaccagacgagctacctaagaaacagctaaaagagcacacccgtctatgtagcaaaaaaaaaa

SEQ ID NO: 21881 - DNA, 400 bp, Homo sapiens
  misc_feature 7, 19, 42: n = A,T,C or G
ttcggcnttatggccgggntgttctgtgattgtaagaaagantgaaaacagtttgtatggagatagagttgattagcatttgagctctgaaagcagaactctagtaaaatgatctcgacctaacaaagggtctgttccattatatagactattaccataatcctggattgtttcaactgggttttggcctctccattatatgagatcatatgtatatagctaagaagtctgattaaagtatggaaagattttaggaaacactaagaagatacagggatctttactgatacctaaaaagattacaattgagtaattgctcaattgagtgtaggggcatacctgaaggaagaatttgcatttgggacttcgaaggaagcttccaagagatttgggaagagac

SEQ ID NO: 21882 - DNA, 400 bp, Homo sapiens
  misc_feature 5, 6: n = A,T,C or G
tcggnnttatggccgggatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttc

SEQ ID NO: 21883 - DNA, 400 bp, Homo sapiens
  misc_feature 11, 15: n = A,T,C or G
tttttgacccngggnaattcggccttatggccgggggattaactgatgcctgctcgtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcatt

SEQ ID NO: 21884 - DNA, 400 bp, Homo sapiens
  misc_feature 3, 9, 30: n = A,T,C or G
acntcggcnttatggccgggggaatcagangcaaagaggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgcc

SEQ ID NO: 21885 - DNA, 400 bp, Homo sapiens
  misc_feature 2, 3: n = A,T,C or G
tnnttatggccggggttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcag

SEQ ID NO: 21886 - DNA, 400 bp, Homo sapiens
  misc_feature 8, 12: n = A,T,C or G
ctcggccnttanggccgggggagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgagggaagaagacatgctctacagtgctcagtctttgaggtcacgagaagagaatgccttctagatgcaaaatcacctccaaaccagaccactt

SEQ ID NO: 21887 - DNA, 399 bp, Homo sapiens
  misc_feature 13, 39: n = A,T,C or G
tatggccggggantgacaaaaaggggaatttcaattacntcgagttcacacgcatcctgaaaccggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattt

SEQ ID NO: 21888 - DNA, 400 bp, Homo sapiens
  misc_feature 2, 11: n = A,T,C or G
gncccaggganctcggtcttatggccgggattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatcccc

SEQ ID NO: 21889 - DNA, 200 bp, Homo sapiens
  misc_feature 7, 13: n = A,T,C or G
gggaaantcggtnattatggccggggaggctgatctaaaagactgcagtggtctactccctgtggagtctgtagtgtgttgcaccaaggttttcttcaaacacaggactctacgtgagagtcttggagtggaatcacgatggagcagggaaacagacaatagagaaaaggaaagaatgtcagataaaaaaaaaaaaaaaa

SEQ ID NO: 21890 - DNA, 330 bp, Homo sapiens
  misc_feature 72, 81, 270, 324: n = A,T,C or G
tatggccggggaaggggcggttggctttgttgggtgagcttgtttgtgtccctgtgggtggacgtggttggngattggcangatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgnactctttctgactacaacatccagaaggagtcgaccctgcacctggtcctgcgnctgaga

SEQ ID NO: 21891 - DNA, 390 bp, Homo sapiens
  misc_feature 2, 38: n = A,T,C or G
antttttttccccgggaattcggttcttatggccgggnaatattcacctgccgactggcttatcaagtacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgg

SEQ ID NO: 21892 - DNA, 291 bp, Homo sapiens
  misc_feature 3, 11, 180: n = A,T,C or G
ttnttatggcngggcaaccaaccaacttaattatgttcctttgttctccacatagaagtcaaaggtattatgtatagagtcactaaactccttgcctctcacaagtggtgaatcaggagtgtcaaacgcatttatttttcataactctctaaaaagttcatgccaggccgggcgcggtgnctcaagcctgtaatcgcagcactttgggaggccgaggcaggcggatcacaaggtcaggagatcgagaccatcctggctaacatggtgaaaccccatctctgctaaaaatcc

SEQ ID NO: 21893 - DNA, 400 bp, Homo sapiens
  misc_feature 9, 10, 30, 32, 88: n = A,T,C or G
ggccggganntcaaaagaacctgttgggancnaacttgcctttttccccaaaaaataaactctcaggcaagcatttctttaaagctanttaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgca

SEQ ID NO: 21894 - DNA, 327 bp, Homo sapiens
  misc_feature 13, 24: n = A,T,C or G
ttatggccggggnatattctaatnctaatattttaaaaaatcgaggctaggcgtggtggctcatgcctgtgatcccagcattttgggaggccaaggtggacggatcaccagagttcaggagttcgagaccagcctggtcaaaatggtgaaatgccatctctactagaaacacaaaaattagctgggtgtgtggtggtgtgtgcctgtggtcccagctgctctggatgctgaggcacgagaattgcttgaacctgggagtaggaggctgcagtaagctgagatcgtgccactgcactccagcctgggtaacagagcaagactctgtct

SEQ ID NO: 21895 - DNA, 111 bp, Homo sapiens
  misc_feature 22, 27, 31, 44: n = A,T,C or G
ctttctttttaccacagggaanttcgntttnttatggccggggnaggaaggaaggggacagttgcagtctcacttggttacaggccacagcgcgggggtgccggtcactac

SEQ ID NO: 21896 - DNA, 352 bp, Homo sapiens
  misc_feature 6, 7: n = A,T,C or G
ttcggnnttatggccgggggatcttcctgcggctgaaccgcccggctgagccgacattgccggcgtcttggcgattcggcccgacgagctccgctttcgctacagcatggtggcctactggagacaggctggactcagttacatccgatactcccagatctgtgaaaaagcagtgagagatgcacttgaagacagaattcaaagcaaatgctaagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattcca

SEQ ID NO: 21897 - DNA, 294 bp, Homo sapiens
  misc_feature 3, 100, 122, 136, 194, 231: n = A,T,C or G
tcncctcttatggaccggggtaaacactgggtactagcaatgataatagggagataagaaactttaattatcttgatcctttaagtggattttatttggngcatttctgctctgggtatatnataaaagtgggggnttttggcgaaatgagtgaagaaatgaaaggtttctaaagtgctatccaaatacatcantaatttttctaaggagtttaattgttaaatggggagncattcataagaaatatttatgcttgaatatgaaaatctatgaaagcataaatgctgctgtttg

SEQ ID NO: 21898 - DNA, 303 bp, Homo sapiens
  misc_feature 3, 15: n = A,T,C or G
ccnttatggccgggnattcaataaaactgtcttgtgagctgatcgcttggagggtcctctttttatgttgagttgctgcttcccggcatgccttcattttgctatggggggcgggcaggggggatggaaaataagtagaaacaaaaaagcagtggctaagatggtatagggactgtcataccagtgaagaataaaagggtgaagaataaaagggatatgatgacaaggttgatccacttcaagaattgcttgctttcaggaagagagatgtgtttcaacaagccaactaaaatatattgctgc

SEQ ID NO: 21899 - DNA, 399 bp, Homo sapiens
  misc_feature 16, 19, 27: n = A,T,C or G
gcggggtgggacctcnttnttatggcnggggagcctttaagtaagcatcctctgccaagtaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatct

SEQ ID NO: 21900 - DNA, 388 bp, Homo sapiens
  misc_feature 3, 29, 36, 41, 43, 57, 88: n = A,T,C or G
tanggccgggtctaagtcccttctgcacntctaaancttananggagttggtcaaangagggaacctctgggttactgcctttttaanagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactattttttttgtactgctggtcctgtaccagaaacattttcttttattgttacttgctttttaaactttgtttagccacttaaaatctgcttatggcacaatttgcctcaaaatccattccaagttgatattttgttttccaataaaaaaattacaattt

SEQ ID NO: 21901 - DNA, 400 bp, Homo sapiens
  misc_feature 2, 13: n = A,T,C or G
tntggccgggganggactgactacctttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtccagaagtg

SEQ ID NO: 21902 - DNA, 311 bp, Homo sapiens
  misc_feature 20, 32, 118, 174, 177, 179: n = A,T,C or G
tctcctatctcatagaaganaggcgcgggggnttaaattcagatctctgatgccaaagcttgggctcttaaccactacaatatattgcctcaaaagataataggagacacaaaatggngtttataatcttgccgggggactgcaaaagacataataacagttacaagccaaaancangnaatacacaaagaaatcaaaccatgaacagaatggctttcaggggcacaaataatagagcagtgatcagaattaggctctgaggagtgagttttgagctgagatttgaggccagtgaagaaaatacactggtc

SEQ ID NO: 21903 - DNA, 388 bp, Homo sapiens
  misc_feature 6, 30, 49, 52, 55, 58, 121, 206, 292: n = A,T,C or G
ggggcnttcctgaagctgacagcattcttnccgagatgtctcgctccgnggnctnagntgtgctcgcgctactctctctttctggcctggaggctatccagcgtactccaaagattcaggnttactcacgtcatccagcagagaatggaaagtcaaatttcctgaattgctatgtgtctgggtttcatccatccgacattgaaggngacttactgaagaatggagagagaattgaaaaagtggagcattcagacttgtctttcagcaaggactggtctttctatctcttgtnctacactgaattcacccccactgaaaaagatgagtatgcctgccgtgtgaaccatgtgactttgtcacagcccaagatagttaagtgggatcgaga

SEQ ID NO: 21904 - DNA, 198 bp, Homo sapiens
  misc_feature 29, 40, 49, 54, 57, 59, 60, 105, 143, 149: n = A,T,C or G
gacacctaacttgaaaactgcctgatggnttttttgcagnggttccctncaggnagncnngatctcaattgaagaagttctttcctggcattccaatgcccctgncagctccatactcctcagacacccttaacaaaggctgncatgcncacaatgtgacaaatacacaaaataaatgataattacactaaaaaaaaa

SEQ ID NO: 21905 - DNA, 275 bp, Homo sapiens
  misc_feature 3, 50, 56, 59, 69, 122, 222, 227: n = A,T,C or G
ggnaccaccgtaaacacacggggcaccgttttttccagtgccaaaaatgngaccgngcnttttccaggncggaccacctcgccttacacatgaagaggcatttttaaatcccagacagtggntatgacccacactgccagaagagaattcagtattttttacttttcacactgtcttcccgatgagggaaggagcccagccagaaagcactacaatcatggncaagntcccaactgagtcatcttgtgagtggataatcaggaaaaatgaggggt

SEQ ID NO: 21906 - DNA, 378 bp, Homo sapiens
accaacaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatt

SEQ ID NO: 21907 - DNA, 382 bp, Homo sapiens
  misc_feature 7, 113, 124, 145, 323: n = A,T,C or G
atcccgnaggagcctctctccctactgttgctacacaagtaccctgagactgacctgcaggacgaaaccatgaagagcctgatccttcttgccatcctggccgccttagcggnagtaactttgngttatgaatcacatgaaagcntggaatcttatgaacttaatcccttcattaacaggagaaatgcaaataccttcatatcccctcagcagagatggagagccaaagtccaagagaggatccgagaacgctctaagcctgtccacgagctcaatagggaagcctgtgatgactacagactttgcgaacgctacgccatggnttatggatacaatgctgcctataatcgctacttcaggaagcgccgagggaccaaatgag

SEQ ID NO: 21908 - DNA, 363 bp, Homo sapiens
  misc_feature 23, 80: n = A,T,C or G
ggacaagttgttcatcagccggnacctgttatggaatttgattatgtaatatgcgaagaatgtgggaaagaatttatggnttcttatcttatgaaccactttgatttgccaacttgtgataactgcagagatgctgatgataaacacaagcttataaccaaaacaggggcaaaacaagaatatcttctgaaagactgtgatttagaaaaaagagagccacctcttaaatttattgtgaagaagaatccacatcattcacaatggggtgatatgaaactctacttaaagttacagattgtgaagaggtctcttgaagtttggggtaagtcaagaagcattagaagaagcaaaggaagtccgaca

SEQ ID NO: 21909 - DNA, 193 bp, Homo sapiens
  misc_feature 25, 127: n = A,T,C or G
caatgaggtagacgaagaagaggangaaggtggggaggaagaggaggaggaagaagaaggtgatggtgaggaagaggatggagatgaagatgaggaagctgagtcagctacgggcaagcgggcagcntgaagatgatgaggatgacgatgtcgataccaagaagcagaagaccgacgaggatgactagacaac

SEQ ID NO: 21910 - DNA, 399 bp, Homo sapiens
  misc_feature 16, 41, 58, 72, 131, 175, 249, 252, 277, 308: n = A,T,C or G
ttcttttgtccccagngcccctgtcttttttatgggccggngatgccctaaaaacagnattgtctcagtttntctagctttgaaaatgccatacccatggggaggagaagaaggatgtgtataaggcgggngagcaagtgacttacacttgtgcaacatattacaaaatggatgnagccagtaatgtaacatgcattaatagcagatggacaggaaggccaacatgcagagacacctcctgtgtgaatncgnccacagtacaaaatgcttatatagngtcgagacagatgagtaaatatccatctggngagagagtacgttatcaatgtaggagcccttatgaaatgtttggggatgaagaagtgatgtgtttaaatggaaactggacggaaccaccct

SEQ ID NO: 21911 - DNA, 110 bp, Homo sapiens
  misc_feature 25, 31, 33, 39, 46, 53, 59, 60, 65, 89: n = A,T,C or G
gaaatgacccttagttgactgcctnccattntnttcagncttgccnctagtangtctcnngagcnaaagcccacttcgccatcatattngtgggaggaaacataacactc

SEQ ID NO: 21912 - DNA, 108 bp, Homo sapiens
  misc_feature 2, 4, 6, 9, 23, 30, 36, 50, 51, 60, 65, 77, 84, 89: n = A,T,C or G
gnangnacngagccacactgaanaatgggngcaaancagtcgttgaatanngaacacgcntggcngagagactaccnatgcgtngatanagcaccctataacaccgga

SEQ ID NO: 21913 - DNA, 397 bp, Homo sapiens
  misc_feature 10: n = A,T,C or G
gaaagagccnacgcagagcacccctggctacatatttgggaaacgcatcatacttttcctgttcctcatgtccgttgctggcatattcaactattacctcatcttctttttcggaagtgactttgaaaactacataaagacgatctccaccaccatctcccctctacttctcattccctaactctctgctgaatatggggttggtgttctcatctaatcaatacctacaagtcatcataattcagctcttgagagcattctgctcttctttagatggctgtaaatctattggcatctgggcttcacagcttgaggtaaccttgcttttccgggaacaaaatgatgcatgcaagctcgcccttgaacatgaccgtgccccaaatttgctattcccatg

SEQ ID NO: 21914 - DNA, 373 bp, Homo sapiens
  misc_feature 2, 11, 57, 314, 336, 345, 365: n = A,T,C or G
gnatataaccntgtttttaaacttgacaatcattacactaaaacagatttgataatnttattcacagttgttattgtttacagaccatttaattaatatttcctctgtttattcctcctctccctcccattgcatggtcacacctgtaaaagaaaaaagaatcaaattgaatatatcttttaagaattcaaaactagtgtattcacttaccctagtcattataaaaaatatctaggcattgtggatataaaactgttgggtattctacaacttcaatgggaaattattacaagcagattaatccctctttttgngacacaagtacaatctaaaagntatattggnaaacatggaaatattaaaantttacact

SEQ ID NO: 21915 - DNA, 185 bp, Homo sapiens
tcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccg

SEQ ID NO: 21916 - DNA, 347 bp, Homo sapiens
  misc_feature 9, 13, 186, 288, 341: n = A,T,C or G
gaagagttncaanttgaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtgganttgactttctaaagactttttttgtggacattttgacatttggagaagaaagatggcacactaacccagataatagtttttatgcctggaattttttgcggnttgatttgtataccgtatgacctcttgaaatgttaatttttaataaaatttgnaacact

SEQ ID NO: 21917 - DNA, 343 bp, Homo sapiens
  misc_feature 11, 38, 49, 55, 278, 315: n = A,T,C or G
gaatatatccncttcctttatactagtttctctctagnaaggcatgccngaagcntttagataccatatcatgaattcttacatattgtaccttttgttggtggttaaatcgcatcagatgcttggcattgctgccataattataaaatgcttgtaaaggatcaaatatcactaaatactttaaattgttttacttaagagctaatctgggaagttttcaaatcatactattaatgtgtaatctaagctcttcagatgtatccatgaataatcctggnacaatattgcttgtattcctgcatagaacaggtttgnaatctttaaaagaaatgaaaatttatat

SEQ ID NO: 21918 - DNA, 363 bp, Homo sapiens
  misc_feature 279, 284, 349, 351, 355: n = A,T,C or G
atctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggntgcanggaaatcagccaagctttataatccttaaatcttaatgttcctcaaagctcggattaaatacatntnggangttactct

SEQ ID NO: 21919 - DNA, 399 bp, Homo sapiens
  misc_feature 7: n = A,T,C or G
tcgtttnttatggaccggggaaactcagtgctgggagcatcctctacccccggggatgaggacacacttcaggacccagccccactggagtgtggccaaggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggaaagaaccttgctacttggtctctgcaatctccttggaaaatagaatgctcctgtagccagaacactctttggaaatgatgtaacgccacagaatatgctcacgaccagcctcagtaggtga

SEQ ID NO: 21920 - DNA, 369 bp, Homo sapiens
gatggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgccttgatgaaaaagaagtttaaaacccaccgacctgagagacatgactattgggcagctacaagtga

SEQ ID NO: 21921 - DNA, 364 bp, Homo sapiens
  misc_feature 7, 13, 48: n = A,T,C or G
gatggcncggggntacccagcctctctccctactgctgctacacaagnaccctgagtactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctact

SEQ ID NO: 21922 - DNA, 364 bp, Homo sapiens
ggacggtcatgggacttcagcatggcggtgtttgcagacttggacctgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcata

SEQ ID NO: 21923 - DNA, 100 bp, Homo sapiens
  misc_feature 7, 15, 28, 30, 32, 33, 41, 52, 61, 63, 67, 75, 76, 79, 88,99: n = A,T,C or G
ctatgtnttacgatncgcaaggtattgncntnntttagtcncgtctcgagtnagctaatgngngttncagccggnntgnacaggccgnttttgcttacnt

SEQ ID NO: 21924 - DNA, 100 bp, Homo sapiens
  misc_feature 6, 9, 11, 24, 27, 29, 31, 32, 36, 41, 42, 43, 44, 48, 49,51, 52, 56, 57, 58, 60, 76, 84, 89, 93, 98: n = A,T,C or G
accganctntnctgacctcggtgntgngncnnctcntgcannnnatgnntnntaannntnacaccgtgtctggacncgagcatnggcanattngctgntc

SEQ ID NO: 21925 - DNA, 377 bp, Homo sapiens
  misc_feature 8, 46, 51, 76, 85, 130, 143, 191, 198, 274, 279, 326: n = A,T,C or G
aaggcganaacctgcatgacaactcctacaaggaggattacacgtnacacnaggagctgaaacagccagtgcagtntcagagatncccaatatcagacaattctgggtgtgatgccccaggtaacagtantccatctttaagngttccctcttcagctgagtcagaaaagcaaacaagacaggctccaaancggaagnctgtaagaagaggaagaaaaccacctttactgaaaaagaaacttcggagctctgtagctgcccctgaaaaatcatnttccnatgattcagtagatgaagaaacagcatgaatctgacacatctcctgnggtagaaaaagagcaccaaccagatgtagacagcagtaacatttgtactgt

SEQ ID NO: 21926 - DNA, 358 bp, Homo sapiens
  misc_feature 186: n = A,T,C or G
ataagggagaagcttcagaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcngcatattacgaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttgaaccg

SEQ ID NO: 21927 - DNA, 372 bp, Homo sapiens
agtcggagaagaaaccgctgctgcagcaagtcgaccacctcaagcaggagatctccaggctggtgcgcgagagggacgcgtacaaggagaaatacgagaagttggtgagcagcggcttccgagaaaacggctcgagcagcgacaacccgtcctctcccgagtttttcataactgagcccactcgcaagttggagccatcagtgggatacgccacattttggaagccccagcatcgtgtacttaccagtgtgttcacaaaatgaaatttgtgtgagagctgtacattaaaaaaaatcatcattattattattattttgcagtcatggagaaccacctacccctgacttctgtttagtctcctttttaaataaa

SEQ ID NO: 21928 - DNA, 100 bp, Homo sapiens
  misc_feature 4, 12, 30, 33, 40, 42, 43, 45, 60, 61, 62, 65, 66, 67, 70,85: n = A,T,C or G
tgcnctatggtnacaccactgcactccaancanggcgtgngnncnagaccctatttctannnctnnnttnaaaaaatgccacaanatgctagttcatata

SEQ ID NO: 21929 - DNA, 385 bp, Homo sapiens
  misc_feature 2, 4, 6, 8, 23, 29, 41, 42, 44, 60, 66, 308, 315, 318, 338: n = A,T,C or G
cntntngnttgaagatgatagcncccaanattttaagtggnntnggcacccaaacacttntgcttncacttaagtgcctggcccgcaatactgtaggaacaagcatgatcttgttactgtgatattttaaatatccacaggactcactttttccaaatgatcctagtaattgcctagaaatatctttctcttacctgttatttatcaatttttcccagtatttttatacggaaaaaattgtattgaaaacacttagtatgcagttgataagaggaatttggtataattatggggggggattatttttnatactgnatntgccaaagctttactactgnggaaagacaactgttttaataaaagatttacattccacaacttgtaa

SEQ ID NO: 21930 - DNA, 360 bp, Homo sapiens
attctagcattgggatgaaacgttgccatcctaggagaagacatgggttcttatggataaacgacttagccttcagccagctttagcagtgtttgggagcagtgtacagacatgcaccatttcccaccttcctctgtgaaatgctgcagtattatatggtgctttgaaaacatgccctgctggagtgctttgggaaaaaatagcctgtttcaaagtttcattaattatagtcatgtaaaacaactgattgcctctatcatttattttaagaaactttcctaacaaaatagccctccgtctgcctctgtagtgaactctgtggacaaggacattaaatgactgtgcattaaaagttacatc

SEQ ID NO: 21931 - DNA, 366 bp, Homo sapiens
  misc_feature 12, 104, 157, 208, 294, 360: n = A,T,C or G
ggcggaccggantaccttgcgtgcagttatgtcggcgtcggtagtgtctgtcatttcgcggttcttagaagagtacttgagctccactccgcagcgtctgaagntgctggacgcgtacctgctgtatatactgctgaccggggcgttgcagctcggntactgtctcctcggggggaccttccccttcaactcttttctctcggggttnatctcttgtgtggggagtttcatcctagcggtttgcctgagaatacagatcaacccacagaacaaagcggatttccaaggcatctncccagagcgagcctttgctgattttctctttgccagcaccatcctgcaccttgttgtcatgaactntgatgg

SEQ ID NO: 21932 - DNA, 400 bp, Homo sapiens
  misc_feature 6, 11, 32, 52, 54, 55, 58, 59, 61, 124, 131, 133, 146, 200,204, 205, 223, 270, 286, 304, 319, 343: n = A,T,C or G
ccaagnaactntattgcaccctttttcaagcncagcaatatggaaaaggacngnnggnngncagcaccaacaaagtaacatgcatatttctgaaatccaataaaaattaccgggcattcagggngggggcngnggctcacacttgnaatcctagcattttgggaggctgaggcaggaagattgcttgagcccaggaattnaggnncagtctggacaatacagngagacccccatctctggaaaacaatttaaaaagttgctgggattggngcggcacacctgtagncccagctgctcaagaggntaaggggggaggatngcttaaatccaggagtttgaggtngcatttgagctatgattgggccacttcactccagcctgagggacagcaagaccttgg

SEQ ID NO: 21933 - DNA, 301 bp, Homo sapiens
  misc_feature 11, 60, 297: n = A,T,C or G
gattggaaagnaggattccctttggtgtttggtcttctacttagaaaaacctattgcagntagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgatnaaga

SEQ ID NO: 21934 - DNA, 257 bp, Homo sapiens
  misc_feature 18, 63, 76, 78, 134, 176, 177, 185, 219, 226: n = A,T,C or G
gggaaagcatttataggnagaggcgacaaacctaccgagcctggtgatagctggttgtccaanatagaatcttagntnaactttaaatttgcccacagaaccctctaaatccccttgtaaatttaactgttagnccaaagaggaacagctctttggacactaggaaaaaaccttgnngagagagnaaaaaatttaacacccatagtaggcctaaaagcngccaccnattaagaaagcgttcaagctcaacacccact

SEQ ID NO: 21935 - DNA, 387 bp, Homo sapiens
  misc_feature 29, 209: n = A,T,C or G
ggaggaaagagtgagggttccaacttttntgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtnggaggatgacttctctaatcagttacgagctgaactagagaaacatggttataagatggagacttcatagcatccagaagaagtgttgaagtaacctaaacttgacctgcttaacacattctagggcagagaacccaggatgggacactagaaaaatgtgtttatttcattatctgct

SEQ ID NO: 21936 - DNA, 369 bp, Homo sapiens
atttattaaatagggaatcctttccctattgcttgtttttgtcaggtttgtcaaagatcagatggttgtagagtgtggagttatttctgaggcttctattcttttccattggtcataaaaaccctagaagaaaaactagaaaataccattcaggacacaagcatgggcaaaggcttcataactaaaacaccaaaagcaatggcaacaaaagccaaaattgacaaatgggatctaattaaactaaagagcttctgcacggcaaaagaaagtatcatcagagtgaacaggcagcctacagaatgggagaaaatttttggaatctatccatctgacaaagggctaatatccagaatctataaagaacttaaa

SEQ ID NO: 21937 - DNA, 372 bp, Homo sapiens
  misc_feature 3, 9, 18, 24, 67: n = A,T,C or G
gancttttnctactaganggttantttgatctgctttagcctttatgctaaagtttgcatcttttcnattaattctgagtccttgttatctagttttagtgacatttataaacaacactgattcctcaaatcacatttgagcacacttaaggcagagttacttctactaaccatcctgtaagaccattttgtttaagcgtcaagtgtcaccaattactaactaataggccataacctctctgactcagggattgaagttacgttccctagggcatgtcttccagaactttttctcttatacttctcttagtgctttctttactatgtaaaccaggggtatccaatcttttggcttccctgggccacattgga

SEQ ID NO: 21938 - DNA, 384 bp, Homo sapiens
  misc_feature 3, 18, 202: n = A,T,C or G
gancttttattactaganggttattttgatctgctttagcctttatgctaaagtttgcatcttttcatattaattctgagtccttgttatctagttttagtgacatttataaacaacactgattcctcaaatcacatttgagcacacttaaggcagagttacttctactaaccatcctgtaagaccattttgtttaagcgtnaagtgtcaccaattactaactaataggccataacctctctgactcagggattgaagttacgttccctagggcatgtcttccagaactttttctcttatacttctcttagtgctttctttactatgtaaaccaggggtatccaatcttttggcttccctgggccacattggaagaagcagaat

SEQ ID NO: 21939 - DNA, 369 bp, Homo sapiens
  misc_feature 35, 50, 54, 58, 155, 269, 280: n = A,T,C or G
aaacccgggtggggcggagcgcctggttttttgcngggagcctaggatcnaagnccgntttgcagaacactgaaatctatggactctaaaatggacttcatttaaagaaacccacggaccattaatggacaaaaacatgagtcaatatgtattgnggcattcaaatcctagcactctgggagagcatcaagtaccacgtttttgaagatcatggcctatcatcattatgcattcaagatttgagtttgaataacctcatcaagacttanatcttcttcanaagcttcaagtctcatctgcattaaagctctccaatgaaccctctcacaaaagtacaagcttaaaggggctaaaatccattaatacatt

SEQ ID NO: 21940 - DNA, 397 bp, Homo sapiens
  misc_feature 5, 13, 55, 344: n = A,T,C or G
ggaangtcacccnaccctcctgaaaactgcagcttccttctcaccttgaagaatnatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggngcctggtacatgtgcagaaatgggatggaaaatcaaccaccataaagagaaaa

SEQ ID NO: 21941 - DNA, 140 bp, Homo sapiens
  misc_feature 14, 30, 46, 53, 63, 73: n = A,T,C or G
ctacttgtgaggcnggaggcagggagaatngcttgaacttggggcngggggtncggaggggcnggaggatgcnggatagccgagatcacgccactgtagtccagcctgggcgacacagcaagactcccatctaaaaaaaa

SEQ ID NO: 21942 - DNA, 137 bp, Homo sapiens
  misc_feature 5, 13, 45, 54, 62, 64, 70, 83, 95, 118: n = A,T,C or G
agcgncgcgagangtttcctctcgcctaagtggacgcgccccctntaagagcancgaatganangggagncggtcccggtgtnctcgggcccagnagatggagaagcgctgaccaatngccactggacatacttgaa

SEQ ID NO: 21943 - DNA, 141 bp, Homo sapiens
  misc_feature 5, 14, 27, 49, 51, 62, 63, 105, 121: n = A,T,C or G
aagcngacagcatncggaccgagatgnctcgctccgtggccttagctgngntcagcgctacnntctctttctggcctggaggctatccagcgtactccaaagatncaggtttactcacgtnatccagcagagaatggaaag

SEQ ID NO: 21944 - DNA, 284 bp, Homo sapiens
  misc_feature 11, 43, 49, 270, 275: n = A,T,C or G
aaggaactgangttcccaagtggatcagcatcatgaccgagcngagcgngccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggcgcgagataaggcctgatcagaatcatggcctcccgcagngaagnggcatgttg

SEQ ID NO: 21945 - DNA, 400 bp, Homo sapiens
  misc_feature 11, 30, 31, 57, 91, 111, 130, 166, 368, 398: n = A,T,C or G
tggggaaggcncccgctatttgaaaatctnnatttgggccacattggttggaagatnaaaatatataagcaatagtccctgaacatcattnggcctgaactaggctagagnttctcttaatcaaaataanaacgatgatttttccatgccaaggagtggtgcatancatgaagtagatttatgtacacattaaataaacttttacattttaatgtaccaatttgcaatttttttttctattcaccaaaatattccagataacggttatcagtttttgattctacacatacttcaaatactattaatgcaaaatccttctttagaaatgtacctaattccaatggttcactttatcaggcgaagacatncctttggataatccgggtagggggtatgangc

SEQ ID NO: 21946 - DNA, 400 bp, Homo sapiens
  misc_feature 14, 15, 34, 38, 356: n = A,T,C or G
gcgatactggcttnntagtggaatacctggaaantctntcaatgtgtcatccctggttgagctggatctgcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaccagtcttccaccggatatgtatgaatgctacgtgttgctaacgaagcactcttaattaatatctgtatcctggacaatattttatggtatggttttctgggggcagtttcatagnatccatatttatactggttatacttccatgaatttaaaatctga

SEQ ID NO: 21947 - DNA, 373 bp, Homo sapiens
  misc_feature 57, 115, 116, 146, 235, 272, 322: n = A,T,C or G
gaaagtaccccacatgtgactaatctgtgggagcagtttattccagtatcacccttngtgcagccacaccaggactgtgttgaagggtgtttttttttttttaaacgtaataccnnctcatcttttcttcttacacagtgtctganaacatttacattatagataagtagtacatggtggataacttctacttttaggaggactactctcttctgacagtcctagactggtcttntacactaagacaccatgaaggagtatgtgctcctatnattcctggctttgtgctctgcaaacccttctttagcccttcacacatcgnactgaagaatatgatgctgaaggatatggaagacacagatgatgatgatga

SEQ ID NO: 21948 - DNA, 100 bp, Homo sapiens
  misc_feature 9, 18, 27, 34, 40, 58, 65, 68, 71, 92, 93, 98: n = A,T,C or G
ccagcgacncgaaagatngaggcaacngacgcanccagcngagaagggaaagtcaaancacgcgnagngcnatgagtatgggagtcatcganncgacngt

SEQ ID NO: 21949 - DNA, 160 bp, Homo sapiens
  misc_feature 4, 61, 90, 102, 115, 118, 122: n = A,T,C or G
aaangagatattccaggggacgggatagcaccctaggaagacaaattcctatagtagcatntgaaaattctaaaatctaacagagagggnagacactataanccattttattagnacnaggngggggaatgataatatatttaaagatatcagctacatg

SEQ ID NO: 21950 - DNA, 229 bp, Homo sapiens
  misc_feature 149, 184, 198, 224: n = A,T,C or G
agggtttgaccggcttagcactgagggcagtgaccaagagaaagaggatgatggaagtgaatcagaagaggagtattcagcacctctgcctgcgctcgcaccttcctcctcctgaaaaccaagctttgatttaagattgagtaagattnacccagaatgcaagattcctttccctttagcacgnttaaaggtctgggnatttaattggaaactggactagctgnggggg

SEQ ID NO: 21951 - DNA, 140 bp, Homo sapiens
  misc_feature 21, 49, 61, 70, 75, 91, 92, 108, 109, 118: n = A,T,C or G
gaataggaataaagctctagntcttaacaaccgacactcctacaagatntaagaaaaaagnttacaacanaatcnagtttacagaaaaatnntgggctaagaatactnnttaaaaggnatgttgaatactattaaaactg

SEQ ID NO: 21952 - DNA, 164 bp, Homo sapiens
  misc_feature 32, 46, 65, 86, 101, 109, 111, 116, 124, 126, 150: n = A,T,C or G
acaaaaagttaaagaggaaaaagcaagttgcnccagaaaaacctgnaaagaaacaaaagacaggngagacttcgagagccctgcancttctaaacagagcnggagcagnangagangataacangnccagatggggaaaatgagggacgntagggggcgcgatt

SEQ ID NO: 21953 - DNA, 100 bp, Homo sapiens
  misc_feature 17, 76: n = A,T,C or G
gctagaagatgaggctnctgggataggcccagaagtccggatgaccgcgacttcgagccctccctaggcccagggngccccttccgctggcaatgccatc

SEQ ID NO: 21954 - DNA, 398 bp, Homo sapiens
  misc_feature 5, 24, 44, 77, 78, 81, 105, 113, 117, 211, 276, 292, 336,341, 365, 389: n = A,T,C or G
aacgncaaacgatcagactctagntcccatgctgatagcgactnttttagctattctagctcttaacactgtaatanntgnttttgctcatctggatatgaggcngtgtctgngaancatgacgggtagttctcagcatgccaaaattaacctgcagctttacctaacaaacatttggacttactttgctttcttgagatatttccccccntgggcatttcggtggcaggaagctcattttctaatctgaaatcaggagaaaaggaagaaaaactngcaataaagcttaagngggtgggacagggtgctaaataaaactggctcaactgaaggttngagantcttgagaaacactgagaattctnacaaaagaaatttccttatgatanaggaaacat

SEQ ID NO: 21955 - DNA, 258 bp, Homo sapiens
  misc_feature 9, 17, 32, 33, 35, 189, 246: n = A,T,C or G
tccaagggnacgcaaangggaggctctcaggnntnagccttgcaggatcaagagaacacgtacagtgtaaagaattacccactaattgaaatgagaagtatagagtagatatgtccatagaaaaggctgagagagctcaaaatccctagcttggctggttggagaaagtattcctcacccaaagacagnaaagactgaagataactgcttcttctaatgcaaaaacagcagtgcaagacggtaagnaacacaatcctg

SEQ ID NO: 21956 - DNA, 100 bp, Homo sapiens
  misc_feature 4, 24, 30, 36, 48, 54, 88, 94, 99: n = A,T,C or G
aagngtttagcttagaatggcaangggaangatagngtggacccgaantcaagnggaagtgcattaattgtaataaaaaattgtatcnaatcangtggnt

SEQ ID NO: 21957 - DNA, 124 bp, Homo sapiens
  misc_feature 10, 36, 44, 55, 56, 61, 72, 100, 101: n = A,T,C or G
tcagaaacgngaagccagcaattgtttcgcaggttnggcatttngaaaacaaatnngccgnggaaacttcancccgttcttgaacagtcaagaaaaacannattgaggaaaattaatatcacag

SEQ ID NO: 21958 - DNA, 110 bp, Homo sapiens
  misc_feature 13, 16, 39, 93: n = A,T,C or G
atacacctggggncanaagaatacaggaaaacgggggcntttacaagcatcttgtgaggaaaacacaataccctacgcacccccactcagaanaaaaaaaccaaccactg

SEQ ID NO: 21959 - DNA, 108 bp, Homo sapiens
  misc_feature 15, 23, 42, 47, 58, 62, 71, 72, 75, 94, 99, 104: n = A,T,C or G
tcaggcttcaacatngaatacgncgaaggggttttttgcccnatgcntaacaggggangacncaaacaccnntanaataaacaccctaacaacnacaangttcnaagg

SEQ ID NO: 21960 - DNA, 124 bp, Homo sapiens
  misc_feature 45, 69, 73, 89, 109: n = A,T,C or G
tcaatcagcagttccaggaaccatttgtagcgtttggtgattganccaacaagaacaagacccgcaggngaangcgaatcttggcgccnttaggacacacccaaaggcnacaaacctcctgatg

SEQ ID NO: 21961 - DNA, 100 bp, Homo sapiens
  misc_feature 2, 16, 29, 30, 34, 36, 51, 54, 61, 72, 98: n = A,T,C or G
antcatcccagggctnaagttatatttcnngganancatggcaactacacnggntgtcgcntaccaggacgnagattaggcatcttaggactgaagtnaa

SEQ ID NO: 21962 - DNA, 173 bp, Homo sapiens
  misc_feature 2, 7, 81: n = A,T,C or G
gnacgantccggagagggagcctgagaaacggctaccacatccatggaaggcgaagaaaagaatagagaagatagggaaantagaagataaaaacatacttttagaagaaaaaagataaatttaaacctgaaaagtaggaagcagaagaaaaaagacaagctaggaaaaaaaa

SEQ ID NO: 21963 - DNA, 397 bp, Homo sapiens
  misc_feature 9, 12, 91, 336, 351: n = A,T,C or G
ggaaagganccnactaatgaagaaatgaataataaattttgacactgaaaaacattttattaataaagaatattgacatgagtataccagngttatatataaaaatgtttttaaacttgacaatcattacactaaaacagatttgataatcttattcacagttgttattgtttacagaccatttaattaatatttcctctgtttattcctcctctccctcccattgcatggtcacacctgtaaaagaaaaaagaatcaaattgaatatatcttttaagaattcaaaactagtgtattcacttaccctagtcattataaaaaatatctaggcattgngggatataaaactgntggggtattctacaacttcaatggaaattattacaagcagattaat

SEQ ID NO: 21964 - DNA, 397 bp, Homo sapiens
  misc_feature 11, 89, 115, 349, 379: n = A,T,C or G
gaaacagaccnaaacaatgaattgcattgtacttatttacaatagatcctaagttattgatgattaacctgtttttctaagtaaagtcnagcccagctctattgcagcacctggnacctcttagaggctcaataaatacctcctgagtgagcgctctgtgttccatgccagatgcaaggtttagggacagcttaatgaggaaggactttctaatctggaggaaattggggagcccttgcaagggtgtagcagaggcagtaagatgttagacagcaggagacctgggatgcatcctcaattcatttgctagctagatgcacttggaaatgcactcccttctctgattctnaggttttttaagtttgccaaatattaaagnaactcccatctgaggctc

SEQ ID NO: 21965 - DNA, 400 bp, Homo sapiens
  misc_feature 65, 378: n = A,T,C or G
gaaatgaccctgcctgttctgcttcgaagtattcaataccgctcagtattttaattgaagtgatnctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagntgataagaggaatttgggataa

SEQ ID NO: 21966 - DNA, 395 bp, Homo sapiens
  misc_feature 11, 19, 41, 65, 89, 119, 121, 171, 212, 245, 261, 271, 279: n = A,T,C or G
atggccgaaanccctatcnaggaagacttcaaattttttgnaaatagcgattataaaggcccctntattttgaatgtacctctattagntgcaattgagtaattctagacataactggntngactctggccaactctgtatttaggccatttgttacagttccttcatgcnttacttactgttaaaactgtaccttttgcgatttcacaggnggcaccttctgccatgagcagagaactgatgcnacttgttttgctgctnggaagcactntaaaaaantttttgattaatgaagaaagtaaaaccataaacatttgccaaaaattcatgccccagtattagcaatgaattagttgcattggtttgaggaaggcacatattggagggaaatcttg

SEQ ID NO: 21967 - DNA, 398 bp, Homo sapiens
  misc_feature 2, 8, 57, 64, 213: n = A,T,C or G
tntggccnaaaacccaaaatttatttacttgatgtttttggagaggaaattgagggnggccccnagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggngggtccaccttcatcagaatggcgtggaaatgctcatggaaaatgaaggaccccagtcaggaaccaacaagccaagggaaacctgccagggccctgagtgtcctggcctccacacgtttctcttgggggcccattcaggctttaactgcctgcttttgtgcagagatgctgggacggaaagagga

SEQ ID NO: 21968 - DNA, 342 bp, Homo sapiens
  misc_feature 3, 15, 36, 219, 220, 238: n = A,T,C or G
ttnttatggccgganacccatttagtttgaaaaagnacgttttttggaaagattaattgggagaggccggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagnnggaagcagaagaaaaaangacaagctaggaaacaaaaagctaagggcaaaatgtacaaacttagaagaaaattggaagatagaaacaagatagaaaatgaaaatattgtcaagagtttcaga

SEQ ID NO: 21969 - DNA, 100 bp, Homo sapiens
  misc_feature 15, 30, 35, 37, 38, 43, 44, 48, 65, 71, 79, 87, 88, 89, 90: n = A,T,C or G
gactctttggggaanaccccgcaatcgggnggggnannagacnncccnccagaaagaggcaattntttggnatttctcnctacaaannnnccggggggga

SEQ ID NO: 21970 - DNA, 304 bp, Homo sapiens
  misc_feature 5, 9, 30, 73, 79, 83, 129, 134: n = A,T,C or G
cccanggcncttttttttatggccggaatncctataaagtatgggtattatgtttttcagttactcaaatggnactgtnccgntgatatttgaccccaaataacatcgtctgtactttctgttttctgnattgnatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattg

SEQ ID NO: 21971 - DNA, 375 bp, Homo sapiens
  misc_feature 19, 23, 27, 28, 86, 87, 186, 243: n = A,T,C or G
atttttgacccagggcccntctntttnntatggccggaaacccaatttactgtccaatcttctttttttatgcagttgaacatatnnagccgggaaatattatgaataaagatatttcgaacacttatgtgcgtgtatcttgatgcacataagcgtacatttttgtgggggaatatacctaggagnggattcatgggtcatgcatatctttaacttcagcagataagcagaaagcattcgacnaagtggttgagaaggtaatgagaattcctgttgctccacgttctaataaaaaacacttggattttctttcttttttttcaaatgacagggctctataatgggatcattgcatttctctgattactaatgaga

SEQ ID NO: 21972 - DNA, 400 bp, Homo sapiens
  misc_feature 20, 25, 62, 89, 91: n = A,T,C or G
tttttttacccagggccttnttttnttatggccggagacccgggaggagaaattaaggaaanttttggagattgcacaggaacgacagncncagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggac

SEQ ID NO: 21973 - DNA, 304 bp, Homo sapiens
  misc_feature 8, 28, 29, 52, 54, 55, 57, 60: n = A,T,C or G
agtccagnaaaatgactgatgtactaanntcagtaaaaattgttgaaaatgngnncnggncagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccggtttttaattgccatgagccaaatacttcttggtatacaattgatccatttattttaatg

SEQ ID NO: 21974 - DNA, 322 bp, Homo sapiens
  misc_feature 51: n = A,T,C or G
ttccgggaaagagtttttgagagtcttaccaggagagtatggtcagctttngcttcccataccccaaattgtgaggcctttacttgtggcattgtgaaggaacaagtgctcaaaggcactttgagcttgttgaatcaactagtttttggttaaaagtgctttataatatatttctgctcttacgagaattaaatgaaaaggctcaagagagaaaaatgagaagtttaagatgggtctagaacacagactacgacactgtaagctaacacaaaagctgggctaccctgcagtcaaattcttacagcaacattaggatcagaga

SEQ ID NO: 21975 - DNA, 149 bp, Homo sapiens
  misc_feature 4, 18, 46, 64, 69, 71, 135: n = A,T,C or G
tttntttatggccaaaanccagagaatgtcattaaatacttttttntgcatgacagtttggctngaacncncagcaggaaaattttgcaagttacataattgtatatacagtaggttttcttaagtctcttcggntcatcctttgtaat

SEQ ID NO: 21976 - DNA, 400 bp, Homo sapiens
  misc_feature 7, 13, 37, 38, 86, 91, 92, 135, 172, 175, 199, 261, 307,356, 390: n = A,T,C or G
ttttttnacccanggccctttttttcttatggccganngcccaaacaaacaggattaaactatttttgggtccttcagccctctanaaccnnagggcttagcctgcaggcttccttgggctttctctgtgtgtgnagttttgtaaacactatagcatctgttaagatccagngtncatggaaaccttcccacatgccgngactctggactatatcacgtttttggaaagcagggttcctctgcctgctaacaagcccacgnggaccagtctgaacgtctttcctttacacctatgtttttaaatagncaaacttcaagaaacaatctaaacaagtttctgttgcatatgtgtttgngaacttgtatttgtatttagtaggcttctatatngcatttaact

SEQ ID NO: 21977 - DNA, 371 bp, Homo sapiens
  misc_feature 27, 28, 54, 203, 205, 207, 255, 276, 306: n = A,T,C or G
aaccaaaggttgactatataagtaggnntttagcctgctgcaccttcacgggcnttcagaatgcggggtcctgaaatattttcttacgtgtatatatggtagcatgaagctttgtaatcattgttttgagagattttttttttcaaaattaaagtatttcttttgatattaatttttattattttcttgaagttggttgtgtnangnaaatggcttcagtcttctgtaaaattgcttttttttcttttaaatgcngtccttctatggctaagacgncttcaagatccttgtacactgtttatatgngcaataaaatgcatggccagctgacagtatcgtcaggggacagaaatgtatatagggcaaatatc

SEQ ID NO: 21978 - DNA, 389 bp, Homo sapiens
  misc_feature 4, 5, 57: n = A,T,C or G
attnnttcgggatcctcctcttgttaggtttttgagacaaccctagacctaaactgngtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctggtgaatctactctgttccttggctagaaaaaattataaacaggactttgtagtttgggaagccaaattgataatattctatgttc

SEQ ID NO: 21979 - DNA, 279 bp, Homo sapiens
  misc_feature 5: n = A,T,C or G
caagncaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggggttttctcccatcctttccctttaaccctcagtatcaagcacaaaaattgatggactgataaaagaactatcttagaactcagc

SEQ ID NO: 21980 - DNA, 145 bp, Homo sapiens
  misc_feature 1, 3, 27, 32, 34, 36, 38, 45, 48, 49, 56, 63, 70, 71, 72,93, 109, 119, 124, 142: n = A,T,C or G
ncnccaagtattatcaacaatgccgtnttttntngnanacgccangtnnttattangccgtgntccaaannnatcgtaccgggttctcactgngatgatgaagcatggntactttggcnaattngaaatcattgatgaccanaga

SEQ ID NO: 21981 - DNA, 399 bp, Homo sapiens
  misc_feature 6, 15: n = A,T,C or G
ccgggnatttcttgnacatttactagggtgttgcgtgctgtgctaagtaaattttaagtctttcagttttatagatacggaaaacaagggtgactctttaccacaggatgaataaagaactaagtaatatgggaaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatcc

SEQ ID NO: 21982 - DNA, 239 bp, Homo sapiens
  misc_feature 27, 28, 53, 54, 56, 124: n = A,T,C or G
gagccattgaggcagccagcgcagggnnttctgctgagggggcaggcggagcnngnggaaaccgcagataagtttttttctctttgaaagatagagattaatacaactacttaaaaaatatagncaataggttactaagatattgcttagcgttaagtttttaacgtaattttaatagcttaagattttaagagaaaatatgaagacttagaagagtagcatgaggaaggaaaagataa

SEQ ID NO: 21983 - DNA, 359 bp, Homo sapiens
  misc_feature 1, 201, 340: n = A,T,C or G
nacacataaaagacagatgtgcatcatctgtatggtgcacaccttttcaggttatggccctgtgtggggtaaacatgtccatatgtatggacatgttttttgggggtatatatctgggcaggagtggctttttaatagaagtccagatgctggcttgtaaaacaccatctcatttgggattctcaaatgcgggttcctggnccatttgcttcagagtcacctggggaatgtgttaaagataaagatcctgggccgggcgcgggggacttacgcctgtaatcccagcactttgggaggccgaggcaggtggatcacctgaggtcaggagttcaagaccagnctggccaatgcgggggaaa

SEQ ID NO: 21984 - DNA, 349 bp, Homo sapiens
  misc_feature 52, 141, 232, 246, 324, 340: n = A,T,C or G
aacatacaaaggcatgtactgttttgtgttgatctatgtaaaagaatacagntcttttttacataattagtgaaattttattttttattaggaaacactaaatagtgtaatatttcttttgcttttaaaaaaattcctggnagcaaatcaagataaataattgcttcattttcttgagcaatactgaagcaggatgaagtaagaggaatgcattcatttaaacatgctttgntttatgaattttgnctcttttttggtctctttttcttatattcaagttacaaatgtacaagtatccttactaagagggctccttttgtattngacatatataccggtntgaaaatac

SEQ ID NO: 21985 - DNA, 100 bp, Homo sapiens
  misc_feature 3, 5, 29, 36, 37, 53, 65, 73, 75, 77, 83, 88, 93, 94, 98, 99: n = A,T,C or G
ctntntggcgcggggtcttgtgagctganaaaaaannaaaaaaaaaaaaaaanacaaataaaaangttttgangnanaaaaanaaaantttanntttnnt

SEQ ID NO: 21986 - DNA, 363 bp, Homo sapiens
  misc_feature 100: n = A,T,C or G
caaccatgaaaataatattgattgaagaggtgcctaggcacatgtgatttagtcagtaagattggagccaagctctacttttctcagtgttatatttggntatgaatgcatttacctcaggtatttaatatatttgctttttaatatatgtcatatagcaaactggattaataaatagaaacacatagtgtagtctttaagcatatgtgtgattataaaaataaatccattttgcattcacagaatagaaaataccctttaattagtgaaattgattacatatcgtatatagtaatgagcttcagctagatgcaagccctcattggatcaaagtcagtttagataagggcagctgaaggtcac

SEQ ID NO: 21987 - DNA, 187 bp, Homo sapiens
  misc_feature 19, 64, 67, 68, 71, 75, 76, 77, 79, 163: n = A,T,C or G
ttattatggccggaagatncctctgtgtgtcacgttttcatagtatccatattttattactggngannacngggnnngnattttaaaatctgagggaaatgttttgtaaacatttattttttttaaagaaaagatgaaaggcaggcctatttcatcacaagancacacacatatacacgaatagaca

SEQ ID NO: 21988 - DNA, 364 bp, Homo sapiens
  misc_feature 1, 54, 206: n = A,T,C or G
ngggccaaggggagtagctattgggaacagggaactgtcctacactgctattgntgctacgtgtatcgagccttgattgctcctagttatatacagggtctatcttgcttcctacctacatctgcttgagcagtgcctcaagcacatccttattaggaacatttcaaaccccttttagttaagtctttcactaaggttctcttgcntatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaattt

SEQ ID NO: 21989 - DNA, 400 bp, Homo sapiens
  misc_feature 5, 14, 35, 46, 72, 74, 75, 76, 77, 222, 321, 360: n = A,T,C or G
ttatnatggcccgnaaggccatagaaatgtacagnaaaaagtcttnctacagggttcccttcattaataacngnnnnttcggcacctaattacttagatgtctacaataataaagctgctgtgttaaagtatgaaaataatgtgatgatatgggagcagctcatatcataatgtctgaaatatttatttattcatctgtctaattcacccttttcttttaanagccccagtttcagaatgtgaatcagggatattcctgttactaaaatggaaatgtaattccaagtttcttttttaattttttaaatttatgtcattgtnttggactatgcttatatttaaaactacttaatttagagntaactacctgcttaggccccagaacattacttatgccctt

SEQ ID NO: 21990 - DNA, 371 bp, Homo sapiens
  misc_feature 4, 207: n = A,T,C or G
tgcnggaagctaaattactccactggaatggaagacataaaccttgggacttccctagtgttcacaacgacttatgggaaagctggtttgttcctgaccctgcagggatatttaaactcaatcaccatagctgatataactctacccttaaaatattccctgtatagaaatgtggaattgtccctttgtagccaactataacattgntctttatgaatattacctttgatacatatgatccacaatataaaaaccaaaaactactgtgtgcaaattataccttggaccatataggcattgattaacttctttaagtacatgtgataactatggaaatcaagattatgtgactgaaaaacataaaggaagag

SEQ ID NO: 21991 - DNA, 163 bp, Homo sapiens
  misc_feature 3, 139: n = A,T,C or G
ganctcttagcggtggatcactcggctcgtgcgtcgatgaagaacgcagctagctgcgagaattaatgtgaattgcaggacacattgatcatcgacacttcgaacgcacttgcggccccgggttcctcccggggctacncctgtctgagcgtcgcttgcaaaa

SEQ ID NO: 21992 - DNA, 383 bp, Homo sapiens
  misc_feature 6, 27, 28, 51, 55, 58, 87, 118, 184, 207, 266, 268, 318: n = A,T,C or G
gggccntctgctgagggggcaggcggnnttttgaggaaacccagaataagntttnttntctttgaaagatagagattaatacaactncttaaaaaatatagtcaataggttacctaanatattgcttagcggttaagtttttaacgtaattttaatagcttaagattttaagagaaaatatgangacttagaagagtaccatgaggnggggaaagataaaaggtttctaaaacatgacggaggttgagatgaagcttcttcatggngnaaaaaatgtatttaaaagaaaattgagagaaaggactacagagccccganttaataccaatagaagggcaatgcttttagattaaaatgaaggtgacttaaacagcttaaagttt

SEQ ID NO: 21993 - DNA, 363 bp, Homo sapiens
  misc_feature 221, 224, 262, 274, 315, 358: n = A,T,C or G
aagcagggagttcatgcaacacctgagtaatctgattaatgcactgaataagtctggattaagtgaccttgcagaaagtctaactaatgacaatgagacaaatagttagcttcttttttttttctttttattaaaactgggatagattttgttaccaagcagcatttgataagaggtccacctggttttggtaaacaataaacatttttataacaattgtngtncagtcggctggggctctgagaacaatagaacacatatnggctcaaaccanagtttggggaggttgggttgagataatgacctaaacgaagngacctcaagatcacaaaatatatttttttgttaagtagatgtntttat

SEQ ID NO: 21994 - DNA, 360 bp, Homo sapiens
  misc_feature 13, 28, 245, 294: n = A,T,C or G
aataccaactgtnaatgaaaaccttganaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatccgtatcctggaacaatattttatgggntatgtttttctgtgtgtcagttttcatagtatccatattttattactgnttattacttccatgaattttaaaatctgagggaaatgttttgtaaacatttattttttttaaagaa

SEQ ID NO: 21995 - DNA, 381 bp, Homo sapiens
  misc_feature 4, 27, 28, 29, 378, 380: n = A,T,C or G
ggancttctatctaccagaggtgaatnnnaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagngng

SEQ ID NO: 21996 - DNA, 364 bp, Homo sapiens
  misc_feature 54: n = A,T,C or G
aagcaaaatagtgagataatgaattcactgattgaaagttggtgccgtaacagngaagttaaaagatatctagaaggtgaaagagatgctataagatatccaagagaatctaacaaattaataaaccttccagaggattacagcagcctcattaatcaagcatccaatttctcgtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgc

SEQ ID NO: 21997 - DNA, 364 bp, Homo sapiens
  misc_feature 27, 28, 50, 56, 202, 206: n = A,T,C or G
gatcaatcacagtaatttgtagcttcnntgtttctattgctgtaaatggntacaanctctttgggaggcgatctgggaaaacttactaaaattttaaatgtggacatcctttgattcagcattgcctcagctaagaaactttccttaaaaaaatactttcataagtataatacacacacatgcacacacacgtgtgtatgtntgtngtgtatgaagaatttttttctagccatacattgggagcaatgaaaatgtccagtaatagggaactcagtaagtaaataacagtaatccagtaatatggcatctagaggctctcagcgaccctattgtttcagaacaactttttagttaatttctggtc

SEQ ID NO: 21998 - DNA, 361 bp, Homo sapiens
  misc_feature 2, 14, 32, 50, 55, 59, 60, 63, 207, 209, 291, 297: n = A,T,C or G
gngccctatagctnattggagcagcatttttntgccgccgaggaacaagnggggngggnngcncgcgcgcaacagccatggtttttaaggataccggaaaaacacccgtggagccggagggggcaattcaccgaattcgaatcaccctaacaagccgcaacgtaaaatcctcggaaaaggtgtgtgctgaccttgataagaggcgcngnagaaaagaatctcaaagtgaaaggaccagttcgaatgcctaccaagactttgagaatcactacaagaaaaactccttgtggngaaggntctaagacgtgggatcgtttccagatgagaattcacaagcgactcattgacttgcacagtcctt

SEQ ID NO: 21999 - DNA, 400 bp, Homo sapiens
  misc_feature 5, 12, 30, 55, 77, 82, 86, 114: n = A,T,C or G
gcccnttttttnatgtatggcgcgggatancagtacgaggtcgacgatccctccnttaccatcaaatcaattggccnccaangggnctgaacctacgagtacaccgactacggnggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatacctacgggtcaatgctctgaaatctgtggagcaaaccacagtttcatgcccat

SEQ ID NO: 22000 - DNA, 361 bp, Homo sapiens
  misc_feature 81: n = A,T,C or G
ggagctttaatttattaatgcaaacagcacctaacaaacccacaggtcctaaactaccaaacctgcattaaaaatttcggntggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggt

SEQ ID NO: 22001 - DNA, 168 bp, Homo sapiens
  misc_feature 50, 51, 57, 58: n = A,T,C or G
attcgatataatcttattgaaattaccttatcatgtcttagagcccgggnntatggnnaaaactaatttcttaaaataaagccttcagtaaatgttcattaccaacttgataaatgctactcataagagctggtttggggctatagcatatgcttttttttttttaat

SEQ ID NO: 22002 - DNA, 366 bp, Homo sapiens
  misc_feature 5, 59: n = A,T,C or G
atatnaaggaaggaaaaattgagataattcacctagaattgcctcaatttttgttgagngggcaatgaagctgtttgttgagaaagttagaagtatatttgagaatctgaaagggcttgaaaagttaggatgtagactgggcatggtggctcatgcctgtagtccctgcattttgggatgctgaggcaggtgggttgtttgaactcaggagttcaagaccatcctgggcaacatggtaaaatcccatctttattaaaaatatagaaattagccaggtgtggtggcactcacctgtggttccaggtactcaggaggctgaggtgggagaatttcttgagcccaggaggcagaggctgcagtaagcag

SEQ ID NO: 22003 - DNA, 365 bp, Homo sapiens
  misc_feature 46: n = A,T,C or G
tcgcggcgctgaaaaaactcaacaagtaataaaaaactggtcaagnaagctggccaagaagtatgatacgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaaga

SEQ ID NO: 22004 - DNA, 364 bp, Homo sapiens
  misc_feature 4, 13, 42, 58, 60: n = A,T,C or G
ctantgaacaagnataatgaaccaccaaagccagctcccagnacaagtttccctgccngntaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttc

SEQ ID NO: 22005 - DNA, 352 bp, Homo sapiens
  misc_feature 28, 50, 56, 58, 206: n = A,T,C or G
agtcgtttgctgtgttatatgttagctncgaacaatggttctcatttggntaagcntnaaaatcacctagggagtcggtgcaaaacaaaatatcccagtcccctcccctgaaacactgactcaggaggtttggttgggggccaggagtctgttcctaaatattccaggtagttctggtgcaggtaagtggccctgagacagtatgntgggaaatgctgacgtaaaggtatcagggccgggcgctgtggctcatgactataatcccagctgtttgagaggccaatgcaggaggatggttgagctcaggagttcgagatcagcctgggtaacatagcgagaccccacctctgct

SEQ ID NO: 22006 - DNA, 370 bp, Homo sapiens
  misc_feature 29, 55: n = A,T,C or G
gaaggccttgaggcagccagcgcaggggnttttgctgagggggcaggcggagctngaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttaga

SEQ ID NO: 22007 - DNA, 360 bp, Homo sapiens
  misc_feature 5, 29: n = A,T,C or G
gatcncattttttaaaaaacaacagtggnaaaaaataacaaggcactagtcagatgtgatttttggcagatacttcactcaaagtgctcagggcatccccagaaattataacccctcaaagatgttcagggtacagtaaataaagcaagatacaattattttaatgttcatcctattgattcagttctcttctctgcaaggtcttagtaacagggattttgatctaagtgaaaggtcagctttgaagtaagtgtaaagttatttacaggaaatgaagcaaaaagtgggctttcatgcattttgaaatttctttattattgaggagaaaatgaactgtgtcatcagctgaaagaaaaacag

SEQ ID NO: 22008 - DNA, 372 bp, Homo sapiens
  misc_feature 6, 30, 207: n = A,T,C or G
gattcntcccctctctacaaccctctctcntcagcgcttcttctttcttggtttgatcctgactgctgtcatggcgtgccctctggagaaggccctggatgtgatggtgtccaccttccacaagtactcgggcaaagagggtgacaagttcaagctcaacaagtcagagctaaaggagctgctgacccgggagctgcccagcttctnggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaa

SEQ ID NO: 22009 - DNA, 369 bp, Homo sapiens
  misc_feature 16, 60, 209: n = A,T,C or G
gtccccttcagcggancgcggcggcaagtattgcagtgcaaatatccaagaagaggaagnttgtcgccgatggcatcttcaaagctgaactgaatgagtttcttactcgggagctggctgaagatggctactctggagttgaggtgcgagttacaccaaccaggacagaaatcattatcttagccaccagaacacagaatgttcttggngagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttg

SEQ ID NO: 22010 - DNA, 332 bp, Homo sapiens
  misc_feature 5, 31: n = A,T,C or G
ggagncaagactggacaaagggggtcacacnttccttccatacggttgagcctctacctgcctggtgctggtcacagttcagcttcttcatgatggtggatcccaatggcaatgaatccagtgctacatacttcatcctaataggcctccctggtttagaagaggctcagttctggttggccttcccattgtgctccctctaccttattgctgtgctaggtaacttgacaatcatctacattgtgcggactgagcacagcctgcatgagcccatgtatatatttctttgcatgctttcaggcattgacatcctcatctccacctcatccatg

SEQ ID NO: 22011 - DNA, 275 bp, Homo sapiens
  misc_feature 7, 31, 56, 127, 208: n = A,T,C or G
aatttcnatcttcaacggatactagaaaatnaaaaagacttggaagaagctgaggnatataaagaagcacgtttagtactggattcagtgaagttagaagcctgaaacttttctcgtatggggtggnttttgcattaaatcctggggtccattttacaatccattatttttgaccactgctatgtgttcaagtagtatgagaatgtgnttgtttttatctggttacatatatatttctttgtctaatttaatatgtcaaataaatgagttcatct

SEQ ID NO: 22012 - DNA, 100 bp, Homo sapiens
  misc_feature 6, 7, 18, 19, 22, 25, 32, 36, 44, 57, 71, 72, 73, 74, 77,78, 80, 81, 82, 83, 88: n = A,T,C or G
tttggnnggcggggggcnnttnttntttttgncccncgggctgnccccccccccctnttttcttttttatnnnnccnntnnnnttttncccccccccctt

SEQ ID NO: 22013 - DNA, 378 bp, Homo sapiens
gaatgccccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaa

SEQ ID NO: 22014 - DNA, 336 bp, Homo sapiens
  misc_feature 50, 123, 263: n = A,T,C or G
gtttctgtcaaaaacatatgttcacataaaaatctgcacacatggttatngcagctttattcatttttgccaaaagttggaatcaaccaagatgtcttttaccaggtgactggataaactggnacattgagacaatggattattactcaatgctaagaagaaatgagttttcaagcccccaaaagacattgaggaatcttaaatacatattattaagtgaaagaagtcagtttgaataagtctgtatgttttatgattccagngatctcacattttcgaaaaggcaaaactatgtacataggaaaaagataagtattgtctcacatccattaggag

SEQ ID NO: 22015 - DNA, 377 bp, Homo sapiens
  misc_feature 7: n = A,T,C or G
atttgcnaacttaagttgtgtaaatgtaatttctacttgtgaatctgagctgtagcagcccagagggagctaggcaaactattccagaccaccaactgataagtgatcagattctttgtaatgtaaggattttttaacctgttgattatgggtttgttgatataaatgtaataatgttcacctcgattttcctggagtaacaaccagcggtggtagtagcccacctgcatgaggacggccagtgttaacaatatttttgttctgatcttcttccccatttttgtttcctcaaacaggtttttaggagagtggagatttaaagtcaggatgtggcctttttattttaattatatacttaattcttagaacaagtagaa

SEQ ID NO: 22016 - DNA, 209 bp, Homo sapiens
  misc_feature 30, 118, 121: n = A,T,C or G
ctctccaatagtgataatctgatgctgaantatcaaataaccaatataaagcatatttcttggccttgctccacaggacataggcaagccttgatcatagttcatacatataaatggnggngaaataaagaaataaaacacattaaaaaaaaaaaaaaaaaaaaaaaaaaaaaaaaaaaaaaaaaaaaaaaaaaaaaaaaaaaaaaaaa

SEQ ID NO: 22017 - DNA, 183 bp, Homo sapiens
  misc_feature 53, 116, 175, 177: n = A,T,C or G
atggccaaatcccatctctactaaaaatacaaaaattagccacatgtggtagngtgcacctgtactgcaatctactctggaggctgaggtgggaggattgcttgaacccaggaggnggaggttgagacaccactgcattccagcctgggtgacacaagtgaggaccccgtccccnanaaaaaa

SEQ ID NO: 22018 - DNA, 130 bp, Homo sapiens
  misc_feature 6, 8, 18, 28, 33, 39, 57, 64: n = A,T,C or G
gcatcngnaatgactagnatgaactagnaatancaaagnaaaaaagtaaaaatcagnaggatgnttatcaaagtgtaatttagaatgggggagaaattagaaagggcttacatgttcaaaaaaaaaaaag

SEQ ID NO: 22019 - DNA, 222 bp, Homo sapiens
  misc_feature 7, 30: n = A,T,C or G
aaatccnaggtggggggtaatctcgagcantaggtgctagatggtgagaaaacaagtaggactttcggctgatgggtagagacaaggaccttagtaaagagtattcatgtgctcaagaggaataacttcctggctaattctgtcgtttttctcgtttttaaattattgatattatgttttctgctcttaaaaattactgtgtccacagaggtctataaaaaa

SEQ ID NO: 22020 - DNA, 386 bp, Homo sapiens
  misc_feature 5, 306: n = A,T,C or G
atcantagggggtctttcattgctagtgactagccccttaaatgccagcctgagtacctgaaggaatctgggaattagccctggcctgaaagtggcccatcattcatacccactgttctgaaggcttgaaaacaaaacatatccacaacattggcttgatgtgatcatcatctcataactgagcaagaagactatgcaaatcttagggcgctcgctccctgcacacggaaagaactctgtttaaatgctcagttcagaacactttgggccacatagtgattttggaaaacaggataatcgtggtgnaaatgagtgtttcctttcaaagtccactgcagagcttttatccatatggtatgcacatgtagccaatattgggttctttt

SEQ ID NO: 22021 - DNA, 130 bp, Homo sapiens
  misc_feature 48, 49, 50: n = A,T,C or G
gggtctgtgcctataatcctagcaactcgggaggttgaagcggaaggnnngatttagcccaggaggtcaaggctgcagtgatccgttattgcaccactgcattccagcctgggtgacagagcgagactca

SEQ ID NO: 22022 - DNA, 368 bp, Homo sapiens
  misc_feature 8, 28, 49, 51, 90, 163, 188, 203, 232, 237, 271, 280, 288,293, 348, 350, 366, 367: n = A,T,C or G
ggacctanttaagctcgtgtaacggcgntggagtcggcaccttctgggngnagagagtttggcgcgatgtctcacaccattttgctgggncagcctaccaagaggccagaaggcagaaccttatgctgactaccaatctgtgaatgaatgcctgggaggtgtntgtaaaatgtatgaagaacatctgnaaagaatgaatcccnacgggccctctatcacatatgacatcagncaggntgtttgatttcatcgatgatctggcagacctcanctgcctggnttacccgngctgntacccagacataccagccttataacaaagactggattaaaagagaagatctacgngncctcctttcgtcgggnng

SEQ ID NO: 22023 - DNA, 379 bp, Homo sapiens
  misc_feature 6, 56, 57: n = A,T,C or G
ggaacngaaaatggggctttccagggaatgaagaagctctcctacatccgcattgnngataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctg

SEQ ID NO: 22024 - DNA, 364 bp, Homo sapiens
  misc_feature 5, 54: n = A,T,C or G
gggangagctggtggcgtcggcaggttctaggcgattcgagctccagctaggangatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaa

SEQ ID NO: 22025 - DNA, 377 bp, Homo sapiens
  misc_feature 49, 52, 53, 206, 365, 369: n = A,T,C or G
cacctaaccccttgaaaccctgtcttgtcctcctgttatttgcttctgntgnncaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctccganttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattacctgngtgnatctatgt

SEQ ID NO: 22026 - DNA, 364 bp, Homo sapiens
  misc_feature 4, 6, 12, 33, 61, 208, 212: n = A,T,C or G
ggancnaagtanaagaattaaatctgactgctnaccgtttgatgggaagaactctcaccgntgaagtgtcagtagaaacaattagaaacccccagcagcaagaatccctaaagcatgccacaaggattattgatgaggtggtcaataagtttctggatgatttgggaaatgccaagagtcatttaatgtcgctctacagtgcatgtgncatntgaggtgccacatgggccagttgatcagaagtttcaatccatagtaattggctgtgctcttgaagatcagaagaaaattaagagaagattagagactctgcttagaaatattgaaaactctgacaaggccatcaagctattagagcattcta

SEQ ID NO: 22027 - DNA, 365 bp, Homo sapiens
  misc_feature 5, 349: n = A,T,C or G
gaacngttgattttgttcacaacctcttttaaatctaacaagtcctgttctgtttagtgaaggcccaaagactcctctaagactttgtatatttgttacataaaaccaagttttactaaatactttaaaatttgtcctacattcgaaaaatagaaattgtaaatcagaggttatctgtctgcattttaaactgccaaattaccttatagtaagtttctattttatgactttgggccaagaattaagtattttcctaagcacaaatctttttctatattctcattttaatatcttatgctattattctgtaaacattttaattttagtttcatgagtctttattttttgntacctgcaagttatgt

SEQ ID NO: 22028 - DNA, 361 bp, Homo sapiens
  misc_feature 49, 272: n = A,T,C or G
gagcatatttggattgaaatcctgacatactacctatatattcttgggntgggaaatctttttatgttgctattgctaatattgaaatgggattgcctacctctttgagatattaagataatataagtataattcctacaatgtaagtgttcagatattgtaaattctgtttattgagcccctttgttacagagactttgctaaattctttgcttaaagtttcacttaatagtcataaaagcagataaattattaactgtcttctatatagntggctagatatcgagactcatcctctgactgagaaaaacctaaaaacattgtaaagcatatctttagaaaccttttaagatctgacatg

SEQ ID NO: 22029 - DNA, 346 bp, Homo sapiens
  misc_feature 3, 50, 62, 165, 207, 265, 320: n = A,T,C or G
agncattataggctttcgctctaagtattaaaaatgccctagcccacttnttaccacaaggnacacctacaccccttatccccatactagtttattatcgaaaccatcagcctactcattcaaccaatagccctggccgtacgcctaaccgctaacattactgcnggccacctactcatgcacctaattggaagcgccaccctagcnatatcaaccattaaccttccctctacacttatcatcttcacaattctaattctactgnctatcctagaaatcgctggcgccttaatccaagcctacgttttcacacttctagnaagcctctacctgcacgacaacacat

SEQ ID NO: 22030 - DNA, 272 bp, Homo sapiens
  misc_feature 8: n = A,T,C or G
gaagcagnaagggaaagaagtaggcagaattgagcagttcgctcctccctgataagcagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaa

SEQ ID NO: 22031 - DNA, 109 bp, Homo sapiens
  misc_feature 12, 16, 40, 41, 43, 46, 56, 63, 83, 84, 89, 92, 93: n = A,T,C or G
aaaaaaccccgntatntttggggaggggggaaaaacccgnngnttngaaagataantaatttntggaaggaaaaaagggaaannggggncgnngggggcaaaaaattgg

SEQ ID NO: 22032 - DNA, 220 bp, Homo sapiens
  misc_feature 5, 50, 57, 211: n = A,T,C or G
gaggnaaatggggagcaggaggctgacattgaggtagacgaagaagaggnagaaggnggggaggaagaggaggaggaagaagaaggtgatggtgaggaagaggatggagatgaagatgaggaagctgagtcagctacgggcaagcgggcagcctgaagatgatgaggatgaccgatgtcgataccaagaagcagaagaccgacgaggatgnctagaccgc

SEQ ID NO: 22033 - DNA, 366 bp, Homo sapiens
  misc_feature 49, 109, 253, 329: n = A,T,C or G
gtttctagtccaatatgattaacaagtttcattattcatttaaaatagnactttttttctcttaaacttacagcataagactttgtttttttattttggaaagaaaggntggaagaaggatacaatgaacagccatatattctttacctagattccttatattactatacttgcttttgcttttttttgtgtatgtgtgcacacacacattcctatgtgttttttttcagaagcatttgaaagtaagacttgngacactttatatcttaatgcttcatcctgtatcatccaagaaccagagatattctcttacataaccataatacagngatcacattcaacaagctgaatatgataattggtgat

SEQ ID NO: 22034 - DNA, 320 bp, Homo sapiens
  misc_feature 127, 239, 314: n = A,T,C or G
attccgtgcagtgattattttttaaagtcttctttcatgtaagtagcaaacagggctttactatcttttcatctcattaattcaattaaaaccattaccttaaaatttctttctttcgaagggtggngtcttttatatttgaattagtaactgtatgaagtcatagataatagtacatgtcaccttaggtagtaggaagaattacaatttctttaaatcatttatctggatttttatgntttattagcattttcaagaagacggattatctagagaataatcatatatatgcatacgtaaaaatggaccacagngactta

SEQ ID NO: 22035 - DNA, 340 bp, Homo sapiens
  misc_feature 130: n = A,T,C or G
cttgaaacacatttaagtgtttttagtaaatagtttagctggtgggagagtaaagggatttttctgaggcctgcgtcagttagtgctgtagatccagtgtggtccttgaaagtatctgccggttcctggnggcatagacactgagttttgataggcagtgaacatggggcacagatataaaggctgaggccggggaagaggacataaaagacatgtggataatgtgagaactcccgaagagcggcagcatcctccccgtgggagctattaaaaagaattcttaaacacaggaccacactcacactggtctggagcaagaattcatactatttggtttggg

SEQ ID NO: 22036 - DNA, 365 bp, Homo sapiens
  misc_feature 50: n = A,T,C or G
gtcctcacaagtaaagttatgcacatgggactaaattgagttatacttgngagggggggttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataaaaacagattgtctcagtttacctagctttgaaaatgccatacccatgggagagaagaaggat

SEQ ID NO: 22037 - DNA, 325 bp, Homo sapiens
  misc_feature 128, 275, 308: n = A,T,C or G
gttccttgggaagctaattttgttgaatgtttagaattgagcaaagatgtaaatttttgaagggcagtttagaaaaattaactttgtgaatgaacttaagatgtctgtactctatatgtgatgctgtncagtttgtttttatatggaaagatgttaactatagccataaccaataaaataaaaactgatgaggcatgcagctttcagcacatcttttatacatgaagaaattaattttgtgttgctatggtgttgaaatatccaagatgttctgnatctatgtaaacatgattcctttaataaattgnattttattattgaaaaa

SEQ ID NO: 22038 - DNA, 112 bp, Homo sapiens
  misc_feature 4, 11, 12, 16, 22, 23, 24, 26, 31, 32, 42, 50, 51, 53, 57,58, 60, 63, 75, 78, 81, 99: n = A,T,C or G
aggnaaatttnngganggcagnnngnaggcnntcgccacttntccttccnngngccnnanggncatcttgaaggngtnctnaaccagccttgaggagantgtgataaggagg

SEQ ID NO: 22039 - DNA, 290 bp, Homo sapiens
  misc_feature 4, 5, 21, 28: n = A,T,C or G
gctnntacctcgttgcactgntgagagnaagatgggtcaccagcagctgtactggaaccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaa

SEQ ID NO: 22040 - DNA, 364 bp, Homo sapiens
  misc_feature 4, 61, 318: n = A,T,C or G
ggtncttataattatcttatgaattaagtaaagacagtaattattacacctattttatggntgataaaaattagattcagtgccaatgccattgatttacactttgaagtcaaacttctatatgcagagaaatgggggcaatgtcttttcaagtagaaacatagcatatgcagaagcaaggagacctggatatggtgctttgaaaatctcagggtggacaggtgtggtggctcatgcctgtaatcccagcactttgggaggccgaggtgggtggatcatttgaggtcaggagttcaagaccagcctagccaacatggngaaaccccatctctactaaaaatacaaaaaaatgagccgaatgtgg

SEQ ID NO: 22041 - DNA, 386 bp, Homo sapiens
  misc_feature 5, 120, 227, 268, 302, 355: n = A,T,C or G
gagcnttaaaaggaatgctactgatgagttgatccatagaatgtgatatttattatgaatttctaatattccttactgaattaaagagtttaccttccattcattctttcttgttaaggngtttataatgaataagtattaaattttatctaatgattttttgtttccattgagattgtaattttattttgttttaatttggaatgtaatcaatttaaattaatagnttttctaatcgtaaaccaatgtagtattcttaggataaagntgagatagtcatgtatttttaaatatattgctgnatttactaatggatcatttgggagtttgaaaataagcttatatttgaattagncctttaatttctttggatccttggctacttc

SEQ ID NO: 22042 - DNA, 378 bp, Homo sapiens
gtgcctattaagtgtctgtttagtatattaggttggcaggggaatctatttttctttgattggaagcagctagcatggcacatggggtgtgtatgtatataagtgtatgtgtttttcctgctatatttatttgaggcagctgttttatagctttcagctttaaagttatagctaagtgtgtatttgtttgatagaaggctcgagaacctcttttgctgccagtacacgtaaagcttggctaagcagacgcatcaggagcaaaccatttgtgttcaccaatctgtctcggcaagtcccagggccactatcttgctagaagccactgtgtgcttttgaaagcatgaaattagttttatactgagcacatgggttctcgtt

SEQ ID NO: 22043 - DNA, 256 bp, Homo sapiens
  misc_feature 27, 28: n = A,T,C or G
gtgcaatcccagtactttgggtggccnnggcaggagcattgcttgggtgcaggaggtcaggactagcctgtccaacatggcgaaacctctgctaaaaattcaaaaaattagtcaagcatggtggcgcacgcctgtattcccggctacttgggaggctgaggtgggaggatcacttgagcccgggtggtggaggttgcggtgagccatgatcgcgctatgacactccaacctagatgacagagtgagactgtgtctc

SEQ ID NO: 22044 - DNA, 156 bp, Homo sapiens
  misc_feature 27: n = A,T,C or G
gtgctggcgggcgcctgtagtcccagntactcgggaggctgaggcaggagaatggcgtgaacccgggaggcagagcttgcagtgagctgagattgggccactgcactccagcctgggcgacagagcgagagtccgtcttataaaaaaaaaaaaaaa

SEQ ID NO: 22045 - DNA, 107 bp, Homo sapiens
  misc_feature 22, 29, 38, 42, 52, 56, 58, 60, 62, 63, 78, 80, 81, 83, 86,89, 94, 97, 102: n = A,T,C or G
agccttctttcttatggaccgnagatccncgtttattntcanactttttttntggngnananntactaaaggtggtangnngnggntantacantantatanatgta

SEQ ID NO: 22046 - DNA, 364 bp, Homo sapiens
  misc_feature 3, 5: n = A,T,C or G
gcncntagtactgtgatgaacatcttcgttactacctttctgtgtccatgattacttttttaggacagatgttcctaaaggtggaattgcttggattaggagatgaacattaaggacttttgatatgtatcatctaatggccccctagaaaagttctgtcagcctgctctcctatcaggtgttcagaatggtggtcttcctgtggggcataattaatgttagataaatagaattttgggaaagaaacttacgaggtcatttagttcagtccccttattttacatctgaggctgctgaggatcagagaggttaagtgagatgcacagagccaagttcagccaagttcattgaggaatgctgaatc

SEQ ID NO: 22047 - DNA, 363 bp, Homo sapiens
  misc_feature 4, 50, 55, 161, 317, 352: n = A,T,C or G
gaancgtttactttgaaaaaattagagtgttcaaagcaggcccgagccgnctggntaccgcagctaggaataatggaataggaccgcggttctattttgttggttttcggaactgaggccatgattaagagggacggccgggggcattcgtattgcgccgntagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcgggggngttattcccatgacccgccgggcagctttccgggnaaaccaaagtc

SEQ ID NO: 22048 - DNA, 365 bp, Homo sapiens
  misc_feature 4: n = A,T,C or G
gcancatgcctcttttagcctttctcattttttttcctcaaattttacctactgaggctcaagccttcacagtgagctgatggtctctacaggggaggggagtctagggaatttatttggtatttgtaaggcaagaggtaatttctctctaatatatctgagttattgctcatttaaaactgttaagtccagtataattttccctgatatgaaaaaatgtgcattttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagt

SEQ ID NO: 22049 - DNA, 400 bp, Homo sapiens
  misc_feature 2, 3, 28, 29, 199: n = A,T,C or G
gnncccttattcgacatcagggtgtttnncaggtaataaaccccataaatgtgatgaatgtggaaaggcctttagccggaactcgggtcttattcagcatcagagaatacacacaggagagaaaccttataagtgtgagaagtgcgacaaaagtttcagtcaacagcgcagtcttgtcaaccatcagaagatccatgcngaggggaaaacccaagaaacccatgaatgtgacgcttgtggtgaagcctttaattgccgtatttctcttattcagcatcagaaattgcacacagcatggatgcaataaatgtagagcaatacataagctcaatttgatttgagactagtacccaagtgcagttttagtatggctcaacatgggtcagatttagtgataaag

SEQ ID NO: 22050 - DNA, 183 bp, Homo sapiens
  misc_feature 35, 135: n = A,T,C or G
ccccaatgtttggaaacagtataatttgacaaagnaaaaatgatacttctctttttttgctgttccaccaaatacaattcaaatgctttttgttttatttttttaccaattccaatttcaaaatgtctcaatggngctataataaataaacttcaacactctttatgataaccaaaaaaaaaa

SEQ ID NO: 22051 - DNA, 362 bp, Homo sapiens
  misc_feature 49, 52, 54, 64, 87, 94, 194, 201, 305, 317, 348: n = A,T,C or G
attcagaacatgtgaaaggtgttttttttttccaatatgaactcatgcnggntnccaaaactgngataacccttttttacttactgnaaagagncattttcataaagatcaattcattgatttgttttttgtaaagctatcattcaatatatattataaattaatataaatttaagggaagctctatgtaaggngacttanagccaaactgtttaagctgtatcatcccaacaaagtatcctttcatgaacggggcatgcaatagcttaagaattgctaggattaaattaaggaaagtaaagctnctcagagcagcnggttccacaagcacaaactttacacatttgnacaattttgaaatg

SEQ ID NO: 22052 - DNA, 364 bp, Homo sapiens
  misc_feature 55: n = A,T,C or G
gaaccgcaattcttggaagtagagaactggacgttgtgaacagagttagctggtnaatgtcctcttaaaagatccaaaaaatgagacttctagcaaagattatttgccttatgttatgggctatttgtgtagcagaagatcgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtac

SEQ ID NO: 22053 - DNA, 364 bp, Homo sapiens
gatagattttattcgactccttcaggttatcttgaactgcctgacttaggccagccctacagcagtgctgtttactcattggaggaacagtaccttggcttggctcttgacgtggacagaattaaaaaggaccaagaagaggaagaagaccaagacccaccatgccccaggctcagcagggagctggtggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaagg

SEQ ID NO: 22054 - DNA, 182 bp, Homo sapiens
  misc_feature 5, 53: n = A,T,C or G
atccnctatttgttttgtaacaagtttctgtaaataaaataatttatactatntataagaaaaggttgtgctttgctttataagaaattagcttgtggaacaaacatgttactaaacgggcaataaaattaggacttctcaataaataaggttggctgcatgaaaaaaaaaaaaaaaaaaaa

SEQ ID NO: 22055 - DNA, 166 bp, Homo sapiens
aagcagcaattactactcgttctgggcagaccttatccaaagtctggtacaactgtccttagactgatgagcaaaggaggagtcaactaatgaagaaatgaataataaattttgacactgaaaaacattttattaataaagaatattgacatgacgaaaaaaaaaa

SEQ ID NO: 22056 - DNA, 358 bp, Homo sapiens
  misc_feature 5, 9, 28: n = A,T,C or G
cgccntggntcacgcctgtaatcccatnattttgggaggctgaggcagggggatcacctgaggtcaggagttcgaggccggcctgaccaacatggcaaaaccccgtctctactaaaaatacaaaaattagctaggtgtagtatgtgggtgcctgtaatcccagctacttggggggctgaggcaggagattcacttgaaacctggaggtggaggttgcagtgagccgagattgcaccattgcacgccagcctgggtgacaagagcaaaactctgtctcaaaacaaacaacaacaacaaaacccccaaaagaatcaaactactgactaaataatggatgaacggactagtggcaaggcta

SEQ ID NO: 22057 - DNA, 357 bp, Homo sapiens
  misc_feature 21, 27, 204, 297, 299: n = A,T,C or G
gacctaatctacaagcgtggntatggnaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgagggggnatgaagaaaaagaccacccattttgtagaaggtggagatgctggcaacagggaggaccagatcaacaggcttattagaagaatgaactaaggngnctaccatgattatttttctaagctgggtgggtaataaacagtacgtgctctcaaatcg

SEQ ID NO: 22058 - DNA, 334 bp, Homo sapiens
  misc_feature 27, 28, 177, 179: n = A,T,C or G
gtcctagtgtggtttgaggactgacanngctagcagaaaactccatctgtatcaggtatttgacggtcaagatttatgtaattaagaatttttggaaatagtaagattgttaaatttctaccctgactgatgagtattaaaaaaaaagaaccacagattatcagtatgtggagtgantnatggacatcacaacatatatggcagatattaaaagaataaaggaatattataaacactcaaaagctaagaaacaatgtagatgaaatggaacactcttttaaaaaatattcattgcccagatttacacaagaaaacagctacgtatttattaagg

SEQ ID NO: 22059 - DNA, 388 bp, Homo sapiens
  misc_feature 4, 54: n = A,T,C or G
gttnatacaaaccactgtgaacattttttatttgagaattttgtttcaaagggnttgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggattggttgtgtacacatgctgccttcttggggattcaaaaacaggtttttgattttgaatagcaattagtgatatagtgctggttaagctactaacga

SEQ ID NO: 22060 - DNA, 386 bp, Homo sapiens
  misc_feature 51: n = A,T,C or G
aatccaaagtaaatgtcctgctagctagttaaggattgttttaaatctggnattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaat

SEQ ID NO: 22061 - DNA, 302 bp, Homo sapiens
gagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatgacaaaaaaaaaaaa

SEQ ID NO: 22062 - DNA, 386 bp, Homo sapiens
gttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcgttggaaaagacatagaaaaggcttgccaatctatttatcctctccatgatgtcttcgttagaaaagtaaaaatgctgaagaagcccaagtttgaattgggaaagctcacggagcttcatggtgaaggcagtagttctggaaaagccactggggacgagacaggtgctaaagttgaacgagctgatggatatgaaccaccagtccaagaatctgtttaaa

SEQ ID NO: 22063 - DNA, 330 bp, Homo sapiens
  misc_feature 4, 58, 95: n = A,T,C or G
gganatattaaaattttacacttttactagctaaaacataatcacaaagctttatcgnattgtataaaaaaattaacaatataatggcaataggnagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggcttaaggatcaaa

SEQ ID NO: 22064 - DNA, 363 bp, Homo sapiens
  misc_feature 27, 81, 102, 105, 123, 203, 267, 273, 311, 343: n = A,T,C or G
gaccattgaggcagccagcgcaggggnttctgctgagggggcaggcggagcttgaggaaaccgcagataagtttttttctntttgaaagatagagattaatncanctacttaaaaaatatagncaataggttactaagatattgcttagcgttaagtttttaacgtaattttaatagcttaagattttaagagaaaatatgangacttagaagagtagcatgaggaaggaaaagataaaaggtttctaaaacatgacggaggttganatgaancttcttcatggagtaaaaaatgtatttaaaagaaaatngagagaaaggactacagagccccgaattaatnccaatagaagggcaatgctt

SEQ ID NO: 22065 - DNA, 293 bp, Homo sapiens
  misc_feature 4, 12, 33, 38, 41, 88, 106, 148, 152, 155, 175, 232, 234: n = A,T,C or G
catnccggggtnaaatattcaaatttttggtgnctcanaanacaagaataaaagggatagaaaacctatttgattaagtgtacccganaacttcccaagtctagcnggagatttagacacccaggcacaggaagcttagaaaaccccnaatngangcagttcaaaaatccatggnctattacagtcaaactgtcaaaagtcagagaataaaacagcaagagaaaagtatcangncacttagaaggagaacacctatcagactaacagggaatttctcagcagccacccttaca

SEQ ID NO: 22066 - DNA, 107 bp, Homo sapiens
  misc_feature 2, 11, 42, 93, 95, 96, 101: n = A,T,C or G
gnaggatgtcntaatattgtttttttaacaacattaacttgnggcctctttctacacctggaaatttactcttgaataaataaaaactcgttngnnttgtnttctgc

SEQ ID NO: 22067 - DNA, 399 bp, Homo sapiens
  misc_feature 39, 41, 68, 113, 163, 353: n = A,T,C or G
ttatggccggaataccagatcacaccgcaaagaagcaantngtaataattaccatagtaggatatggnagaaattgttctgattgtaattagttttgtattttctatactggngttagaaaacatatgtttacatttgattaactgtgttgcctatttatgcngggtaatccagctaaaggaagctttctttaattataagtattattgtgactattatagtaatcaagaggatgctatcatcctgcttgcctgtccatttgtggaacagcatctggtgatatgcaattccacactggtaacctgcagcagttgggtcctaatgatggcattagactttcataatgtcctgtntaaatgtttttactgcttttagaaaataaagaaaaaaaacttgata

SEQ ID NO: 22068 - DNA, 388 bp, Homo sapiens
  misc_feature 7, 55, 103: n = A,T,C or G
cgacctnaagaggagactttaagaacctgaagaaccttcacgcattgattcttgncaacaataaaattagcaaagttagtcctggagcatttacacccttggngaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttac

SEQ ID NO: 22069 - DNA, 387 bp, Homo sapiens
  misc_feature 3, 31, 159, 205, 207, 208, 256, 280, 343: n = A,T,C or G
ganacctttaaaataactggcttaaaagtanaagtctcattaattgcttactttttttggggttctgttattttttgttttgtttttaaacaatattgtctcaggcacaaaagctgttatttttaagaagttgacactgaagataatttgctttcttgnattctaatgcatgtgctatagattctttgtcacacatatcagtagngnncttaaaatcaaagaatcttacagtaaagactcttatagcaaaagaagntagtaattttaatttatgtttggnccgtagcacatgaccctaagttattctagttgcagaaggtatttccgcgtagaggttagccangttcttttgaaagtaccctctcttgagcaaagaataaagaatta

SEQ ID NO: 22070 - DNA, 381 bp, Homo sapiens
  misc_feature 55, 86, 112, 119: n = A,T,C or G
atttcagtatatgaataaaccattttatttattctcttgtggaaggacatttggnttgcttctagttcttgacttttagtaatggntcaagaacattcttcagatccatggntcatggnttctctaggagtggaatttgggatcagggagtatacctgtcttcaggtttacaagataatgtcaaactgctttccaaagtgggttataagatttcctatggctccaccatgcttgccagcacttggtattgtcagctttatcaatctgatgatttcaaaatggaatctaattctggtgataactggcattttcctaattactaatgaggctatacaggagtgactcaaacaatttaacaactagacatagctagtacagtag

SEQ ID NO: 22071 - DNA, 400 bp, Homo sapiens
  misc_feature 23, 26, 28, 29, 30, 71, 135, 139, 152, 324, 347, 378: n = A,T,C or G
tgtagacatctctgagttaaaanccntnnncaaaagttttaaagcatggataatatatctttaaaattggntaaaatgtgcttggatgctttaaacatatactcaaaatagtaaataaatgtttgtggccaggcntggnggctcatgcctgnaatctcagcactttgggaggctgagacaggcagatcacttgaagtcaggagttcgaaaccagcctggacaacatggggaaaccccgtctctactaaaaacaaatgataataataataataataatgcaggaaaaatctgggcatggtggtgcatgccctgtaatcccagctnctcaggaggttgaggcaggaganttgcttgaacccagggggtgggggttacagngagccgaggatcatgcccgctg

SEQ ID NO: 22072 - DNA, 400 bp, Homo sapiens
  misc_feature 11, 44, 57, 60, 64, 71, 72, 93, 144, 145, 165, 193, 220,234, 272, 276, 294, 355, 362, 364, 370: n = A,T,C or G
tgagggatggnccggaaaaccccgacgtcattaaaaggaagttntcctgaacatggnggnccgnagggggnnggaagatatcatgatcacagngattcccgaagaaattgacccataggcagaggcatgagctggacttcatgnntccctcaaagactctcccgnggatgacggatgaggactctgggctgcnggaataggacactcaagacttttgacngccattttggttgntcaggggagactccctggccaacagaatccttcttganaggntgcaggcaaaacaaatgnaatggtgcagatccgcaggcagaagctctgcccttctggatcctatggatgcaggggggcnttttctngncagctngggccattcttgcttagacaggcagcattt

SEQ ID NO: 22073 - DNA, 400 bp, Homo sapiens
  misc_feature 17, 62, 69, 159, 220, 379: n = A,T,C or G
ttatggccggaaacccnatgacgtgtactactgtggtttttagtacatcaaagatgatggcntcctaantgagccctctgcagatgccccagctgctctctaccagacaattgaagaaaatattaaaatctttgaagaagaagaagttgaatttatcangtgtgcctgtcccagagtttgcagatagtgatcctgccaacattgttcatgactttaacangaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggntattactgatcgcattgaaaa

SEQ ID NO: 22074 - DNA, 400 bp, Homo sapiens
  misc_feature 8, 172: n = A,T,C or G
gaaccagnaagctgtctgaacttctgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggngagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtgg

SEQ ID NO: 22075 - DNA, 400 bp, Homo sapiens
  misc_feature 25, 26, 29: n = A,T,C or G
tttcaatatctctttcaaaatgccnnggnctaaccagaattaaaagcaaaaatcttatgatcatctcagtagatcagaaaaacattcaataaaatctagcatcctttcatgataaaaacccttaacgaactatgcatcaaaaggaatatacctcaaaataaggagagccacctatgacaaacccacagccaacatcatactgaatggggaaaaagttgaaagcatttaacatttaagctgagaaccaaatcaagaacacaatgccatttacagtagccacacacacagaaagtaaaatgcctaggaatacatttatccaaggaagtgaaagatctgtacaaggagaactacaaaacactgatgaaagaaattggggatgatataaacaaatgaaaaaaca

SEQ ID NO: 22076 - DNA, 132 bp, Homo sapiens
  misc_feature 8, 13, 47, 51, 70, 73, 85, 97, 100, 102: n = A,T,C or G
agggaggnccggnaagcccacctacagggaaaacactgccgtttgangagnaaaacctgacggggagganggngggagggggttnctaaagagcaanacnanaacattgaggggcctagtagaacagcaaga

SEQ ID NO: 22077 - DNA, 342 bp, Homo sapiens
  misc_feature 3, 18, 55, 56: n = A,T,C or G
aancgcctttcctctaanactgaaacttgataaggatgcgcactttcactactgnngttcaatatagtactggaagtcctatctagagcaatcagaaaagagaaagaaatggcatccaaattggaagggaaggagtcaagttatccttgtttgcatattatatgattttatatttcaaaaaacccaaagagtctaccaaaaactattagagataataaacaaatttagtaaagttgcaggatacaaagtcaacatataaaaatcattaatatttctatatgccaacaacaaacaatctgaaaaagaaaccaaacagtaattccagttataatagctacaaat

SEQ ID NO: 22078 - DNA, 400 bp, Homo sapiens
  misc_feature 3, 24, 29, 110, 122, 206, 239, 345: n = A,T,C or G
aanccccaaaaagttgaacaaagnatgantttatgtattacattaccattgccactgatttttttttaaatggtaaatgaccttgtatataaatattgccatatcatggnacctataatggngatatatttgtttctatgaaaaatgtattgtgctttgatactaaaaatctgtaaaatgttagttttggtaattttttttctgcngggggatttacatattaaattttttctgctggnggataaacattaaaattaatcatgtttcaaagttttattttcagttccttttgcatgcctattttgatttagaaatcactttaagataaatgaacaaaattattgnaagtcttctaaacttggtttattgacgttagtataaataacatacaataccagat

SEQ ID NO: 22079 - DNA, 387 bp, Homo sapiens
  misc_feature 26: n = A,T,C or G
acaccgaacactgcataacccgtttntttgaggagtgtgaccccaacaaggataagcacatcaccctgaaggagtggggccactgctttggaattaaagaagaggacatagatgaaaacctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcacattaactttggaaacaaaaatgtacaattaagtaaagtcaacatatgcaaaatactgtacattgtgaacagaagtttaattcatagtaatttcactctct

SEQ ID NO: 22080 - DNA, 160 bp, Homo sapiens
  misc_feature 4, 52, 63: n = A,T,C or G
gaancaaatgaaagctaccaatttaaagttacggaatctaccattttaaagntaattgcttgncaagctataaccacaaaaataatgaattgatgagaaatacaatgaagaggcaatgtccatctcaaaatactgcttttacaaaagcagaataaaagcg

SEQ ID NO: 22081 - DNA, 288 bp, Homo sapiens
atgaataaggttgaaaagaaaaatctggacgtctaattagaatacttatatgtatcatcaaagatttctttttctttgttttctttagcatccagtcatgcacctttccacagatctggactgtttattgattttactgtgcttctttaaaaatttctcatgaagccaggcaggcatggattttgcctgtagtcccagcgactcaggagggcgaggtgggaggatcatttcaggccaggagtttgagaccagcctgggcaacgtagcgagaccctgtctcttaaaaaa

SEQ ID NO: 22082 - DNA, 400 bp, Homo sapiens
  misc_feature 11, 24, 34, 38, 40, 63, 64, 237: n = A,T,C or G
tagaaccacanaaccctttttttnttatggccgnaatncnatagaaaaaaaacttctcatttnngttaactagagtgaatgtagggagaattgttttgcttgtaacatggagagtttattttcaagtgaggaaagagaaaaaaattactcagacttgttcctggtgaagtgcattctctgtttgtatactttttgatggagaaattgatctatagaactgcttaattttttgaggcntttagacagcaatgaaaggtagttctccacaggacaccgaatcaaaaggagagaccagactctggcctcatacccagcctatttgaaacaagctatctagtttctcctgcagacaccttgtcaacaacatgcaacagtgtcaggtgccttgcgggaaaataat

SEQ ID NO: 22083 - DNA, 253 bp, Homo sapiens
  misc_feature 5: n = A,T,C or G
atttnaaaaaatgattattctcagctataaaaaggcttacgggtatgtgtggcatttcaggattaagcccatggttttgatgactttcagaacgtttcatttgttagtcatattggccacactctgacagcttctgtgtcctctccagctccctgccgtggcctttaatgtgaacaacctgcccttcacagagcccatgctgtctgtctgggctcagttggtgaacctcgctggaagcaagttagaaaagcac

SEQ ID NO: 22084 - DNA, 137 bp, Homo sapiens
  misc_feature 21, 23, 27, 31, 96: n = A,T,C or G
actgcagaagtatcacagggncngggngagngttttattaatttctttgtcagacaagtgtttaggaaactctcactccaggcctaatgctgtgcnaggctctgcaaatgctaagagggggaagttactgtccctgc

SEQ ID NO: 22085 - DNA, 400 bp, Homo sapiens
  misc_feature 41, 64, 65, 215, 216: n = A,T,C or G
tttatggccgaaaccccaaacatttggaatattattctttnctcacgttttaataatacatctnnttatttttctagtagagaaactacaaatcagcctcttcaacatttatatacagtttaataagcctcttgcaagttacttgttctctcacctgaggtatttttttcctccccaccttgcccctgttcctcccttcctcttctccctttgcnngaggaaatatttaacatatttgggtccaacttcaataatgtaataattaatacattaaaaagcatttaacttcctttctagaaaaatgcacaggctaaggcatagacaaaacaaagagaaatgctgagaaatttgccactggagacgagcaatctgaataaatatttgccaaaagttcttttta

SEQ ID NO: 22086 - DNA, 348 bp, Homo sapiens
  misc_feature 24: n = A,T,C or G
attgggaactaaatttagaattgncaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattattatttgcaactagaactgtaatcagaaagaaattttgtatttttgtataacttgattgtgtgtcattttatataacaggtcctgttttacaaataaattttgttttacga

SEQ ID NO: 22087 - DNA, 398 bp, Homo sapiens
acaatcaggattacataaagcccaaaagcttctgcacaacaaaggaaacaatcaatgaagagataacctaaaaaatgggagaaacgccttgcaaagtgtccatataacaaggattcaataactaaaatatgtaaacaactcaaacaactcaatagcaaaaaaataaatctgattttaaaatgagtaaaagatcagaaaagacatttctcaagagatacaaatggccaacaaggatgtgaaaaaatgttcaacatactaaccatcagagaaatgcaaatcaaaatcacaatggcatattatcttactccaattaaaatggcttttatcagaaagacaataacagatgctggcaggaatgtggagaaaggggaactctggcacactgttggtgggaatgt

SEQ ID NO: 22088 - DNA, 399 bp, Homo sapiens
  misc_feature 38, 62, 63, 65, 69, 73: n = A,T,C or G
ttatggccggaagacccctggctggagcagcgagtctnttgatcccaggccagagacaaggnngnacanaggntcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatgggacttgttttcaccattgggctaactttgctgctaggagttcaagccatgcctgcaaatcgcctctcttgctacagaaagatactaaaagatcacaactgtcacaaccttccggaaggagtagcctgacctgacacagattgatgtcaatgtccaggatcatttctgggatgggaaggga

SEQ ID NO: 22089 - DNA, 165 bp, Homo sapiens
  misc_feature 38, 50, 53, 54, 74, 76, 91, 93, 134, 140, 153, 155: n = A,T,C or G
gggaccggaaactttttttttttctattttcttttttngataacatcttntgnngcataaccagcctggcagtntnatggcctaaatgcananaaaacagctccttggggaattgataagtaaaggcagaaaanattatntgtcatacctccntnggggaataag

SEQ ID NO: 22090 - DNA, 356 bp, Homo sapiens
  misc_feature 18, 25, 177, 178: n = A,T,C or G
gcgcaatgggacattagntgcatcnccgagggcattatttctggatgctaagtccattcagtccaccatctccagctcgcagaattactgaagtttggggtattccttcccccattgatactgtttttactaggtgcaactgtgaaggaaaaactttcttctttaaggattctcagnnctggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacag

SEQ ID NO: 22091 - DNA, 142 bp, Homo sapiens
  misc_feature 23, 88: n = A,T,C or G
tggtcttgagggggatacagatnatagaatatgctgacatttgggcttcagaggaagaattttcaaatctaatggaaatagttgaggngttcaggaatgctgtttcttggagttggaagcttaggttttgaaatgttgaaac

SEQ ID NO: 22092 - DNA, 261 bp, Homo sapiens
  misc_feature 16, 20, 171: n = A,T,C or G
atggtacgctcataanaatnctaagatgctatttgcctttttactctcattctgttacaggtgtacagtagagttttccagaggctacatgacatgcagtatcacaacggaagcaaatataagaacccacctgtctcctgttaaaatgcaaaatgtaaaacaataccactntgctaactgtttttgtttggggaaatatagttcataaaaatatttatgttaacatgtaatttaggggtaaaataaattaataaatatttg

SEQ ID NO: 22093 - DNA, 388 bp, Homo sapiens
  misc_feature 8, 22, 31, 56: n = A,T,C or G
cagccagnagaagaaacttagnaattgtctntcaaaggagtgtcaagaagtatganctaaatgtcctttcaccagctcacaggccagaaatggaggacccaagtcaactaggtgaaactactagcagacccagctttcccataataacctaatctgcaaattgttctattaaagtctcatcgttttcaggatgcaatgaaagtggatttcaaaaggctttggaaaaataagtggaacatgactgatcttgaaaaaaaaagcaaaagcttaaatatttgatacaagtttacttagctacaacatactttacattgttgcctttagttatctcacaggcactgacattttatatttagaaaatacttttaatctttctaatctttttttg

SEQ ID NO: 22094 - DNA, 310 bp, Homo sapiens
  misc_feature 19, 21, 29, 139, 174, 175, 178, 234, 251, 277, 283, 301: n = A,T,C or G
tgtactgtttaattttggnanagcaaagnttgaagtcaaaaaaggtgatcgaattgcacagctcatttgcgaacggattttttatccagaaatagaagaagttcaagccttggatgacaccgaaaggggttcaggaggntttggttccactggaaagaattaaaatttatgccnngancagaaaacaagaagtcatacctttttcttaaaaaaaaaaaaaaaagtttttgcttnaagggtttgggggtttngcccttttgaaaacttactagctttncctttnaaaagaacggcatttttnacttttttt

SEQ ID NO: 22095 - DNA, 389 bp, Homo sapiens
  misc_feature 5, 31, 59, 207, 208: n = A,T,C or G
gattncagataatttttagcttagggccttntggctaggtcggttctctcctttccagncggagacctctgctgcaaacatgctccgccagatcatcggtcaggccaagaagcatccgagcttgatccccctctttgtatttattggaactggagctactggagcaacactgtatctcttgcgtctggcattgttcaatccagatgnntgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaat

SEQ ID NO: 22096 - DNA, 389 bp, Homo sapiens
  misc_feature 30, 381: n = A,T,C or G
gaggccttgaggcagccgcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaggagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggngacttaaa

SEQ ID NO: 22097 - DNA, 400 bp, Homo sapiens
  misc_feature 4, 5, 32, 287, 335, 347, 350, 353, 389, 397: n = A,T,C or G
gcgnncttattacagcctttgagacagctggnaattataagtcattttccattttttaaaacataattttataaagaattctcttatctcgactatgtagaataccacctactggacagaacaatttttgtactcacaaacactgccattttcttagagatggcttgagaggagtaacactatggtttaaagcttgcagtaaaaatgccaaacactgtagtaccttggaacccagtttattcttgtgctaagcagaactgtaaaatagttaaaacggcttatcaagnaattcgccgattacaaagacaccatttggtttttatttcattctttgntttaactcatgnggnagngatatttaatactttctgatcaaacagggtcaaagnaaaacggnaaa

SEQ ID NO: 22098 - DNA, 213 bp, Homo sapiens
  misc_feature 1, 3, 155: n = A,T,C or G
ncncagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggnccctgggtgacatgtcaagatctttgtacgtaattaaaaatattgtggcaggattact

SEQ ID NO: 22099 - DNA, 399 bp, Homo sapiens
  misc_feature 2, 32, 61, 63, 66, 68, 69, 81, 178, 217, 218, 221, 227, 339,345, 353, 371, 386: n = A,T,C or G
gnggtgggcaagaccccgcctactttaaaaanctatatgttttcaatgctctctcttactntnatncnntagacaggcagntcctctctttagaaataattagttttatcagtttcttgagcagccttgtatgtagtgcacatatgagtggtttcacacaacatgagagagtgtgtgngcattttataacaatacctttttttgttttttttacctnnggnagtggnagcattctttaccataaattttttacttaacatcttgggatatcttctcatatgggacataaaaggattttcattcctttttaaaaaggtgctgcttagggggccattgggnaggtgnaacaattnggctaggaccttattganggggggttttaatcntttgctattacaa

SEQ ID NO: 22100 - DNA, 400 bp, Homo sapiens
  misc_feature 24, 291, 313, 386: n = A,T,C or G
cacagtttgtgatggaaggagtgnagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaacctacattgaatatcagaatcttgttgactacataaaggggaaacaaggcaaacacattttatatggctgcagngagctttttaatgctacacagntcataaaacagttgtcacaacttggacaaaagtaacacagaagaaccttactatgataatctacttggaatgnggataaatgtaaaa

SEQ ID NO: 22101 - DNA, 382 bp, Homo sapiens
  misc_feature 30, 209: n = A,T,C or G
atcttacagcttgcctttttaatgttagtnacaatgtttttgtggtttgaagtttagtttaatgttagtgcagtgacgggaaatacacattatgctaatgttgatgacagaatttatttggttgccttgtgtgttaattgaatgcatacctaattgtaaaatttttttatttacaacattggaaattcagaagttaatgtttttttgtnagcacaaaagaagtattatagaaatttatcctagcaagactttacaagataggatcaaattctaatggaattgagccggtttcttatcccaaatgtttcctccctttttacaatctctgtccagcaccccttggttaaataatgtatgctgtgagacatgaaattaaaacaga

SEQ ID NO: 22102 - DNA, 387 bp, Homo sapiens
  misc_feature 211: n = A,T,C or G
gctaaccctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcnaggagagccaaagctaagacccccgaaaccagacgagctacctaagaacagctaaaagagcacacccgtctatgtagcaaaatagtgggaagatttataggtaagaggcgacaaacctaccgagcctggtgatagctggttgtccaagatagaatcttagttcaactttaaatttg

SEQ ID NO: 22103 - DNA, 390 bp, Homo sapiens
  misc_feature 5, 7, 30, 57, 58, 62: n = A,T,C or G
tgggncnggtagtgtttaactggagatgtnttaaccttgaaagtctgtgagacaagnntggncaagagtcaggagctgttctgtctggtcagaaagcagagacgggatagtggaagagcaagagatactcagggagagacaggctgagacctattctggaaaggcataagaagtaggctcagtttctgggctttcttcttaaaactaccaatgtttctcactaagaatgaagtgatcagagcagggctgagcctttgggcagccatttaagtgagtctggagagtgagaggtaggaaggcctatgaactagtggttccccaaacccaggtgaagatacacttagtattactgagctagactgggttgaaaagagggatgagggtttcaaa

SEQ ID NO: 22104 - DNA, 376 bp, Homo sapiens
actgctgatgtagtatgataaagtcagcttcttggatacagacacacccagggcagctgccaatcagaaatgcaaattgctaaattccaaacagaaccagtgactttgctactacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttc

SEQ ID NO: 22105 - DNA, 389 bp, Homo sapiens
  misc_feature 5, 6, 91, 370, 372, 373: n = A,T,C or G
aggtnntcagattgactcttctagtattacaacacttggcttcaagtaatccttattttacttcatagtggccccaaagtgcaggagtggngatcctggcaattcagatatgtcaaagagaagctgtaaattgcttcccttaagtggaagatgaaaattctagacttatatataaagaaaagaaatcatatgctgagactgctaagatctatgataagaatgaatcttttatacatgaaattgtgaagaatgaaaaagaaatgcgtgctggttttgctgtcatatctcagactgcaaaagtttgcagccaatgtgtatgataagtgcttagttaaaaggaaaaaggcatttaaggtaagtatatataggngnntggtactacctgtgat

SEQ ID NO: 22106 - DNA, 195 bp, Homo sapiens
  misc_feature 12, 52, 56, 58, 62: n = A,T,C or G
gacctccaaatngcaaaataaatactaacttattattatttatgattatatnagangngganggacctatatcaagaggcagactgaagcttggaaatcattatgaatatttgtaaattacagctttaagaacacattacacataaatatatgttttgtaattaatcgaagtcacatttcctgacctaagaattt

SEQ ID NO: 22107 - DNA, 390 bp, Homo sapiens
  misc_feature 4, 49, 207, 277, 292: n = A,T,C or G
aaanccctcctgaagctgacagcattcttttcgagatgtctcgctccgnggcctccagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaaggngacttactgaagaatggagagagaattgaaaaagtggagcattcagacttgtctttcagcaaggactggnctttctatctcttgnactacactgaattcacccccactgaaaaagatgagtatgcctgccgtgtgaaccatgtgactttgtcacagcccaagatagttaagtgggatcgagac

SEQ ID NO: 22108 - DNA, 297 bp, Homo sapiens
  misc_feature 6, 33, 56, 123, 172: n = A,T,C or G
aattanccatcaagtagggttgggccgggtttngtgtctcatgcctgtaatcccancactgtgggaggctgaggcaggcggatcacgaggccaggagtttgagaccagcctgatgaacatggngaaaccccatctctactaaaaatacaaaaaaaaattagctgggcatggnggtgcgcacctgtaatcccagcaacttgggaggctaaggcaggagaatcgcttgaacctgggaggcggaggttgcaataagctgagatcgcaccactgcactccagcctcggcaacagagtgaga

SEQ ID NO: 22109 - DNA, 382 bp, Homo sapiens
  misc_feature 4, 29, 48, 51, 56, 61, 66, 118, 146, 205, 208, 214, 246,255, 270, 327, 341, 345: n = A,T,C or G
gaancagcactgtggaataaaatataccnttgtgaacatatctgatgntgngatgnaatgnaaagntccttactttgctgatttttcatcataactccttgactcataaaagcggggnctaaactgggaacagctgctaatagggnaaaagtattatacatcaaataaaagttcattacaatatttgtactcataagtcaaaatntgncctggntcgctttgtgcctctgtcagcctacttacagngataaatgnacacacaagtccagngttgccaaggagctttgtttatagaaagaagcttgggcccctcagttctatgctgtntgtgtggccctggntggnacatgccgtcatggtgaaggatgactttggtttgaga

SEQ ID NO: 22110 - DNA, 378 bp, Homo sapiens
aaatccagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcgcctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaat

SEQ ID NO: 22111 - DNA, 329 bp, Homo sapiens
  misc_feature 86, 265: n = A,T,C or G
gtagttggatcaagtgacttctgcccacctggacacaacaccaaaaaggcttcttattcgggtgtgagtcttttcagcaacccggnccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaaccgcaatgnggatgttttacccacatgacttattatgcataaagccaaatttccagtttaagtaattgcctac

SEQ ID NO: 22112 - DNA, 188 bp, Homo sapiens
  misc_feature 5, 29, 50, 149: n = A,T,C or G
gtagnaagtgaaatcagaggagatgtaantatcggacctcggacagtgangcaccctaaagcaagaattattgcggaagccgggccaatagtgattggcgaagggaacctaatagaagaacaggcccttatcataaatgcttacccagntaatatcactccctgacactgaggatccagaaccaaaac

SEQ ID NO: 22113 - DNA, 360 bp, Homo sapiens
  misc_feature 28, 29, 85, 177, 179: n = A,T,C or G
aagcgtaactggcggaaacccagcaggnnttgacaacagggttcgtagaagattcaagggccagatcttgatgcccaacattggntatggaagcaacaaaaaaacaaagcacatgctgcccagtggcttccggaagttcctggtccacaacgtcaaggagctggaagtgctgctggngngcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactg

SEQ ID NO: 22114 - DNA, 388 bp, Homo sapiens
  misc_feature 4, 29, 31, 54, 55, 142, 232, 332, 335: n = A,T,C or G
gggnccgaaagattcccacccaattcaantnttgtgccatgtcaaacaaatagnnctatcaaccccagacactggtttgaagaatgttaagacttgacagtggaactacattagtacacagcaccagaatgtatattaaggngtggctttaggagcagtgggagggtaccagcagaaaggttagtatcatcagatagcatcttatacgagtaatatgcctgctatttgaagngtaattgagaaggaaaattttagcgtgctcactgacctgcctgtagccccagtgacagctaggatgtgcattctccagccatcaagagactgagtcaagntgntccttaagtcagaacagcagactcagctctgacattctgattcgaatgacact

SEQ ID NO: 22115 - DNA, 255 bp, Homo sapiens
  misc_feature 24, 73, 131, 216: n = A,T,C or G
caaagcaggcccgagccgcctgcntaccgcagctaggaataatggaataggaccgcggttctattttgttggntttcggaactgaggccatgattaagagggacggccgggggcattccgtattgcgccgntagaggtgaaattcttggaccggcgcaagacggaccagagcgaaagcatttgccaagaatgttttcattaatcaagaacgaaagncggaggttcgaagacgatcagataccggcgtagttccga

SEQ ID NO: 22116 - DNA, 400 bp, Homo sapiens
  misc_feature 16, 66, 130, 383: n = A,T,C or G
attatggccggactanctggatgctttaaattacagacagttaactctctgactctttaactcccnttgctgaaagctgagtttgaaataatgaaccatgtggcactcacatctggtaacaggctacggnttgtgtccttccttttactttctatgtggcatagcatttttgagttgagtggcctcatatcttgttgcttcattttgtgtgatctatctgttgttactactttttcatagttagggtttattggcttaataatcttaatgtatttcagtttttagtgtagtttttatatttcttgagaaatgtacagctgttctgattcttgatcctttatagtgctcctttattttattcttccgggagtatgtaaaatggnctgaaattccttgcgtt

SEQ ID NO: 22117 - DNA, 225 bp, Homo sapiens
  misc_feature 6, 28: n = A,T,C or G
aaagcnaactttgtgcctgtcctagtantgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatggttttaaaaaatgacttttaac

SEQ ID NO: 22118 - DNA, 382 bp, Homo sapiens
  misc_feature 31, 34, 57: n = A,T,C or G
aaggcccaaggaaaaacaagctgaagaaatnttntcagatgatttgtcattaattcngaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcacctggaagaacaattgaggaggttgcaagaagaacgaac

SEQ ID NO: 22119 - DNA, 364 bp, Homo sapiens
  misc_feature 4, 30, 85: n = A,T,C or G
atancaaaccaaatgaaaattttagaattnaaaaatacaatacttgaaataaaaattcattctgtgaacctaatagaagattggngacagaagaaatgatcagtaaacttaaaggcagggaaatacaagctatccaaactgatgcacaaaagaaaaaactattgaggaaaagaaaagaatagcacctcagtgaactatggaaccacacaaaacagactactgtaagtgtaattggagatcaagaagaggggaagagggtgggagagtaaaagaaaaattgaaaaagtactaaccaaaattcttcccaaatttgaagaaatgtgtaagagtttcaagaagtttaaccccaaacaaacccacatct

SEQ ID NO: 22120 - DNA, 400 bp, Homo sapiens
  misc_feature 24, 26, 175, 176, 322: n = A,T,C or G
tgatgttcacgcctctgagagggnantacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcnntatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggngacctacctggccaacctcacacagtcacagattgcactcaatgaaaaacttgtaaacctgtgaatggaccccaagca

SEQ ID NO: 22121 - DNA, 383 bp, Homo sapiens
  misc_feature 49, 133, 206: n = A,T,C or G
gcccccaaaaatgtgctgcctagaaacttacctgcattcaaccaactgnagatgccggattggaccatgaatgatatgctagaatagaagaaagagaagtgtttttttaattgagagcctctatgtgcaaggngatatataatcatatccagtttaatcttcacaatatccaatgaagaaggtctcattatctccatgataaaganggggaaactaaggtcagaagggttaactcaactgtctattgtcacatgatgaataaatagatgaagtgagatacaaagctaggtttgattcaaagcccttactttcctaattaaactatgatgcgtatttatttttctgcaccttcctttcttccacaaacacatattgatagatgc

SEQ ID NO: 22122 - DNA, 385 bp, Homo sapiens
  misc_feature 375: n = A,T,C or G
aagcaccaactgtatttgaaggaactgtattttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtgaatgtgtatatatatatacctgaatacaggaacatcggagacctattcactcccacacactctgctatagtttgcgtgcctttgtggacacccctcatgaacaggctggcgctctaggacgctctgtgttcactgatgatgaagaaacctagaactccaagcctgtttgtaaacacactaaacacagnggcctagata

SEQ ID NO: 22123 - DNA, 371 bp, Homo sapiens
  misc_feature 9: n = A,T,C or G
aacaccaanggctgttcctggaacaatataagggagttgggtttggatttggtttggatttggtgatggagttagaggggttagagagaccgactaatgcagtgtctggtaaggaatttagatcacattccaagtgtaatgaagccatggagcattttatgcagaggagctaatctgaggaatgttttagaaagagccttctgacatgggaggggaaaatagcagaagcagaaaaaccagttaggagattgtggcagttggacacgtaaggcatgatagtggcttgacacagtggtagtgctggaattggagacagatagtggaatttaggacatggctcgaagcagagctaatagcacttgtttatgggt

SEQ ID NO: 22124 - DNA, 398 bp, Homo sapiens
  misc_feature 25, 173: n = A,T,C or G
tgtctgatgaagagaaggggcccgnagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtngaaattgaaagttatgaagatcaggtattgataacagaacatggcgacttgggaaatggaaagtttttggatccaaagaacagaatctgttttaaatttgatcacttaaggaaggaggcaacttgatccaagaccctgtgaagtagaaaatgcagttgaatcatggagaacttcagtagaaactgctctgagagcttacgtaaaagaacattacccgaatggagt

SEQ ID NO: 22125 - DNA, 377 bp, Homo sapiens
  misc_feature 4, 58, 204: n = A,T,C or G
gacngtaggcccgggtggttgctgcctaaatgggcaagttcatgaaacctgggaaggnggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcnagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtc

SEQ ID NO: 22126 - DNA, 221 bp, Homo sapiens
  misc_feature 4, 28, 54: n = A,T,C or G
atancacagtataaggaaaagagaaagnttcaaggaaaaacaagtgttagagantattcgcccaaaaaaaaatgttgccatggagcaaataaaattagtgctatttcagatttaaaacctttaaaatgagaaagcagagattttacgaattcagggaagatagagtaagatattataagaagatcaaatgggagctatcagagttcaggtaggaaattgaa

SEQ ID NO: 22127 - DNA, 349 bp, Homo sapiens
  misc_feature 5, 23, 34, 37, 57, 62, 209, 212, 214, 264: n = A,T,C or G
ggganaacccctgaaacagttgnccaggatgttnttnagagcccctgtgtattgggngccangggaacatcttgagttgtttcatctgccaacctcagtacatatgttgatgttcattagtgaaacagttatcaatctggccagaattgccctgagtactgtgttttacttcagcatatgtttctgaaaaccagtacaatacactctgnggngncatgaagagagtaatccccagttacacagtaatatgcttgaatttgcggntctccgggagaataatctacaccccagtccaaccctatgcaccacacatagcggctaagaagacattaaactttctcccaatcac

SEQ ID NO: 22128 - DNA, 379 bp, Homo sapiens
  misc_feature 27, 50, 165: n = A,T,C or G
ggacccacacagtggctaagtagcttntttggtgccaggagctggcaggnagcgatgctgaaatccaaaccaggcaatctggccctccttattcaccctctcataccaccagtgctacccattataacctgtgttcacttcgcttattactgtggcccttctggngactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactggtcttgaatgacattctca

SEQ ID NO: 22129 - DNA, 400 bp, Homo sapiens
  misc_feature 27, 178, 179, 311, 361, 367, 393: n = A,T,C or G
tacgttaatatcgccccactccgcgcntgggacgatttcttcccgggttccgatcgctttgcccggccggacttcagggacatttccaaatggaacaaccgcgtagtgagcaaccctgctctattaccagaccaactacctggtgggggctgccaatgatgatttccattgtgggggnnctgagtcccttcaacatgatcctgggaggaatcgtggtggtgctggtgttcacaagggtttgtgtgggcagcccacaataaagacgtccttcgccggatgaagaagcgctaccccacgacgttcgttatggnggtcatgttggcgagctatttccttatctccatgtttggaggagcatggnctttgngtttggcattacttttcctttgctgntgatgtt

SEQ ID NO: 22130 - DNA, 397 bp, Homo sapiens
  misc_feature 21: n = A,T,C or G
cctgattcagaatggagactngaccttccagaccctggtgatgctggaaacagttcctcgaagtggagaggtttacacctgccaagtggagcacccaagcgtgacgagccctctcacagtggaatggagagcacagtctgaatctgcacagagcaagatgctgagtggagtcgggggctttgtgctgggcctgctcttccttggggccgggctattcatctacttcaagaatcagaaagggcactctggacttcacccaacaggactcgtgagctgaagtgcagatgaccacattcaagggggaaccttctgccccagctttgcatgatgaaaagctttcctgcttggctcttattcttccacaagagaggactttctcaggccctgggtgctaccg

SEQ ID NO: 22131 - DNA, 247 bp, Homo sapiens
  misc_feature 1, 52, 53, 55, 207: n = A,T,C or G
nccccagtaattagacaagagaaagattttaagggcattcaaatcggagggnngncatcaaattgttcctgtttgcagatgacatgatcttatatataggaaaacctgaagactctaccagaaaacttttagaacaaacaaattcagtgaagttgcaaaacacaaaactaatacacaaagattggttgcgtttatatatatgaacancaaactcgctgaaaaagaaattaagaaggcaaacccattt

SEQ ID NO: 22132 - DNA, 227 bp, Homo sapiens
  misc_feature 7, 16, 33, 50, 61, 64, 81, 89, 150, 193, 206: n = A,T,C or G
acccagngcccctatntttattatgggccgggnataccgaattaactagnaaataactttnttnggagtagccaaagctangaccctcnaaaccagacgagctacctaagaacagctaaaagagcacacccgtctatgtagcaaaatagngggaagatttataggtagaggcgacaaacctaccgagcctggngatagctgggtgnccaagatagaatcttagttca

SEQ ID NO: 22133 - DNA, 251 bp, Homo sapiens
  misc_feature 33, 51, 55, 80, 157, 167, 239: n = A,T,C or G
gaacccagttcatcatagatattttgtctatgntaccaatgctaatggggncttntccccattatctctaatgactaggngttatcatatatatgaaagatattgatttctacatattacttttgttccccacagtaattctaaattctcatagggnttctgggggntttaaattgattctttaatatatattttactaagtataacaaattaattctaaattctcaaaggttagaagntggtcatctcag

SEQ ID NO: 22134 - DNA, 172 bp, Homo sapiens
  misc_feature 2, 29, 80: n = A,T,C or G
tnatttttgtgtgaattatatttcgcggngaatatacattacattttctttatccattcatcattgatgtgcacttaggntgattccatattttggctattgtgaatagtgtgttaataaacatgagagtgcagttaaaaaaaaaaaaaaaaaaaaaaaaaaaaaaaaaaaa

SEQ ID NO: 22135 - DNA, 400 bp, Homo sapiens
  misc_feature 4, 12, 29, 30, 31, 32, 44, 66, 71, 73, 74, 97: n = A,T,C or G
gacnaaactggncccagggccccctcttnnnnatgggccgggancccctggcacatatagtaaggnaagtntnncactctgaggaaggtttcacagnctattctcattttaattgtcagttgagtggacatgaagaaggcatttctgttttacaacttcaaatacatttatttacttaaacaatatgcataaatcagaaacatttacatcctaatacatatagtagcaactcataaagaagacatcggataatgaaatttaactgtaaaatagtagttctacaattataacaaagtactattgagtttcaaattacaggacgttgaataaaagaaaacctagccaggctaaagtcatttctataaattcttttgaggatagtcatgagatttccaatgag

SEQ ID NO: 22136 - DNA, 385 bp, Homo sapiens
  misc_feature 24, 28, 208: n = A,T,C or G
ggcccgatatgatgatactcaagnactntttatggtgcattggataggacgtggcatatttagatggaatctagtgataatattgaaggcgggcttggcgaggtgtttcacacctataatgccaaaactttgggaggccgaggcgggaggatcactttgagccctagagttcgagacaaacctgccaacatagtgagacccccgtctntacagaaaatacaaaaattagccaggtgtgccaagtggtgatgtgtgcctggtacttcccagctactcaggaggctgaggtgagaggattgcttaggcccgggagattgagacctcagtgggctgagatcgcgccactgcacttcagcttgggcatcaagcaagaccctggctcaaa

SEQ ID NO: 22137 - DNA, 377 bp, Homo sapiens
  misc_feature 6, 55, 57, 263, 269: n = A,T,C or G
attccncagtcctgttgtgagcacagttttgaagggtttattattgtcaaaatangntttgttttgttttgtttatgttgggtttttaatgttgtctcttgacccttaatgctcaggttcttgtgggagttaatcagccacatccaatgttaccttgagggggaagaagagggtgatgctcagaagctaaacaagacaggggccacatgaccctctattgattagccccaagtagaaagtcctgtggttttatgtttaatggnaatagntgatcatatatggcataattttctatcagcttcctactcagtcactataaacacagacttgaaatagtactttaaatgtccaaatacctaaatgtgctaaactggagg

SEQ ID NO: 22138 - DNA, 386 bp, Homo sapiens
  misc_feature 4: n = A,T,C or G
gacncattgaggcagccagcgcagggttttctgctgagggggcaggcggagcttgaggaaaccgcagataagtttttttctctttgaaagatagagattaatacaactacttaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgactt

SEQ ID NO: 22139 - DNA, 367 bp, Homo sapiens
  misc_feature 4, 29, 30, 32: n = A,T,C or G
cacnccaagtaatacttaacatctcagtnnanaattttgcatgttctgtagttttgtattaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaaggtaggtgcagtgtgtggaagctgcaaacaagtaggccttttattcattgatatcttttcccaagtactggattttaaatctgtatgtatcctgtttgatttt

SEQ ID NO: 22140 - DNA, 386 bp, Homo sapiens
  misc_feature 5, 28, 53: n = A,T,C or G
caacntcattttcatggcacagataatncattggatgctcatagtttaagtcntcaggtggtgactggaggagccagaaggtccctttgggcctgtcctctcaccagcatcaactgcaccaaaaagatctcattctgattatcagggatgaacccccccactgggtgatcaggcaaactacgtgcattttaaaaaactatatcctgctgggtgcagtgcctcatgcctgcaatcccagcattttgggaggttgaggaggacggattacttgaggccaggagttcgagaccagcctggccaacatggtgaaaccccatctcacctaaaaataaaaaattagctgggcgtggtggcagccacctgtagtcccagctactcaggagact

SEQ ID NO: 22141 - DNA, 306 bp, Homo sapiens
  misc_feature 25, 57, 60, 65, 208: n = A,T,C or G
ataccgtaaatgaagatcatcaagnattttttaagaatgttgaaaccaatctgaggnagntaggnatcacaataaaatagtacagaagctgacaaacaaaacactcagtatagaaaagagtgtaaccaacctgatagagctgaaaaaacacagtacaaaaatttcataatttaattgtaagtattaacagcagaatagaccaacctgnggaaagaatctcagagcttgaagactggctttctgaaataaaatagtcagacaagaataaagaaaaaataataaaaaggaacaaacaaaacctccaaa

SEQ ID NO: 22142 - DNA, 387 bp, Homo sapiens
  misc_feature 30, 205: n = A,T,C or G
cagccaggtggagtaactaaggatatcatnagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaactttngattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactg

SEQ ID NO: 22143 - DNA, 400 bp, Homo sapiens
  misc_feature 4, 16, 35, 36, 54, 62, 66, 160, 211, 215: n = A,T,C or G
tggnggggaagcccangtaacacctgtgattactnntgtatcatgacccttggncataatangagntatctccacactagcagagaccaaccgaacccccttcgaccttgccgaaggggagtccgaactagtctcaggcttcaacatcgaatacgccgcnggccccttcgccctattcttcatagccgaatacacaaacattattataatnaggngccctcaccactacaatcttcctaggaacaacatatgacgcactctcccctgaactctacacaacatattttggcaccaagaccctacttctaacctccctgttcttatgaattcgaacagcatacccccgattccggtacgaccaacttcatacacctcctatgaaaaaacttcctaccactca

SEQ ID NO: 22144 - DNA, 365 bp, Homo sapiens
aacccctattattaacaataatgccttgttttgtatagtgctttataatttacagagagcgttaacatccatcaatttatttgaccctcaaaacaaccctctttgtttacttatgcatatgtataagtaaaatatgtaatattacctccagttgaggaaaccaaaacttggctgggcgcggtgggtcaccgcctgtaatcccagcactttgggaagcctaggcaggtggatcctgggacctcacttagaataactaagcacggtgctcgcttcggcagcacatatactaaaattggaacgatacagagaagattagcatggcccctgcgcaaggatgacacgcaaattcgtgaagcgttccatat

SEQ ID NO: 22145 - DNA, 392 bp, Homo sapiens
  misc_feature 3, 4, 26, 28, 29, 30, 210: n = A,T,C or G
ggnnctggtaggatgaaacaatttgnannnagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcnaaatgtacaaacttagaagaaaattggaagatagaaacaagatagaaaatgaaaatattgtcaagagtttcagatagaagtttgaagtggaaaactggaagacagaagtccggggaaggcgaagaaaagaatagagaagatagggaaattagaagataaaaacatacttttagaagaaaaaa

SEQ ID NO: 22146 - DNA, 370 bp, Homo sapiens
  misc_feature 3, 27: n = A,T,C or G
ggngggtcaaaagtgccggtcaaaatngaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggaatatatttttgggagaggccttttccagttatatcagcgttcataatgatagcaatcaagttgtaaaagacatattagtaaaagctgatcttcagacaagttctcagcgtttaaatctttcagcctcca

SEQ ID NO: 22147 - DNA, 397 bp, Homo sapiens
  misc_feature 24, 49, 50, 89, 103, 273, 319, 386: n = A,T,C or G
gaacgtttactttgaaaaaatttnagtgttcaaagcaggcccgagccgnntggataccgtagctaggaataatggaataggaccgcggntctattttgttggntttcggaactgaggccatgattaagagggacggccgggggcattcgtattgcgccgctagaggtgaaattcttggaccggcgcaagacggaccagagcgaaagcatttgccaagaatgttttcattaatcaagaacgaaagtcggaggttcgaagacgatcagataccgncgtagttccgaccataaacgatgccgaccggcgatgcggcgggggntattcccatgacccgccgggcagctttccgggaaaccaaagtctttgggttccggggggagtatggncccaaagctga

SEQ ID NO: 22148 - DNA, 238 bp, Homo sapiens
  misc_feature 50, 147, 175: n = A,T,C or G
tctaaataccacgatcaaaattacaagcatcaagcacgcaacaatgcagntcaaaacgcttagcctagccacacccccacgggaaacagcagcgattaacctttagcaataaacgaaagtttaactaagctatactaaccccagggntggtcaatttcgtgccagccaccgcggncacacgattaacccaagtcaatagaagccggcgtaaagagtgttttagatcaccccctcccca

SEQ ID NO: 22149 - DNA, 179 bp, Homo sapiens
  misc_feature 23, 40: n = A,T,C or G
aggtgttttacagccccatcttngcggtgtgggtactgcnttcatgtattagaagccagaggagcttcaaaatatgtacagaattgagtgggatcttgggtgtaacctattaccatgagaaattggcaagaaggaaatcacttgttttctgcatgttcttatgtaaccttgaacaaact

SEQ ID NO: 22150 - DNA, 304 bp, Homo sapiens
  misc_feature 29, 30, 49, 55, 59, 72, 81, 84, 139, 157, 176, 199, 242,274, 278, 280: n = A,T,C or G
tgtccagaaatatagcaaggtgtaggctnntgtggtaattctatttgtntatctnagcngaattaaaatgtntagcttggnggnatttttatagccataaaagaaaatctttaggctttcaaaataaggatgactttanaataatattgtgtcatanaattaattttcagccatgnggaccatattttgtatccaaggntccttatttaaagctttcaacatgtacaggaagttggaaattnttggtttatgactttgtctaataaagagatanggtntnaacacattcttgatcaccaaacaa

SEQ ID NO: 22151 - DNA, 262 bp, Homo sapiens
  misc_feature 21, 25, 27, 29, 162, 194: n = A,T,C or G
tcttaacttttaaattaagantgcntnanttaagatgaatcttgatttttaaattagtatgggtttaagatagttttacagatagattagataatctatctagagatagatagggagagatatctatcaatacatatctctatctagatatagatagatggntttctatatagacctatctatctatatatgtntacatctatatatgtctacacatatctctatacacatatatatatttatatctacatctatatttcta

SEQ ID NO: 22152 - DNA, 183 bp, Homo sapiens
  misc_feature 56, 103: n = A,T,C or G
gatcaaaaagtaattataaatacgtattacaaacaagtggatgtttttaatgaccnattgagtaagaacatccctgtcttaactggcctaaatttcttctggnagtgtcagttcaactttcagaagtgccacttaaggaagtttgatttttgtttttgtaatgcactgtttttaatctctctc

SEQ ID NO: 22153 - DNA, 388 bp, Homo sapiens
  misc_feature 28, 51, 54, 55, 57, 58, 59, 113, 117, 138, 159, 204, 228,293, 310, 344: n = A,T,C or G
gaacagataatgatggagtatttgatangttggatgaatatatatataganacnngnnngggacactttttcccctccatatggacccagtcgacctgataaaaagcaacgtntggnaaatattgaaaactccaggcntcgaaaacaagagcagaagcnccttcagccacagccttataaaagggaaggtaaatggcataaatntgggcgcactaatggaagacaagnggcaaatcttgaaatagaattggggcaattaccttttgatcctcaatactgattcacaattgagntaaattagacaactgtnagagaaaaatttatgctttgtataatggttgggnttgaaactaatgaaattaccaagatgacaatgtcttttcttttg

SEQ ID NO: 22154 - DNA, 303 bp, Homo sapiens
  misc_feature 4, 32, 33, 176, 182, 242, 251: n = A,T,C or G
gccnagtatccatctaaactggagggaggggnngcagacccagcttagagttcttctttctttcttaagccctttgctctggaggaagttctccagcttcagctcaactcacagcttctccaagcatcaccctgggagtttcctgagggttttctcataaatgagggctgcacatngcctgntctgcttcgaagtattcaataccgctcagtattttaaatgaagtgattctaagatttggnttgggatcnataggaaagcatatgccgccaaccaagatgcaaatgttttgaaatgatatga

SEQ ID NO: 22155 - DNA, 381 bp, Homo sapiens
  misc_feature 15, 206, 320, 352, 361, 371: n = A,T,C or G
gatagtggacaaagnaacttgtggtcttttaaaactgggactgatacttttttgagagagtatcgtgtcgaaagtgtgatgttctaccactttaccaataactaattttaaatacacattgtcctctcgatttttggaccaaacagacgctcacagtggaggcttatcaagggttgcattggggaagaagcctctccctctctgtnagcaccagctggtaaaggtgactgtacagatgtgcattttccttttggtataaatggtccacagcactaactggtaaggcttattgtacagtatattggcagtattcttctggntcagcataccttatagttcatatataacctgnattaattgnttaggattgngcattaaaag

SEQ ID NO: 22156 - DNA, 400 bp, Homo sapiens
  misc_feature 25, 29, 33, 45, 174, 192, 198, 217, 258, 267: n = A,T,C or G
ttatattcctcctcattgaaggccngggnggangctactaaaggnttctacgataaagacagttcagggtggagttctagcaaagataaggatgcgtatagcagttttggatctcgtggtgattcaagagggaagtctagcttcttcagtgatcgtggaagtggatcaaggggngggggggatgatcgtggncggagngattacgatggcattggcngccgtggtgacagaagtggctttggcaaatttgaacgtggnggaaacagncgctggtgtgacaaatcagatgaagatgattggtcaaaaccactcccaccaagtgaacgcttggaacaggaactcttttctggaggcaacactgggattaattttgagaaatacgatgacattccagttgagg

SEQ ID NO: 22157 - DNA, 278 bp, Homo sapiens
  misc_feature 20, 22, 46, 94, 148, 171, 186, 244, 277: n = A,T,C or G
tgctgtggctcacgcgtggngngccagcactttgggagactgaggngggtggatcacagggtcaggagttcaagatcagcctggccaagatggngaaaccctgtctctactaaaaatacaaaacaaaattagccgggcatggtggtanggtgcctgtaatcccagctactnaggaggctgaggcangagaattacttgaacccggcaggtggaggatgcagtgagccgagattgtgccactgcnctccagcctcggcaacagagcgaaactccatcnc

SEQ ID NO: 22158 - DNA, 208 bp, Homo sapiens
  misc_feature 23, 28, 30, 33, 115, 176, 177: n = A,T,C or G
ctttggggacttctagatagggnacggnanggncttttattctgttactggacatgaaaactttgtctaatttcttactctattgtacgtttacagtcgcagcactaaaaatggntgacatcaaacatttttaacaaaatgatgtacaaactaaggactatttattgataatgtgnngctactcttgtcagacaatggctataaactg

SEQ ID NO: 22159 - DNA, 400 bp, Homo sapiens
  misc_feature 3, 19, 57, 109, 313, 367, 368: n = A,T,C or G
ccncctcttttaccaaggnacccgtttcatgggccgcgttcgcaccaaaaccgtgangaaggcggcctgggtcatcatagaaaagtactacacgcgcctgggcaacggnttccacacgaacaagcgcgtgtgcgaggagatcgccattatccccagcaaaaagctccgcaacaagatagcaggttacgtcacgcatctgatgaagcgaattcagagaggcccagtaagaggtatctccatcaagctgcaggaggaggagagagaaaggagagacaattatgttcctgaggtctcagccttggatcaggagatntttgaagtagatcctgacactaaggaaatgctgaagcttttggacttcggcagnntgtccaaccttcaggtcactcagcctacaggt

SEQ ID NO: 22160 - DNA, 400 bp, Homo sapiens
  misc_feature 5, 24, 32, 33, 42, 186, 187, 188, 332, 341, 356, 366: n = A,T,C or G
taagnaagtttgaagtggaggaantggggggnnagaagttcnggaaggcgaagtaaaagaatagagtaagatagggaaattagtaagataaaaacatacttttagaagaaaaaagataaatttaaacctgaaaagtaggaagcagaagaaaaaagacaagctaggaaacaaaaagctaagggcggnnntgtacaaacttagaagaaaattggaagatagaaacaagatagaaaatgaaaatattgtcaagagtttcagatagaaaatgaaaaacaagctaagacaagtattggagaaatttagaagatagaagtttgaagtggaaaactggnagacagaangtacgggaaggcgangaaaagaatnggagaagataggggaaattagaagataaaaacat

SEQ ID NO: 22161 - DNA, 389 bp, Homo sapiens
  misc_feature 4, 5, 30, 55, 56, 58: n = A,T,C or G
agannacaaacactaatgttaattgcccanttgagtgcttcatgcctttagatgnncnggctgacagagaagattcccgagagtaaatcatctttccaatccagaggaacaagcatgtctctctgccaagatccatctaaactggagtgatgttagcagacccagcttagagttcttctttctttcttaagccctttgctctgggggaagttctccagcttcagctcaactcaccgcttctccaagcatcaccctgggagtttcctgagggttttctcataaatgagggctgcacattgcctgttctgcttcgaagtattcaataccgctcagtattttaaatgaagtgattctaagatttggggttgggatcaataggaaagcatatg

SEQ ID NO: 22162 - DNA, 188 bp, Homo sapiens
  misc_feature 19, 35, 40, 45, 60, 61, 66, 69, 73, 102, 105, 117, 157, 162: n = A,T,C or G
tagtatggccggaaagcgntcttggaagggaaagnaagtntaggntggggggaataaaannagggnggngggngggccagaaagcaggggtctcaacctcgnggncagcaatctgcngaagaagagaacttcaaaaaaaaccaactagaagcaacangcggnggaaaaaaaaaaaaaaaaaaaaaaaa

SEQ ID NO: 22163 - DNA, 400 bp, Homo sapiens
  misc_feature 21, 24, 173, 180, 205, 346: n = A,T,C or G
cctttcctcctattagaaggnganggcggggaccagaggggcggagaggtggagggtttatagagggacaatttggggtatgggccacttccagagaggcagtgtcaggattgggcccattgtgggttttgtcagagcatgagagcccttgctggagtaattttatgagctgntgggggnaaatcaataaaccgagaatgtggtnaaatgtcaaaaaattgaggagattgaagtataataccccaatatttttccagtataacaaacactgttatttcataaaagagaggacatttcttgcccttttttcttgccattggtgatattaaaaagtaaaaaagtgagnctcaattgcttaaacctgggaggcggatgttacagtgagctgagattgcaccac

SEQ ID NO: 22164 - DNA, 300 bp, Homo sapiens
  misc_feature 20, 22, 30, 31, 124, 175, 178: n = A,T,C or G
tagtataaaagacttatggnancgcgggtnngcatatttttaaagtaattttactgagctcacatatcaagaatatgaaatcatgagatagagataagttctctcaattctcattagaattggntggaattaattccagattattttcctgggagattttattttaagatgtgantgngacaaccattacagttacctgtaaggcttgagatctgcatccccaaagtatgttcctttgttagtgttagttatttgagattcacagaaaatgcccagtagcaacagtctgtgctgtctttc

SEQ ID NO: 22165 - DNA, 102 bp, Homo sapiens
  misc_feature 28, 30, 31, 91, 98, 101: n = A,T,C or G
taacaaacccacaggtgcctaaacccancnnacctgcattaaaaatttcggggtgggggcgacctcgggggcagaaccccaaccttccggngcggggncang

SEQ ID NO: 22166 - DNA, 388 bp, Homo sapiens
  misc_feature 52, 55, 57, 58, 85, 138, 149: n = A,T,C or G
gagcgcggaggtggtggcggcggattttttggcagctcgggactgagggcangantnngcatgattcttcagaggctctccaggntctcctctgtcattcggtcagccgtctcagtccatttgcggaggaacattggngttacagcagnggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaa

SEQ ID NO: 22167 - DNA, 176 bp, Homo sapiens
  misc_feature 2, 3, 162, 165, 168: n = A,T,C or G
cnngcattacttttaactgctatgtataaaggaaagtgtgtcttttgacttcatcagttatttctcttgtgcacagagaaaaatgcattaaaaatgactaacaaaaaaaaaaaaaaaaaaaaaaaaaaaaaaaaaaaaaaaaaaaaaaaaaaaaaaaaaaanttnggncccccccc

SEQ ID NO: 22168 - DNA, 388 bp, Homo sapiens
  misc_feature 52, 53, 54, 133, 204, 324, 371: n = A,T,C or G
gaacccgaaagaagatgaaacaggctttgtggatgctacagtcaatgagggnnngggctcccgatacgggattagaggatttcctacaatcaagatatttcagaaaggcgagtctcctgtggattatgacggngggcggacaagatccgacatcgtgtcccgggcccttgatttgttttctgataacgccccacctcctgagcngcttgagattatcaacgaggacattgccaagaggacgtgtgaggagcaccagctctgtgttgtggctgtgctgccccatatccttgatactggagctgcaggcagaaattcttatctggnaggtcttctgaagttggcagacaaatacaaaaagaaaatgtgggggnggctgtggacagaagct

SEQ ID NO: 22169 - DNA, 301 bp, Homo sapiens
  misc_feature 7, 56, 63, 81: n = A,T,C or G
gaatccnacaacaaggaatttatcatccatttattaacagtaatggcagcatttgnctcgatnttctaagatcacagtggncgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattact

SEQ ID NO: 22170 - DNA, 345 bp, Homo sapiens
  misc_feature 29, 53, 56, 57, 60, 102, 107, 205: n = A,T,C or G
ggacctcttgccgtgaaggaatccctgtntatagtaggtgttcaatttagaanagnngangaatgaattgtattgtaacaccattttaaaaagttgttaggngaggnataaacaggcactgaggaggtagtgacctgactgcctggaaaaggtagcaagtgctttaatagggaatgacttctgagctgaatttttgaaggctgangtttctctactagatgagataggcagagacatcttgtaaatgaggaaggaagaggcagagggagcaagaatgaacaaaggccctgagcatatggaaggacacagggtgtttggagagcagagggaaaagaaatgagattg

SEQ ID NO: 22171 - DNA, 261 bp, Homo sapiens
  misc_feature 25, 26, 27, 46, 51, 56, 155, 201, 203, 259: n = A,T,C or G
gaaccgatctgaatcaagccctggnnnttatgaagacaaaagcggntgagngagtnatataaacttacttccattctgtttcggattttaagtttgagagacttgctaatgaatctcctttatgttgttttccttttcattgtttttggattgtnttatgtttgtccttttttttcttaatgtggatttcattgagttgantntttgataatctgcaatctagataatttgtactgctaaagttttaataaactcggcntg

SEQ ID NO: 22172 - DNA, 301 bp, Homo sapiens
  misc_feature 65, 107, 152, 156, 180, 295: n = A,T,C or G
aaactttggcactgggcatgggggctgcgacctataatcccacacactttgagaggctgaggcangctgttatcacttgaggtcaaggagttcgagaccagcctggncaacagggagaaaccccggctctactaaaaatacaaaaaaaagtnactncgggtgtggtggctcgtgcctggnatcccagctactcgggagtccgagacaggacaatcggttgagcacgggaggcggaggttacagtgagctgagatctggccactgcactccaccctgggggacagagcgagacttntggtct

SEQ ID NO: 22173 - DNA, 388 bp, Homo sapiens
  misc_feature 1, 27, 32, 56, 61, 300, 385: n = A,T,C or G
naggccttgaggcagccagcgcagggnttttntgctgagggggcaggcggagcgcngaggnaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtntttaaaagaaaattgaggagaaaggactacagagccccgaattaataccaatagaagggcaatgcttttagattaaaatgaaggngac

SEQ ID NO: 22174 - DNA, 400 bp, Homo sapiens
  misc_feature 26, 31, 58, 349: n = A,T,C or G
tagtctctgtccctcactagattctntgtgntgtcactagactgaagctctgtgaggntaaggatgatattttgattacagttatatgtccagcactcagcacagtgctttgacacacactataaatatttgttggatggatggggaatggctctgagacttcacttttttactcatgctaattgttcatgttccttcacctggtcctcaggtgatgtggttttgggtctgtttaccatcactaggtaatcatttaaactcagatttgctctctgtcaaagtgtagttttcagaactatatcccaggtattattttattagtccaagaaagaataggaatattacttgngtgcttcttttcattcactcagaaactcatattgagcctctattaaatttc

SEQ ID NO: 22175 - DNA, 140 bp, Homo sapiens
  misc_feature 25, 26, 28, 31, 103, 109, 119: n = A,T,C or G
attgtgtcttttctaataaaatgcnngnagntgcaaatatttccagcagtttttaaaaacaagcataatgagttgcttttgagagcaactaaaggatgtatangatggntggatggcangaagaaaggaaggaaagaaag

SEQ ID NO: 22176 - DNA, 116 bp, Homo sapiens
  misc_feature 8, 15, 32, 42, 45, 46, 53, 60, 64, 65, 68, 81, 86, 87, 97,100, 104, 108: n = A,T,C or G
attgaagntgaaatntgcagcaacatttttgntgcttgcaanatnncgggggnggcgggngggnnccntaaataatttctncccanntttgaaaganttntatnaatncccctact

SEQ ID NO: 22177 - DNA, 400 bp, Homo sapiens
  misc_feature 18, 21, 27, 176, 301, 305: n = A,T,C or G
acctgcattaaaaatttnggntggggngacctcggagcagaacccaacctccgagcagtacatgctaagacttcaccagtcaaagcgaactactatactcaattgatccaataacttgaccaacggaacaagttaccctagggataacagcgcaatcctattctagagtccatatnaacaatagggtttacgacctcgatgttggatcaggacatcccgatggtgcagccgctattaaaggttcgtttgttcaacgattaaagtcctacgtgatctgagttcagaccggagtaatccaggncggnttctatctacttcaaattcctccctgtacgaaaggacaagagaaataaggcctacttcacaaagcgccttcccccgtaaatgatatcatctcaac

SEQ ID NO: 22178 - DNA, 378 bp, Homo sapiens
  misc_feature 31, 32, 126, 149, 164, 322: n = A,T,C or G
atgctcagacttcaccagtcaaagcgaactnntatactcaattgatccaataacttgaccaacggaacaagttaccctagggataacagcgcaatcctattctagagtccatatcaacaatagggnttacgacctcgatgttggatcanggacatcccgatggngcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgnaaatgatatcacctcaacttagtattatacccacacccacccaagaacagggtttg

SEQ ID NO: 22179 - DNA, 370 bp, Homo sapiens
  misc_feature 30, 81, 204, 205, 209: n = A,T,C or G
atatcaatataaacgaacaaaaaacttatnacctccttatgtggtaaataaggcctatgtaggaaaatgattctacttggntcacttatgtttctgcatactttgtaacagaaacattgattcttttctgttctgaattatcttttcaaagatgtgttatagcacattcttggaagagattgtgtttcagtcaagagcaaaggnngagnttgtagtcttagaaggcacgatagcatctcccattggcagaaaaaatagtcatgcttactgtctaatataaaagattcaaatttcctaaactaaaactaagctcttaaattcagatttccttttctgaaatgcaatcccatgaatgtgtaggtgtcattta

SEQ ID NO: 22180 - DNA, 236 bp, Homo sapiens
  misc_feature 30, 32, 33, 50, 58, 169: n = A,T,C or G
ggagaacgtaatatgctgtctgcttttaantnnccagactcgttttgtanctaagggncaattatttaaaattgtttgctaattaaataatagataatgggaaaaaaaaaccagtaggctggttgcagaggcttgtgtctgtaatcccaacactttggaaagccaaggngggagaatcacttgagctcagagtttgagaccaacctgagcaacatagtgagaccctgtctctacca

SEQ ID NO: 22181 - DNA, 389 bp, Homo sapiens
  misc_feature 30, 33, 209, 210, 340: n = A,T,C or G
atagcctaaacttctaatctcagtgtaaantcngaacttttcagtagtgttgctcatttccctcccttgaacgggagggaatagagcagaacttatttccagcattctaactcatctgggggcttcttgaaagagtgtgtttcacttaacagagggctcacatggggaaaggcagcatgtctgggaaaagctgcacaacttgaagctgnnaccccaggctgctcccaaggctcagaacacgcctgctaattagtgaagggaaggttgtcctcatcatgaaaccagtctgcaaaaactggggagagatgatttttttttttaattcccattttttccagcngaaaaccacaaggcaaaaacaggaaaacaccccattcaaaggggagaaa

SEQ ID NO: 22182 - DNA, 382 bp, Homo sapiens
  misc_feature 33, 134: n = A,T,C or G
gagagcaatttccgtctgatctatgacaccaanggtcgctttgctgtacatcgtattacacctgaggaggccaagtacaagttgtgcaaagtgagaaagatctttgtgggcacaaaaggaatccctcatctggngactcatgatgcccgcaccatccgctaccccgatcccctcatcaaggtgaatgataccattcagattgatttggggactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgccactcgacttt

SEQ ID NO: 22183 - DNA, 235 bp, Homo sapiens
  misc_feature 58, 221: n = A,T,C or G
agctcgtaaccagggtatgatctgctattgttatttctcctctttattggaaaaaggnctcagttttaattattttcttcccaaaataaatcacacatttgggtacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagnggggggggggggcg

SEQ ID NO: 22184 - DNA, 365 bp, Homo sapiens
  misc_feature 80, 116, 141, 209, 295: n = A,T,C or G
gactgcgataggaatatgtctggtcgctttaaaggcggaaaaggcttggggaagggcggggctaagcgccatcgtgaggngctccgggataacatccagggcattacaaaaccggntattcgccgtttggctcggcgcggnggcgtcaagcgcatttccgggcttatctatgaggagactcgaggtgtgccttaaggttttcttagagnacgttattcgagacgccgtcacctatacggagcacgccaagcgcaaaactgtcacagccatggatgtagtatatgccctgaaacgncaaggggcgcacctctgtatggcttcggcggctgaatctaagaatacgcggggctcctgagaacttcaaa

SEQ ID NO: 22185 - DNA, 324 bp, Homo sapiens
  misc_feature 21, 30, 174, 176, 177: n = A,T,C or G
actttcattgctcaatagggntcctgaggnggctatagagggtgaaattaagaatatttgggattctgcttttgtcttttttgttaaattttctagtgactaaggctgaaagtaaatatgggttgggaagacagataaatttgtacatgttcccgagaacaggagcaagagatntnngacaaagctatttcagtggctctttaatgtataaggaggcaaacacctgaaactctgaaaactctgaaattgagaggcaaaataaacttagagtcaagaaagaaatgccatttctgcagatcagaatataaacaccaaccacagctg

SEQ ID NO: 22186 - DNA, 100 bp, Homo sapiens
  misc_feature 2, 81: n = A,T,C or G
gnggaaaaaaaaaaaaaaaaaaaaaaaaaaaaaaaaaaaaaaaaaaaaaaaaaaaaaaaaaaaaaaaaaaaaaaaaaaaanaaaaaaaaaaaaaaaaaaa

SEQ ID NO: 22187 - DNA, 228 bp, Homo sapiens
  misc_feature 15, 60, 61, 66, 83, 84, 203, 207, 209, 213: n = A,T,C or G
gagggcggaaaaagnacaggtaactctaagaaactaaaatgttagtcattacttctaagnnttgtncctacgtctttataggnntattatgaaaatttttagttagttctatcatccatagtctagttttcatcctctcactaatttttagtcatttcttccataaaaacatatatacataatgggaaaatttagaaaatgtngggngngagnattacccggatttct

SEQ ID NO: 22188 - DNA, 252 bp, Homo sapiens
  misc_feature 7, 18, 32, 33, 58, 207: n = A,T,C or G
aacatcngaattaccagnataaatactgttannctcttgtccagtaacaagagttgantcatatggacagtatgatttattgtttatttttttaaccaaatacctcctcagtaatttataatggctttgcagtaatgtgtatcagataagaagcactggaaaaccgatcgtctctaggatgatatgcatgtttcaagtggtattganagccgcactgatggatatgtaataataaacatatctgttattaat

SEQ ID NO: 22189 - DNA, 336 bp, Homo sapiens
  misc_feature 55, 202: n = A,T,C or G
gtttgcaccagtgtgcatgggttcaaattctgcctccactgcttaacacctttgngctgaagtttcctcatctcttaaataggaatgatgatgatgcccactcacagcattgttgtaaacactaagtgattttatgtctctatagagctaagaaacatgtcaggttcatagtaattgctatgtaagtattggcttgttaagngagattatttatttaacgtgaaaagagagacctcttaggaaatgagtaagaaaaaaagaacagtaactcaatagaagtatttggagtggctctgaataggtacggttcaaaaaatataaatgacaaaattatat

SEQ ID NO: 22190 - DNA, 184 bp, Homo sapiens
  misc_feature 20, 29, 53, 80, 177: n = A,T,C or G
ttgctcgagctgtagcaaangagactggngccttcttcttcttgatcaatggncctgagatcatgagcaaattggctggngagtctgagagcaaccttcgtaaagcctttgaggaggctgagaagaatgctcctgccatcatcttcattgatgagctagatgccatcgctcccgggnaaaaaaa

SEQ ID NO: 22191 - DNA, 129 bp, Homo sapiens
  misc_feature 51: n = A,T,C or G
catgctgcataggtggtgggtatcctgtgagtaggactacttttaaatggnactagtaaagatttatcaaacaatgctgctattatgttgctatatttttaataaaatgaaaatcttaaaatcttaaaa

SEQ ID NO: 22192 - DNA, 241 bp, Homo sapiens
  misc_feature 218, 219: n = A,T,C or G
ttatggcccagggtagctacaattttctgattaaatctggtaaaataaaaggcagcctgtttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttnnattatactcttgatttttcaaa

SEQ ID NO: 22193 - DNA, 390 bp, Homo sapiens
  misc_feature 28, 40, 51, 55, 60, 87, 97, 204, 207, 256, 369: n = A,T,C or G
ggaccaagagtgagggttccaacttttnttcttatctggnaggtgttgggngcgngcagncgagatgtcagagaaaaagcagccggnagacttaggnctgttagaggaagacgacgagtttgaagagttccctgccgaagactgggctggcttagatgaagatgaagatgcacatgtctgggaggataattgggatgatgacantgnggaggatgacttctctaatcagttacgagctgaactagagaaacatggntataagatggagacttcatagcatccagaagaagtgttgaagtaaccctaaacttgacctgcttaatacattctagggcagagaacccaggatgggacactaaaaaaatgtgnttatttcattatctgcttgga

SEQ ID NO: 22194 - DNA, 174 bp, Homo sapiens
  misc_feature 8, 17, 28, 74, 108, 122, 123, 137: n = A,T,C or G
ctgctganggggcaggnggggcccgggnaaccgcagataaatttttttctctttgaaagatagagattaatacnactacttaaaaaatatagtcaatagggtactaanatattgcttagcgnnaagtttttaacggnattttaatagcttaagattttaagagaaaatatgagg

SEQ ID NO: 22195 - DNA, 389 bp, Homo sapiens
  misc_feature 8, 276, 292, 347: n = A,T,C or G
atccccanaaagttttatacattccttgattcttacaaaattttatattgccaaaaaactacaatagattctaccttcagtattcttttaatccttaatgattgtttctatgtagttttaaatgttttatattcacagaatatattttagatttgtatagaatttgaaaaatgggttccatgctaacttcagaaaatttggttaatatcttaattatagtttttttttaaatttcactttgccttctattacttcttcctgcttcttactagtagngttttatataataagnagcaaaagctctagtcttcaatctctctgaaaatagatgtcagctatttataggncttttcccttccatcttgctttaatggacacttttaaagctg

SEQ ID NO: 22196 - DNA, 346 bp, Homo sapiens
  misc_feature 24, 26, 50, 52, 53, 94, 135, 199, 202: n = A,T,C or G
gaccggaggagtcgagccagcgtntncgcgatggtgttgttggagagcgngnngttcctgacggagctgaccggacttttccagaagtgccggncgtcgggcagcgtctatatcaccttgaagaagtatgacggncgaaccaaacccattccaaagaaaggtactgtggagggctttgagcccgcagacaacaagtgtntgngaagagctaccgatgggaagaagaagatcagcactgtggtgagctccaaggaagtgaataagtttcagatggcttattcaaacctccttagagctaacatggatgggttgaagaagagagacaaaaagaacaaaactaagaaga

SEQ ID NO: 22197 - DNA, 389 bp, Homo sapiens
  misc_feature 60, 206, 207, 226, 294, 379: n = A,T,C or G
atctctcaaaacaatattactttgtcttttcatcttctacttttaactaataaaataagnggattttgtattttaagatccagaaatacttaacacgtgaatattttgctaaaaaagcatatataactattttaaatatccatttatcttttgtatatctaagactcatcctgatttttactatcacacatgaataaagcctttgnntctttctttctctaatgtngtatcatactcttctaaaacttgagtggctgtcttaaaagatgtaaggggaaagataatattggctgnctctatattgcttagtaagtatttccatagtcaatgatggtttaataggtaaaccaaaccctataaacctgacctcctttatggntaatactatt

SEQ ID NO: 22198 - DNA, 352 bp, Homo sapiens
  misc_feature 52, 139, 342, 349: n = A,T,C or G
gacctgagctcaccatagtctagaaaacaaccgaaaccaaataattcaagcnctgcttattacaattttactgggtctctattttaccctcctacaagcctcagagtacttcgagtctcccttcaccatttccgacggnatctacggctcaacattttttgtagccacaggcttccacggacttcacgtcattattggctcaactttcctcactatctgcttcatgccgccaactaatatttcactttacatccaaacatcactttggcttcgaagccgccgcctgatactggcattttgtagatgtggtttgactattttctgtatgtctccatctattgntgagggncct

SEQ ID NO: 22199 - DNA, 400 bp, Homo sapiens
  misc_feature 203, 387, 390: n = A,T,C or G
tggaacataatcttgttaagataaccttttttccaagataaataatactgttaaaaatagaaaaaagtaatctgtggcaacagcgcgtgattatttcaaacaaacaattggattttgaaacgcatctaaagggttaactttcaatttgtgaggataacactgaatatacttgtagatcgaatgctaatcttgaatgctttgcncatatgccagatactgctgcagaaaaatgtctgaagataagtaacttattagtatcttcatgctgaaataaatattgaacagtttttctatatgcataaaatgaataaaaacgcatctgaaatttccttttataccaacaagtttatgttactgaaatgctatttgagagattctttccttggnggntaaacttcgt

SEQ ID NO: 22200 - DNA, 125 bp, Homo sapiens
ggggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22201 - DNA, 372 bp, Homo sapiens
  misc_feature 55, 193, 205, 207, 352, 362: n = A,T,C or G
atgtatatactatattggagttcccacaatgtgttttgttttgttattttgatgnggggctgtttttttattccccataaatctgatctgattatttttcttgatgatgggcagaaaatgtttatagattatgtaaatcactgattaggcatagagggtgactggaaagtggggcaagagtggaagagagtanaaacgtgggagngncctctgtcttctagagcttctagttgatgttctgtgagagccgacctcttagtaaaccttagattatatgcttcagtatccacaacataatgttaaaggaatcaatagcacttaaatatgtcacttttttctgagaatacattgnctggaaaggnaaagccttgg

SEQ ID NO: 22202 - DNA, 400 bp, Homo sapiens
  misc_feature 64, 71, 72, 94, 104, 131, 220, 313, 318, 335, 376: n = A,T,C or G
atctatgggccggggaaaccaatatctcggtgccatttgctctctgcacatgctttggaggccnggggggnnggggctgtgacaactgccgcanacctgggggngaacccagtcccgaaggcactactggncagtcctacaaccagtattctcagagataccatcagagaacaaacactaatgttaattgcccaattgagtgcttcatgcctttagatgngcaggctgacagagaagattcccgagagtaaatcatctttccaatccagaggaacaagcatgtctctctgccaagatccatctaaactggagngatgntagtagacccagcttanagttcttctttctttcttaagccctttgctctggaggaagntctccagcttcagctcaactcaca

SEQ ID NO: 22203 - DNA, 388 bp, Homo sapiens
  misc_feature 4, 6, 30, 51, 206, 207, 386: n = A,T,C or G
gatncnaatatatcccaaaataataaattnataaatgatttttatggggantagaaactgattttattcagtcagttccctttgtattctaggcaaagtgcctatttctacacatgggatcacattcattcctcaatcaactttgagggggaagatagaatattctccacatgaaaaataaagaaactgatggtagagtgacttgnnccccattgattctccagggattaatgtgattaatgtgatacatggcaggtattcagtaaataatttggggatagattaatgaatgaacgaatgaatgagtggataattgaatgaattcacctttgacacaaaatgtcttttcgtgtcattggcagtgagaagatcctgagaaggattgntc

SEQ ID NO: 22204 - DNA, 366 bp, Homo sapiens
  misc_feature 4, 6, 207: n = A,T,C or G
aagncnatttatagattcaatgccatcctcatcaagctaccaatgcctttcttccagaattggaaaaaactactttaaagttcatatggaaccaaaaaagagcccgcatcaccaagtcaatcctaagccaaaagaacaaagctggaggcatcacgctacctgacttcaaactatactacaaggctacggtaaccaaaacagcatggnactggtaccaaaacagtgatatagatcaatggaacagaacagagtcctcagaaataacgccgcatatctacaaccatctgatctttgacaaacctgagaaaaacaagcaatggggaaaggattccctatttaataaatggtgctgggaaaactggctag

SEQ ID NO: 22205 - DNA, 139 bp, Homo sapiens
  misc_feature 4, 50, 53, 102, 121, 128: n = A,T,C or G
actncagtattacttacctattagccttatttatatatatcctataaagnganaatgattgaggtcagagaaatcacatcaccttaggactttatacaaggnaactgaccattcacatgcngttaggnaatatcccgaa

SEQ ID NO: 22206 - DNA, 382 bp, Homo sapiens
  misc_feature 5, 206: n = A,T,C or G
ggacnaagggagagagcaagcagcgagttttgaagctctgttcggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggcctngcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaat

SEQ ID NO: 22207 - DNA, 365 bp, Homo sapiens
  misc_feature 31, 51, 58, 67, 95, 100, 275, 303, 338: n = A,T,C or G
atatcaaaagattgaaaagatgaatatgttnatgacaacatggagcttatntcagcgnaatccaggntggcttaaccgaaagaaaacatcatgtnatgtnagtcatcagattaacaagttaaagcagaaaaattatatgatcatctcactagatacggaaaatatgtttgggagaagtcaagatccattcataattttaaaaacatcttagaaaattgtgaataggaaggaacttccttaaagtgatcaaagatatttgcaaaatatctgctgcnaacatcaaacttaatagtgaaatgtggnaagcatgtctttaaaatcagaaataaaacaagggngcctgcgtggtagcatattcattctac

SEQ ID NO: 22208 - DNA, 222 bp, Homo sapiens
  misc_feature 21, 49, 55, 90, 120, 149, 150, 154: n = A,T,C or G
attgaggcagccagcgcaggntttttctgctgagggggcaggcggggcntgaggnaaccgcagataagtttttttctctttgaaagatanagattaatacaactacttaaaaaatatagncaataggttactaagatattgcttagcgnnaagnttttaacgtaattttaatagcttaagattttaagagaaaatatgaagacttagaagagtagcctgagg

SEQ ID NO: 22209 - DNA, 379 bp, Homo sapiens
  misc_feature 7: n = A,T,C or G
aagcccngtggcagcattcagcagtatattttataaacaggaacctgtacagaagcgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaatt

SEQ ID NO: 22210 - DNA, 279 bp, Homo sapiens
  misc_feature 72, 177, 178: n = A,T,C or G
tttgtagatcaagcagggaaatacaccaaaacagtagcttcggagaagttaaaacagctgaccaaaactggnaaagcttccttcataaaggatgaaggtaaagacaaggccttaaagtcctctcaagcattcttttctaaattacaagatcaagtaaaaatgcaaatcaatgatgcnnagaaaacagaaaagaaaaagaagaaaagacaggatatttctgttcataaattaaagctgtaatatattttgaatataatgtaaatattaatgtgtaagcct

SEQ ID NO: 22211 - DNA, 313 bp, Homo sapiens
  misc_feature 5, 6, 208, 268: n = A,T,C or G
aaatnnagcaaggactaacccctatacctttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaagcctaccgagcctggtgatagctggttgtncaagatagaatcttagttcaactttaaatttgcccacagaaccctctaaatccccttgtnaatttaactgttagtccaaagaggaacagctctttggacactagc

SEQ ID NO: 22212 - DNA, 364 bp, Homo sapiens
  misc_feature 4: n = A,T,C or G
gacnggagaattttactaacaaattgtttgtataaatggcaaatttatacctttagagcaaatttatattttagagcagagaactcagtgtgcaaattacatagtaggtatgacaaagcaaaagacagaatgaatgaaaaggaaaagaagtcagtagaaaatattgaaaatgaattacagagattaaactgatatgtgagacagggaaaatatctaatacatctgtaatgttaggaccttttagcttagcaggagaggatgtagaaaatgggacagaagcagttttgatgaggtaatggctaagaattttccaggactttttaaaaacattatctgatgaattgaggaagctgtatgagcctga

SEQ ID NO: 22213 - DNA, 366 bp, Homo sapiens
  misc_feature 4, 19, 27, 203, 207: n = A,T,C or G
atancaagaagcacccagnagcttcantttacttctcagagttttctaagaagcgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcncccnggaggcctccttcggccttctttctcttctgctctgagtatcgcccaaaaatcaaaggagaacatcctggcctgtccattggtgatgttgcgaagaaactgggagagatgtggaataacactgctgcagatgacaagcagccttatgaaaagaaggctg

SEQ ID NO: 22214 - DNA, 380 bp, Homo sapiens
  misc_feature 26: n = A,T,C or G
atcccagccctggctgaggtgttagnttgaggaagagggtggtagaggaggcagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaagcacacacatacacacacaaaacaattttttaagaaatcctaataagtaacatacccaaaatgctctgtcttgagtcatgagaaccatcagttcttgatattgtctagacttgcatc

SEQ ID NO: 22215 - DNA, 362 bp, Homo sapiens
  misc_feature 4, 50, 54: n = A,T,C or G
gatngagatttgttcgtatttagaatgggatcacgaggaaaagagaaggnaagngatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaa

SEQ ID NO: 22216 - DNA, 192 bp, Homo sapiens
  misc_feature 85, 158, 170, 171: n = A,T,C or G
gtgccgagagagtgggcgaggtgcctttactacatgtgtgatctgaaaaccctgcttgggtctgagctgcgtctattgaattggnaaagtaataccaatggctttttatcatttccttcttccctttaagtttcacttgaaattttaaaaatcatggntatttttatcgnngggatctttctgtcttctggg

SEQ ID NO: 22217 - DNA, 265 bp, Homo sapiens
  misc_feature 25, 189, 202: n = A,T,C or G
gccccgacaatgctacaatctcctntttactggcatgcagagaaataatggctttatagaaatacaccactgtgacaaagtgggaagacagattaagcagaaaaggcagggcaggctagaggctgaggaacatagggacagaattacaggaaaccaagccacacaacagtagctcttaacaggactgtngaatcttaatgcnttcttcccacccagcacaaatgtggggggctcagattgggatggaggcggtctaaaaatcagc

SEQ ID NO: 22218 - DNA, 186 bp, Homo sapiens
  misc_feature 29, 33, 51, 60, 63, 72, 181: n = A,T,C or G
atacccactatataaagtacaaacaggtntttnacctgtttatagtagtgnactaacaangtntcccttgcngcttcagactgtctatctataggcttatcgttcaaatacagcacttgaatatcccaagtagttcttctacgcatagctcaccttttctaaacccagttaagcatggaanagagg

SEQ ID NO: 22219 - DNA, 370 bp, Homo sapiens
  misc_feature 4, 24, 130: n = A,T,C or G
ggcngaggtttctgggagccaagnagtggtaatggcgtctgtatgatcttcggagcctgctgcatcggacctcggccagtcataaaagatgacaacagcagccaggccaacctttgaacctgccagaggnggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgagaacatacaacctcctcttcagtgtcaaaaaaagccacg

SEQ ID NO: 22220 - DNA, 361 bp, Homo sapiens
  misc_feature 29, 30, 50, 51, 120, 210: n = A,T,C or G
caaccaaaaccttgaaaactattacctgnngggcaatcaacttgagaagnntgacataaagagcttctgcaagatcctggggccattatcctactccaagatcaagcatttgcgtttggntggcaatcgcatctcagaaaccagtcttccaccggatatgtatgaatgtctacgtgttgctaacgaagtcactcttaattaatatctgtntcctggaacaatattttatggggtatgtttttctgtgtgtcagttttcatagtatccatattttattactgggttattacttccatgaattttaaaatctgagggaaatgggtttgtaaacatttattttttttaaagaaaagatgaaagg

SEQ ID NO: 22221 - DNA, 385 bp, Homo sapiens
  misc_feature 4, 122, 160: n = A,T,C or G
agcncagttttgcagagcaaaacatttttagaaactgaatatgtgtgagttctatataaaatgaatgtgttagtaacatccatctgctgatcaaggaggcattggatctggtactagaaggngaaattgattgtagctatcaaagcattttatcaatgtnagtcaagaaaaaagaagaaaactgtgaacctctgatatttttaacataaaaactgttcccaatgagtgttctcttgctgattttgtgttaatgttattgtctatgatttttaagctaatgctaatataaaatctaaaatttcaacatgatgacaacaattcctgtagcctgtttttaccattaggatgtttttgaaaacagatgtcatcttagaaattatatttt

SEQ ID NO: 22222 - DNA, 290 bp, Homo sapiens
  misc_feature 26, 27: n = A,T,C or G
gcccttacctcgttgcactgctgatnncaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaa

SEQ ID NO: 22223 - DNA, 380 bp, Homo sapiens
  misc_feature 106, 109, 360: n = A,T,C or G
ggccccttaaatattaaatgaagagcctttaacattaagactttgaaacttacctatgccagaatataatacaattcttactgtctctattctagatgactgaggnggnatatgcatattgaccctgcagagtacattgttgatctgccttctcagctcttagcagaacagttttcctagctatgcttaggaagcttctcttctaggggtcaagaccaggaccctaaatctacaaggattgtccacagaatgattttgcatttatcagtttttattagtacatataataaaattgacttagtatatttcagttcctcttaatgctgccttttaaagtatctgttttctaattctcaaggnaatttataagatttaaaagt

SEQ ID NO: 22224 - DNA, 386 bp, Homo sapiens
  misc_feature 27, 47, 48, 58, 77, 100, 164, 176, 207: n = A,T,C or G
atccagggcaacttaatgcaagatctntggctctatgttgagagcannctctctctgntatttttattttatttgcnttgcttacctatctcaaagtagncaaactgatatatgagattgagtactcccttttgatattatactgatgaatatttgtaggtgtntcactataaggnacagctaaggaataattttaataaaaggganccagaacaaatcactcatttaaaaagtaattcagaagaacagtgtggcatgatcagacttctaattgaatagcgtaacaacagtgtttgtaattatagatttgcttggacaaaatattccaggaactcatagcgagctcaaagcaattaagggggaacatttttaatttaaaaaaaatt

SEQ ID NO: 22225 - DNA, 379 bp, Homo sapiens
  misc_feature 53, 55, 57: n = A,T,C or G
gacccaaaccttacttgaagcaaacttttatttttgttgaaaatgtatatcancntnagttaaagttgatttttcagacctgctcctcagtaataatactagctagtcagcattcacgcctaccaggacacaaaaatcctcttcaaaactactcagaaaagaaagtcattactcaggaatgatgtccattcaggagaaatcaaaagagaattcctccaaagttactaaaaaagtgacgataagaattcagaaacagaaattcaggattctcaaaagaatctagcaaaaaaatcaggtccaaaggagactataaaatcacaggctaaatcttccagtgaaagtaaaataaatcagccagaattggaaacacgcatgagta

SEQ ID NO: 22226 - DNA, 385 bp, Homo sapiens
  misc_feature 29, 174: n = A,T,C or G
ggacccaggtggtgcttctgtgttgctgnctcttgcacttacaggaagcaagagctataaagggcattggaggccggatgcggtggctcatgcctgtaatcccaccactctgggaggccgaggggggtggatcacctgaggtcaggagtttaagactagtctggccaacatggngaaaccccgtctctactaaaaatacaaaaatttgctgggtgtggtggccgtgtgcctgtaatcccagctactcaggagactgaggcaggagaattgcttgaacctgggaggtggaggttgcagtgagccgaagttgtgccattgcactccaacctggatgacaagagcaaaactttgtctccaaaaaaaaacataaataaaaaaaaaaaaa

SEQ ID NO: 22227 - DNA, 372 bp, Homo sapiens
  misc_feature 22, 143: n = A,T,C or G
catgggaagagaaagcgctagnaagtttatgatttgattagaactatccgggacccagaaaagcccaatactttagaagaactggaagtggtctcggaaagttgtgtggaagttcaggagataaatgaagaagaatatctggntattatcaggttcacgccaacagtacctcattgctctttggcgactcttattgggctgtgcttaagagtaaaacttcagcgatgtttaccatttaaacataagttggaaatctacatttctgaaggaacccactcaacagaagaagacatcaataagcagataaatgacaaagagcgagtggcagctgcaatggaaaaccccaacttacgggaaattgtggaacagtgt

SEQ ID NO: 22228 - DNA, 384 bp, Homo sapiens
  misc_feature 3, 26, 47, 50, 140: n = A,T,C or G
gancccgagtggagagagcgagctgnttggttgtgtggtcgcgtctnggncccgggagcgcttgcagcatggctgaccaactgactgaagagcagattgcagaattcaaagaagctttttcactatttgacaaagatggngatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaac

SEQ ID NO: 22229 - DNA, 207 bp, Homo sapiens
  misc_feature 3, 27, 28, 75: n = A,T,C or G
gancattgatgtgcctagtagaacagnnaggagcaattactactcgttctgggcagaccttatccaaagtctggnacaactgtccttagactgatgagcaaaggaggagtcaactaatgaagaaatgaataataaattttgacactgaaaaacattttattaataaagaatattgacatgagtataccagtttatatataaaaaaaa

SEQ ID NO: 22230 - DNA, 172 bp, Homo sapiens
  misc_feature 80, 122, 165: n = A,T,C or G
ggactgtggggaaattctactttactacttataccaaaataaaattccagtgatcaaagatttaaacatgcgcgcgcgcncacacacacacacacacttacacacacagtaaatatgttctnttttttctttttcgatctttgataggaagtgcctttttaagcnacactca

SEQ ID NO: 22231 - DNA, 259 bp, Homo sapiens
  misc_feature 210, 238: n = A,T,C or G
ataccaaaagggtgagcagtggccagagcctcctctgcacctctcgagtgtctttaccaattgagctttttatcgccatagccccttggagtgccccagctgccctgaggtcaatcaaggaaaatttcttaatgaaataagctccaaagagccaaagtatcaacttacagatcgtttttaaagcttaaatttatgaaccacctttgtggnaaacaatgaattatgaataccgcagggnggccttcttaaataacaaatg

SEQ ID NO: 22232 - DNA, 182 bp, Homo sapiens
  misc_feature 51: n = A,T,C or G
gagaaacatctaggaacagtgtcttctcagaaaaccaccagccttgaaggntacaagtgacgaggaagattctgttttgaatatagccagagaaaaaaaggatggagaaaaatctagaacagtgtcttctgagcaaccaccaggcttgaaggctacaagagatggagaaagattctcttttg

SEQ ID NO: 22233 - DNA, 252 bp, Homo sapiens
  misc_feature 12, 132: n = A,T,C or G
taatttccagtntaccaaaaggttgcttttgttaattttgtccaggcttatacaggttgaatattccttatccaaaagacttgggaccagaaatgtttcagattttggatttttttggactttgaagtattngcattatacttaccgattctatagccctaatcaaaaattcaaaatccaaaatgctccaatgaatatttcctgggaatgtcgtgttgccactcagaatcttttggattttgaagcactttg

SEQ ID NO: 22234 - DNA, 274 bp, Homo sapiens
  misc_feature 3, 12, 68, 73, 120, 196: n = A,T,C or G
tantcggccttnggccgggggtaacggagtggtgcgccaacgtgagaggaaacccgtgcgcggctgcnctttnctgtcccaagccgttctagacgcgggaaaaatgctttctgaaagcanctcctttttgaagggtgtgatgcttggaagcattttctgtgctttgatcactatgctaggacacattaggattggncatggaaatagaatgcaccaccatgagcatcatcacctacaagctcctaacaaagaagatatcttgaaaaatttcaga

SEQ ID NO: 22235 - DNA, 234 bp, Homo sapiens
  misc_feature 19, 207: n = A,T,C or G
ctaaatagctagcttaacntcaagatcaacttaaaaacatcaataacctataatcaacctaaaaccacaaactaaaccattatattatcctagtatgggagacagaaaagataaaatactaagcaatagagaaagtaccgcaagggaacgctgaaagagaaatgaaataacccgtaaaagcaataaaaagcaaagattaaaccttgnaccttttgcatcatgatttagccaaca

SEQ ID NO: 22236 - DNA, 223 bp, Homo sapiens
ggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggggaagatttataggtagga

SEQ ID NO: 22237 - DNA, 374 bp, Homo sapiens
  misc_feature 250: n = A,T,C or G
ggaagctctgtttggtgctttggatccatttccatcggtccttacagccgctcgccagactccagcagccaagatggtgaagcagatcgagagcaagactgcttttcaggaagccttggacgctgcaggtgataaacttgtagtaagttgacttctcagccacgtggtgtgggccttgcaaaatgatcaagcctttctttcattccctctctgaaaagtattccaacgtgatattccttgaagtagatgntggatgactgtcaggatgttgcttcagagtgtgaagtcaaatgcatgccaacattccagttttttaagaagggacaaaaggtggggtgaattttctggagccaataaggaaaagcttgaagcca

SEQ ID NO: 22238 - DNA, 364 bp, Homo sapiens
  misc_feature 14, 20, 49: n = A,T,C or G
atggacaagaaagnacaagnatctatgactgtacacaactgtccacagnaagtttttcttccaaacagagctgcagaatcatacaatgacccaacacagcagttagtgcaagtacagtctctcaaggagaattgattttgtggcacaaaaagggaacatgttttactctttgcacgaaactttcattgttaatgtatattattcagaaacattgtattgtaccataaaacttgtattatcaaactgttggatgttcatgtgtttgaacttttgcgcaccggatagaccccttgtatataaaagtgttgcacatgtattaatgttgtctgatactaaaatggtcttataaagacaagtggacttg

SEQ ID NO: 22239 - DNA, 271 bp, Homo sapiens
  misc_feature 21, 87, 116, 156, 212: n = A,T,C or G
aaaacaatcttctcaaaatcntattggcagtatcaatacttttcagtctccttttgaagttaaatgtaattgaagaccttacttggnttcctagtggcattctttttttttctttngaaacagagtctcactttgtcacccaggctggagtgcagnggtgccatctcggctcagtacaacctctgcctcccaggttcaagcgattctgctgnctcagcctcctgagaagctgggactacagggatgcgccaccacgcccggctactttttg

SEQ ID NO: 22240 - DNA, 388 bp, Homo sapiens
ataactcagcctgacaaaatagtgactgggattagacagcattatttaaccagagactctcatatgcctttgaataatttccaatgtttgcctttttaattcaggtatcatatcaacgtttcttcacgtccatccttttggagccaacatagaatatctttggtcatacatgcagcagctggactccaagatatctgcaaatgaaatagaaatgcttttgatgaggctgccacgcatgttcaaacaggaattcacgggtgtgggagccacgctggaaaaaagatgggaagttgtgtgcctttgaaggaattaaaactacctaactgcgaagagcaaagcatctctggaaatgaaaccatgtgaacctggccagggcggtgcgacgggg

SEQ ID NO: 22241 - DNA, 399 bp, Homo sapiens
  misc_feature 18, 50, 131, 159: n = A,T,C or G
acccagggcaattcggcnttatggaccggggacagtagtcttgctctgtngcccaggctggagtgcagtggagcgatcttggctcactgcaacctccgcctcctgggttcaagcgattctcgtgcctcagnctcctgagtagctgggtttacaggcatncgccaccacgcctgactaatttttaatagggacggggtttcaccatgctggccaggctggattcgaactcctgatctcaggtgatccacccgccttaccctcccaaagtgctggaattataaggtgtgagccaccgcgcctggccaccatttacttttaaatgtttttcaagtgttttcagaagtttcggaaatatacagagttcccttagaagtctaatatatgcctttttagaccttt

SEQ ID NO: 22242 - DNA, 278 bp, Homo sapiens
atagctttttggtagaatccttagaattttccacatttctaatcattttatctgtggataaagagagttctacttccttttcattgtagatgccttttattaatttttcttgccttatcagatttgaaaatcagtcagtgtaatttatgatataatcattctcagtggacgcagagacggcatcagacaaaagctaatttattcctgataagaatttccagtaaaataggaatcgagtaaaatgtccttagcctgataaagagggcatctatttaaaa

SEQ ID NO: 22243 - DNA, 212 bp, Homo sapiens
  misc_feature 69: n = A,T,C or G
gtttgaggatgcttaatgattccagcctctcactgtgccttatgcattaaaatttctttgttacgagcnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggg

SEQ ID NO: 22244 - DNA, 240 bp, Homo sapiens
  misc_feature 25, 29, 37, 45, 46, 51, 71, 89, 112, 132, 214: n = A,T,C or G
ttttttgggtaccccccgggggganaaanttcggggncccttttnntgggnccccgggggggggggggctngggtaaaaggttccttantgggggtatttttgggatttttncccttttttttgggcttggnttttcctatttttttttgggtaaaccattgttttttatggtaaacctttccatttttttttaaaaaaaaaattggcctaccnatttccaaaaatttttcccccccaaa

SEQ ID NO: 22245 - DNA, 313 bp, Homo sapiens
  misc_feature 271: n = A,T,C or G
aatcggtattcatccaagttaaatgtagagtttttaaacatcaatctttaaaccaattgctgctacttatataattgccaaaaagtgaaataatgtgtagttcatgtaaataatacattatatttctattttattatgaagaaggtgaatagccatatttgtaaaatgacaatcatgtgtgttaaccccagtgctttccattcgtgaaaacacatttgctttttgtgatatgcacaatgtagataagtgttctgtctgactttcttttttntattagaagtataaaagaattgggggtttatatattttaaaa

SEQ ID NO: 22246 - DNA, 248 bp, Homo sapiens
aattcggcacttatggcccgggaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaaggtgaccattggcacacgctagaagtttatggcaagagctttacaaataaaaaaaaaactg

SEQ ID NO: 22247 - DNA, 224 bp, Homo sapiens
agggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatg

SEQ ID NO: 22248 - DNA, 190 bp, Homo sapiens
  misc_feature 22, 26, 29: n = A,T,C or G
gggggcagaaaaggctgttcgnaganctncggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattaccaaa

SEQ ID NO: 22249 - DNA, 305 bp, Homo sapiens
  misc_feature 186, 203, 223, 299: n = A,T,C or G
actcttcctgttgatgttccttttctgtttttaccttgtccaatttccacactagtcattttttttattttttagaggatcagattttagcgcaggaaaatgagttcaaaaatttcagtgtaatgtcataaggatgttgggatacagagatttttttttttccttggaaacaaatggactgggaanaaacacagcatggcttngctctgagtttcaatctgangattatgaccatggaagatagtcttatgtaaaggttaaatgggggtttacaagtggatagataaggcggagatggnggagaa

SEQ ID NO: 22250 - DNA, 373 bp, Homo sapiens
aaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaaagattgacccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggggggggtctcaat

SEQ ID NO: 22251 - DNA, 372 bp, Homo sapiens
gtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcgggtggtgctgaccaggaattctttgtggacattggcccagtctgttt

SEQ ID NO: 22252 - DNA, 370 bp, Homo sapiens
  misc_feature 65: n = A,T,C or G
aaagtaaataatgctgtctgtaaaaaaggctattcacataaatttgtataaagatttttattgcntcacaaaagaggaagcaacttaattggttcaccaaaacattaaaccacgagttagtggtttgataaaataaaacacagccattaaaattatggttatgagatgatgtagtaatacaaaaagtgaaaatgatataagctaagcttctaaaagtatgctataaaagtatatgtgctgaatgattaacattacatttaaaatgtttatggaaaaatactagaaaatctgcaaaattcaaactataatgttagcaggatttatattttaaatcatttcatttgccaaaataagaataaataatgtattt

SEQ ID NO: 22253 - DNA, 382 bp, Homo sapiens
atctttcttacttttttcccatttagcccctggaatagctttcatgccaagtttagaattagccaatgaaatgtaaataaactttggacagaaaatagcaatgtatttttttaatataatttcattattcacaaatgaagaatgcaattccatagcttacttctttctcctaaatttaatgtacaaaaatgtacatggatgatattatcacttgttgctgtttttgttgcacaatagcacattaattatattaaatattctctttggtgaagttatgcacagaactgtaacactttcctctgcctttttctcttatatgtgggttcatgggttcagttgcattgttatgttaatggaatttactactttggggtgttctaaa

SEQ ID NO: 22254 - DNA, 176 bp, Homo sapiens
gttattggcaagggcaacaaaccatggatttctcttccccgagaaagggtatccgcctcaccattgctgaagagagagacaaaagactggcggccaaacagagcagtgggtgaaatgggtccctgggtgacatgtcagatctttgtacgtaaaaatattgtggcaggattaataac

SEQ ID NO: 22255 - DNA, 218 bp, Homo sapiens
  misc_feature 25, 177: n = A,T,C or G
aaatgtaatgttgcagatccgcagncagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagnaagaagccccacgggagccaggatgggactggtcgtgtttg

SEQ ID NO: 22256 - DNA, 203 bp, Homo sapiens
gttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcagggatcttctccatactgtcttcaagaatggcaaggtgacaaaaaaaa

SEQ ID NO: 22257 - DNA, 373 bp, Homo sapiens
  misc_feature 36: n = A,T,C or G
ggtaggagcctctctccctactgctgctacacaagnaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaa

SEQ ID NO: 22258 - DNA, 370 bp, Homo sapiens
aaggctggactatggaaccctgagggcaagacctgggtctctcttactcactgctccatgatcagcatttcacacaacaccagtgccctgtcagtatctgtagaattggccaagggtgggtgtggctcacacctgtaatcccagcactttgggaggctgaggcgggcaggtcacttgaggtcaggagttcgagaccagcctggccaacacggtgaaaccccatctctactaaaaatacaaaaattagcccagctactcgggaggctgaggcaggaaaatcacttgaacctaggaggcaagaggttgcagtgagccgagatcacgccattgcactccagcctgggtaacagagggagactccatctcaaaa

SEQ ID NO: 22259 - DNA, 281 bp, Homo sapiens
  misc_feature 112: n = A,T,C or G
gaccccaaacccactccaccttactaccaggacaaccttagccaaaccatttacccaaataaagtataggcgatagaaattgaaacctggcgcaatagatatagtaccgcangggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtggc

SEQ ID NO: 22260 - DNA, 372 bp, Homo sapiens
  misc_feature 20, 210: n = A,T,C or G
gggctgtcttggggctcagnaaggtaaagaactatttgagcagatgtgtgtgggtggcactggattccacccaactgccaagttagtattgttagagatttcattttacaacacaaaaataagcctgtgtcaaagattttaaaatcatggaaagttaaaatctagaaagaccttagagaaccagccaaccaactctctcattttaaaagngaaggattcatagcacagattacttgcctaagatcatccaggaacgaagacaagaatccaaatgtacttggggacaagaattagtccccaaattcagtgttcttcctagtattaaacattgcccctttcgacaaattttggatttcattcttgttatatttt

SEQ ID NO: 22261 - DNA, 255 bp, Homo sapiens
  misc_feature 28, 205, 209, 210: n = A,T,C or G
gggaagtaaaaaatctgggtgccttgtncttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaaacgatgtnccanncccgtctggcccaccagggtccttttttgacactgctcttaacag

SEQ ID NO: 22262 - DNA, 233 bp, Homo sapiens
  misc_feature 178: n = A,T,C or G
taacagaatctgggtcacatgaaaaaaaatcttttatccgtcttttaagtatatgtttaaaataataatttatgtgtctgcatattgcggaacagctctgagagcaacagtttcccattaactctttctgaccaatagtgctggcaccgttgcttcctctttgggaagaggaaagggngtgtgaacatggctaacaatcttcaaatacccaaattgtgatagcataaataaag

SEQ ID NO: 22263 - DNA, 262 bp, Homo sapiens
  misc_feature 145: n = A,T,C or G
aaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcangagcattgtgcaatacagtttcattaactccttcccccgctcccccaaaaatttgaattttttttttcaacactcttacacctgttatggaaaatgtcaacctttgtaagaaaaccg

SEQ ID NO: 22264 - DNA, 167 bp, Homo sapiens
gatttctgcccagtgctctgaatgtcaaagtgaagaaattcaatgaagcgcgggtaaacggcgggagtaactatgactctcttaaggtagccaaatgcctcgtcatctaattagtgacgcgcatgaatggatgaacgagattcccactgtccctacctactatccag

SEQ ID NO: 22265 - DNA, 371 bp, Homo sapiens
  misc_feature 19: n = A,T,C or G
atttgaaattaatcccagnacacccgctgatcagagacatgcttcgacgaattaaggaagatgaagatgataaaacagttttggatcttgctgtggttttgtttgaaacagcaacgcttcggtcagggtatcttttaccagacactaaagcatgtggagatagaatagaaaagaatgcttcgcctcagtttgaacattgaccctgatgcaaaggtgggaagaagagcctgaagaagaacctgaagagacagcagaagacacaacagaagacacagagcaagacgaagatgaagaaatggattgtgggaacagatgaagaaagaagaaacagcaaaggaatctacagctgaaaaagatgaattgtaaaatta

SEQ ID NO: 22266 - DNA, 375 bp, Homo sapiens
  misc_feature 207: n = A,T,C or G
gggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctntgaggaaatctgaaatagagtactatgctatgttggctaaaactggtgtccatcactacagtggcaataatattgaactgggcacagcatgcggaaaatactacagagtgtgcacacctggctatcattgatccaggtgactctgacatcattagaagcatgccagaa

SEQ ID NO: 22267 - DNA, 368 bp, Homo sapiens
aagctgggttagtaataagtgaaaaaagaaaaaccacgcatcttcatattcttcattcaacgtatttactgaataccttgtgtgccaggccagtggagacaaagatgataatggtagttactgggataactcagtttggtgaacacatgatgtggtttggttattagtagagttacagaaaaggtagcatggaaactgagatggcctcgtgggtgttggaaggcttttcagcaaggggaggtgaatgttattaagtccaacctgaaaggtgcatatttcaggcagatagatagggtgttttggcatcttataactgctcactttccttttccttagtaatctgaaagtaattcactgtactgaatagt

SEQ ID NO: 22268 - DNA, 367 bp, Homo sapiens
  misc_feature 332: n = A,T,C or G
ggagatggagtcttgctctgtcacccaagctggagtgcagtggtgtgatttcagctcactgaaacctccacctcctgggttcaagcgattcttttgcctcagcctcccgagtggccaggtctacaggcatgcaccactgcatctggctaatttttgtatttttagtagcggtcaggtttcaccatgttggccaggctggtcttgaactcctgacctcaggtgatctgcccacctcggcttcccaaagtgctgggattacaggcatgagccactgcacccggccgaaggctgtcttaaaggggtgtggcaagctttccatctttgcccttttngaaatgctttcctgagcccaccatacaaagagatt

SEQ ID NO: 22269 - DNA, 348 bp, Homo sapiens
  misc_feature 212, 250, 252, 258, 259: n = A,T,C or G
gcctgcagtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagcccttaaaggccaacccttttgggaggtgctttctcatgcaaaaggaatcgtgctggaaaagnaaggagttgaaagccgaacagccaaattctgccattangnaagtgnngtaagggggcccagctgatcaagaatggcaaggaaaatcacagccctttgtaccccaatggacggttgcttgaactttattgaggaaaa

SEQ ID NO: 22270 - DNA, 297 bp, Homo sapiens
ggaggtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaaggagaaggttcttttctg

SEQ ID NO: 22271 - DNA, 345 bp, Homo sapiens
  misc_feature 151: n = A,T,C or G
gattaacatcaaggctggaacctatttgcctcagtcctatctgattcatgagcacatggttattactgatcgcattgaaaacattgatcaccctgggtttctttatttatcgactgtgtcatgacaaggaaacttacaaactgcaacgcanagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcaggattatttttttaaaggctttctt

SEQ ID NO: 22272 - DNA, 323 bp, Homo sapiens
  misc_feature 298, 311, 313, 323: n = A,T,C or G
atttcaaaagtgaccaagggaatctccgcacaaaagtgcagattgaggaattgtgatgggtcattcccaagtaatcccccaaggggcatcccaaatccctgaggagtaacagctgcaaacctggtcagttctcagtgagagccagctcacttatagctttgctgctagaacctgttgtggctgcatttccttggtggccagtgacaacttgtgtaaccaggaattagctgcatggcgctgacccttttggccggaactttggtctctttggctccctccttggccaccccaccacctntcgcacagccccntntgtttttacn

SEQ ID NO: 22273 - DNA, 186 bp, Homo sapiens
atggcaaaaccccatctctgcttaaaaatacaaaaattagccgggtgtggtggtggatgcctttaatcccagctactcaggaggctgatgcaaggagaattgcttgaacctgggagtcagaggttgcagtgagccgagattgtaccatggcactctagcctgagcaacagagtgagactccatctc

SEQ ID NO: 22274 - DNA, 386 bp, Homo sapiens
  misc_feature 6: n = A,T,C or G
aaattncacataacaatattaactttaaatgtaaatgggctaaatgccccaattaaaaggcacagactggcaaattgggtaaagagtcaagaaacatcagtgtgctgtattcaggagacccacctcatgtgcaaagacacacataggctcagaataatgggatggaggaagatttacaaagcaaatggaaagcaaaaaaagcaggcctagtctctgataaaaacagactttaaaccaacaaagatcaaaaaaggcaaagaaaggcattatctaacggtaaagggatcaatgcaacaagaagagttaactattctaaatgtatgtgcacccaatacaggagcacccagattcataaagcaagttagagacccacaaagagacttaga

SEQ ID NO: 22275 - DNA, 213 bp, Homo sapiens
gaatgggtatcgctaataacactcatggtgaactaaggtagctggtacatctttgatttgcgtgcgcatgtgcattttgcgtattctaacagctcagttcatttgggtacagttgtctgctttcacctaatgtttcccaccaaaaaatagtacataagcaaatgagaaattcttgttttgctaatgttgtgtcagaacaaatgtgtatatatg

SEQ ID NO: 22276 - DNA, 212 bp, Homo sapiens
  misc_feature 95, 117, 157, 159, 191: n = A,T,C or G
attacctggaggtcaatcaacttgagaagtttgacataaagagcttctgcaagatcctggggccattatcctactccaagatcaagcatttgcgnttggatggcaatcgcatctcanaaaccagtcttccaccggatatgtattgaatgtctaccgngntgctaacgaagacactcttaattaatatctgnatcctggaacaatattttatg

SEQ ID NO: 22277 - DNA, 375 bp, Homo sapiens
  misc_feature 12: n = A,T,C or G
gtagattaaaantttgtaatgatatcaaggtaaacaaccaatagagagtatgcattcttctcaagtatgaatgaaacatttataaaatgatcatataataggtcataaagggagtgtcaaacaatctaaaatattcaataaatgaaagatcaaattctgtggtcacattacaagtaaattttacaaatctcaattttacattaaagatctttactctaaatgccatatgcttgtttattttagttgcccactcagcatatccatttgactgattcatagacatctcaaacacagtatagctaaaaagtgaacctctgacttcccgctagcagacttgctctaccttattgtttccctatctttatgggttttagg

SEQ ID NO: 22278 - DNA, 334 bp, Homo sapiens
  misc_feature 317: n = A,T,C or G
ggtaggagcccctctccctactgctgctacacaagaccctgagactgacctgcaggacgaaaccatgaagagcctgatccttcttgccatcctggccgccttagcggtagtaacttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggnttatggatacaatgctg

SEQ ID NO: 22279 - DNA, 372 bp, Homo sapiens
tatctgcaatgaggtacagctttaatgatctgtatctgcaagccaggagcatgaatgtgatcttattgtatcatagtgtagagatgagataggctagcgctacagcacaccagtgcattgtgcctgggtgtcgggaacaatccttccatttccaaagcagcaactctttatttttcatcattgtttctttacctcacttgtatgctccttgtgatacagatctgagtggagttgtgcaagcttcagacttgccagcccccagctcccaggcctagtacagagtaattcataaacttaccatattagactatcagattgaaaccaagggtttctactgtggtggaaattgggaaagcccattgtttttgatta

SEQ ID NO: 22280 - DNA, 318 bp, Homo sapiens
atttatggtttggctatagaaatttacctttaattgctgggcatggtggttcattcctataatcccagcactttgggaggctgaggtgggcagattgcttgagcctaggagtttgagaccagcctgggcaacatggcgaaaccctgtctctactaaaaatacaaatattatccgagtgtggtggcacacacctgtagtcacagctacttgggaggctgaggtgggaggatcacttgagcctgggaggcaggaggttgcagtgagctaagatcacatcactgtactccagcctgggtgacagagtgagacacccccccc

SEQ ID NO: 22281 - DNA, 233 bp, Homo sapiens
  misc_feature 1, 7, 227: n = A,T,C or G
ncacgcncgttctttgtggcacgaaacccattaaaagtcaagatgttcctctgtaatacaaaggtgcccttaaatctttagttttagaaggtgagagattcatacacatgacttcttgaagacaagttcatcatctgtattttctctaaggcctcaaatgccattcatctttaaaaagaacatattatggagtttcaaggaataaaatgaccaaaaaaccatgcagngtgctg

SEQ ID NO: 22282 - DNA, 287 bp, Homo sapiens
gatggtccagtaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcacttttttcagtggcaggtg

SEQ ID NO: 22283 - DNA, 222 bp, Homo sapiens
gcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaaggggacccttcccaagaggaaccaataaaccttctgtgcaaaaaaaa

SEQ ID NO: 22284 - DNA, 373 bp, Homo sapiens
gagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtggagatgatctgttactgcaacttcagcgaaatt

SEQ ID NO: 22285 - DNA, 229 bp, Homo sapiens
  misc_feature 87: n = A,T,C or G
gcctcagcctccttacaggcgtgaggcacagtgcctccatctcaagaaaaaaaaaataactaaaacaaattagccgcgcatgggggngtacacctttggtcccagctactagggtggctgaggtgggagagtcccttgagctcagaagtttgatgctgcagtgagctatgattctccactgcactctggcttggggaacaacagagtaagacctgccatctccaaaaaa

SEQ ID NO: 22286 - DNA, 400 bp, Homo sapiens
  misc_feature 2, 22: n = A,T,C or G
tnttggccggggtctgctttcnaactgcctgactgcttgttcgtctcactggtgtgagctccagcatcccctttgctcgaaatggaccccaactgctcttgcgccactggtggctcctgcacgtgcgccggctcctgcaagtgcaaagagtgcaaatgcacctcctgcaagaagagctgctgttcctgctgccccgtgggctgtgccaagtgtgcccagggctgcgtctgcaaaggggcatcggaaaaagtgcagctgctgtgcctgatgtgggaacagctcttctcccagatgtaaatagaacaacctgcacaaccctggatttttttttaaaaaatacaacactgagccatttgctgcattttcttttttatactaaaatatggggacctgacaaata

SEQ ID NO: 22287 - DNA, 372 bp, Homo sapiens
  misc_feature 11: n = A,T,C or G
ggaaacaaganggcgggttcgtggtgagaagccgtcaaggagtagaaattggtatgcttagaagcagattctaaaagcagtttctcttcagaacatcttttttcataccacttgataagcatcttgaaacaccatggctgtagcttgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatc

SEQ ID NO: 22288 - DNA, 388 bp, Homo sapiens
  misc_feature 354: n = A,T,C or G
ggacaacaacaagcttaccagagtacctggtgggctggcagagcataagtacatccaggttgtctaccttcataacaacaatatctctgtagttggatcaagtgacttctgcccacctggacacaacaccaaaaaggcttcttatttcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgnggggatggttttacccacatgacttattatgcat

SEQ ID NO: 22289 - DNA, 232 bp, Homo sapiens
cagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaact

SEQ ID NO: 22290 - DNA, 266 bp, Homo sapiens
atctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactat

SEQ ID NO: 22291 - DNA, 397 bp, Homo sapiens
  misc_feature 22, 35, 42, 43, 56, 59, 387: n = A,T,C or G
tccccgggacctcggcccctcnggccgggggaccnaggcttnnctaaatggccctntantaaagatggtagagaaatacgatatgggtagaaaaccttggttcctgtgaagtctggttttagctccaacttccttagtggttttctctgtggttctcttccattagcacgatgaactgaagccaaggtaaaaatgccttcgataattgtacaaagaacagactaatggattgtgttatatccaggcgcaaagactatgattgccccagagtcttaatctgaaataaaagcagtagcaatgtttgaaagagtcattttagtatcttcaaatgccagctttagatcccaaacactggaggatgaacaactcagtaagacagtctggggntgtcattcaa

SEQ ID NO: 22292 - DNA, 369 bp, Homo sapiens
  misc_feature 5, 7, 58, 61, 191: n = A,T,C or G
ttacntnctttccaacctgtagtgtacagtatttactagttcttcaactctactagantantattttagtaaaaaaggaacatgacgttgatcatttgggcaaattttacgtaaagagaagagcatttattgtgttttggaacattaattgtgagatgggatttttcaattttattattttatttttgggnttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaa

SEQ ID NO: 22293 - DNA, 391 bp, Homo sapiens
  misc_feature 36, 54: n = A,T,C or G
gaagcagcgtttcccttctcaggctgttcaatgacnttcacaaatttagggacnaaatgctacctgggtttccagggcacacctagacaaacaagggagaagaagtgtcagaatcagaatcatggagaaaatgggcgggggtggtgtgggtgatgggactcattgtagaaaggaagccttgctcattcttgaggagcattaaggtatttcgaaacagccaagggtgctggtgcggatggacactaatgcagccacgattggagaatactttgcttcatagtattggagcacatgttactgcttcattttggagcttgtgggagttgatgacctttctgttttctgtttgtaaattatttgctaagcatattttctctaggcttttttcctt

SEQ ID NO: 22294 - DNA, 360 bp, Homo sapiens
  misc_feature 5: n = A,T,C or G
cagantaaatagataacttcgtaaccaccagggggcagattcaatacatcacagaatggctgaggaagatccttgggttgtgaagagagtagaaaccctagggagcagtgcttttgggtcctagaacctgttgagtttctaatgaatatttgtagaatctcataaaacagtttaaatacaagcttaagtggcttatgaatcctgtgaagctcatttatggactagtgtaaaacaatgtgaagctctactaagttctgtccttaatcataaataatagccccttgaggactagcctgttctctggtcaccttaccagttgggttgacattgtgtgggtcgtccaaataactcaatcttgcg

SEQ ID NO: 22295 - DNA, 373 bp, Homo sapiens
  misc_feature 352, 355: n = A,T,C or G
attttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtaccgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccagcggtattttctaattcagatcatcaaactgatatttnagnaaagaagttggcttttaa

SEQ ID NO: 22296 - DNA, 397 bp, Homo sapiens
  misc_feature 18, 21, 34, 35, 36, 363: n = A,T,C or G
ccccgggacctcggcccntcnggccgggcttctnnntcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtgggatgttttacccacatgacttattatgcataaagccaaatttccagtttaagtaattgcctacaataaaaagaaattttgcctgccattttcagaatcatcttttgaagctttctgntgatgttaactgagctactagagatatttcttta

SEQ ID NO: 22297 - DNA, 141 bp, Homo sapiens
  misc_feature 6, 35, 40, 45, 53, 65, 79, 80, 92, 101, 108, 109: n = A,T,C or G
aggtcnggtatcgtctgcgtgtgtgcggacctgantttgnggcgnctgctagntaagagctgganaatttgccggtcannataaaatattanactctacantaacaanncatttacgcgatgctttttacttcacgaatat

SEQ ID NO: 22298 - DNA, 350 bp, Homo sapiens
  misc_feature 15, 34, 35: n = A,T,C or G
taccagccctacccntggacctgcaaatctaaannctctggagccttctcaagacagtttgtcctggctctgttgattgcaactccttgtatagcttgtattttgatttagtttatattctgcttattatgtatactgtgttcttatatatgagaaagcacaaatgcgaaagaggtcatgtcttctcaaaatctagcaaaggaagtagtctgcattggtgtgcattacagtattttgcttaatgaaagcctcagttctgaatgttgatatgagtagttaaaagggaagtggggccattttatgtgtttatctgtgtcaagtatttctggtaataagaagcacttaattta

SEQ ID NO: 22299 - DNA, 400 bp, Homo sapiens
  misc_feature 42, 45, 47, 66, 76, 88, 89, 96, 110, 115, 142, 175, 202,230, 283, 322, 334: n = A,T,C or G
tccccgggacctcggcccctccggcccgggtggtgctgtgtntcncnccaccgcggtcccctgacncctcccctancctgtccctgannctgaccntgaagaggggaaantttanaagtgtgcgcttgtgctaaagcagacntgtgaagacaacactggtagtttcctgccctcntaaactctaatttgttctgaatgcacntgaaaaatcttttctgtctgttacactnaaacaatattccccaggactgacggagaaagtaaacaatgtcaagtcgaaccnttaggtagggaagggagcaaaatattttaaatttaaccnttttattattgnttagagggaaaatgtggcaccctaaagaaatacgactttccaatatgattttttatttaactcttt

SEQ ID NO: 22300 - DNA, 314 bp, Homo sapiens
  misc_feature 10, 16, 24, 308: n = A,T,C or G
ctgtctctantaaaantacaaaanttagccgcagtggctcacacctgtaatccagcactttgggaggctgaggcgggcggatcacttgaggtcgggagtttgagaccagcctgactaacatggagaaaccccatctctactaaaaatacagaaaattagctggacgtggtggcacatgcctgtaatcccagctactcaggaggctgagtcaggagaattgcttgaacctgggaggcgggaggttgcagtgagccaagattgcaccactgtactccagcctgggcaacaaatgcagaactccgtcccanaaaaaa

SEQ ID NO: 22301 - DNA, 206 bp, Homo sapiens
ggtgtatctaaactaaatgaagctaaagctcttgtggatgaactgaacagaaaagctggagaacaaagtgtgttacttaaaacgaagcaagatgaagcagatgctgcccttcaaatgatcacagtgtcaatgcaggatgctagtgagcaaaaaacagaacttgaaagactgaagcacagaatagcagaagaagttgttaaaattga

SEQ ID NO: 22302 - DNA, 218 bp, Homo sapiens
  misc_feature 2, 9: n = A,T,C or G
cnctttgantaataacttgcttttaatggctttaaaactccaggtctttcctttttaaaatatttctgcattctcttttatgaactagatcaggatgccttgtttttcctgtgctttcacccccaaaaggttttgtgcatgtgtatgaatacacataatattagtgaatgtgaacccatgttctatacgcactaaacacacagttaatataaaaaaaa

SEQ ID NO: 22303 - DNA, 230 bp, Homo sapiens
tacttacatttggtttggtcctaattatgaatacctttaattgctttatcacagtgatgattaactgtgcccaagtcaaacccctttgaaagagaggacaattccttttaaaggctttgcatgaatgcacctaggaggaatattaaacaaaagaatagagattttccagcttccggaagtctggtcagccttctaacatttctagtgaatgtcttccgaaaaaaatccca

SEQ ID NO: 22304 - DNA, 269 bp, Homo sapiens
atgcctttagatgtacaggctgacagagaagattcccgagggtaaatcatctttccaatccagaggaacaagcatgtctctctgccaagatccatctaaactggagtgatgttagcagacccagcttagagtccttctttctttcttaagccctttgctctggaggaagttctccagcttcagctcaactcacagcttctccaagcatcaccctggggagtttcctggagggttttctcataaatgagggctgcacattgcctgttctg

SEQ ID NO: 22305 - DNA, 343 bp, Homo sapiens
  misc_feature 7, 12, 284: n = A,T,C or G
gaagagngaacngtcctggaagagggaaaagacctttcagccctcaagatctacagctcaacaggaacttgatgggaaacctgcttctcctactccggttattgtggcctcccacacagccaacaaagaagaaaagagtttactcgaactagaagtagatttggataatttggaatttagaagatattgacacaacagatatcaatctggatgaagatattttggatgattgactgtaatgctttccatttacctgactaaacagatcattattatatataggnatttgattgctaccctgaccacagtgctttggactatgagaaacttcttagatttttat

SEQ ID NO: 22306 - DNA, 289 bp, Homo sapiens
  misc_feature 20, 21, 30, 242, 267: n = A,T,C or G
cccggcgatgcccacagaanncccgtcccntgcttacagagcaggagttgccgcagccccaggctgagacagggtctggaacagaatctgacagtgatgaatcagtaccagagcttgaagaacaggattccacccaggcaaccacacaacaagcccggctggcggcagcagcttgaaatcgatgaagaaccagtcagtaaagcaaaacagagtcggagtgaaaaagaaggcccggaaggctntgtccaaactgggtcttcggcaggntacagggagttactagagtcac

SEQ ID NO: 22307 - DNA, 107 bp, Homo sapiens
  misc_feature 1, 2, 5, 6, 7, 8, 9, 10, 11, 13, 14, 15, 16, 17, 20, 21,22, 23, 24, 25, 29, 30, 31, 32, 36, 39, 40, 41, 42, 43,44, 45, 46, 47, 49, 50, 51, 52, 53, 54, 55, 57, 58, 59,60, 61, 62, 80, 81, 82, 91, 93, 94, 95: n = A,T,C or G
nnggnnnnnnncnnnnnggnnnnnntttnnnntttnttnnnnnnnnnannnnnnntnnnnnnaaaaaaaaaaaaaaaaannnaaaatcccncnnncccccccccccc

SEQ ID NO: 22308 - DNA, 373 bp, Homo sapiens
  misc_feature 261, 271, 276: n = A,T,C or G
ggaggtagataatggtaaatacttgattttctatctgatatgtaactcaaaatagaagatcatatcggctaaatactacttattgttattatagggtatgtgcatacctctgacctaaatttgttctaatggcaacttcaagttggacattctacaaaagataaaaataaaggttttaatttttgagaataaaatttgttatctattatcaggaaatagaaggaaacaaagaataaaatagttatgctaagactctatggnaatattaggnaaggnatataccagtgtcacttgagaacttactgaaaatcaaatgttttttcagtaatgagtaataggaacccttaaatgtctagaattatgggaaaccttc

SEQ ID NO: 22309 - DNA, 170 bp, Homo sapiens
cagcgtgacagcaaatgggaaacctcagtagtaaaggcatatgtcatcaaatgtttgaggatacttctccttaattctaaaataaaagattatggtgtgatgaaaactgtaatcatgatgtatctatttttcctccaaggtatcacttactttaaaaatagatttcccta

SEQ ID NO: 22310 - DNA, 258 bp, Homo sapiens
attacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctattaagttgtaccaaaacatccactta

SEQ ID NO: 22311 - DNA, 100 bp, Homo sapiens
  misc_feature 5, 15, 27, 32, 40, 42, 53, 59, 63, 65, 68, 89, 90, 98: n = A,T,C or G
tgtangtaatgtcantgtcaacgtcanagtantgtaaagnantgtaatggaanggaaangtancncantattgcattgggaacaagtannaggatcangc

SEQ ID NO: 22312 - DNA, 391 bp, Homo sapiens
  misc_feature 346, 350: n = A,T,C or G
gatcccttctgcggcccctctgatcaaccttcgcaatgcccggaaacactttgagaagctggagagagtggatggccccaagcacagtctccttatgcgttgaatattgccaaatgctctttctgaaaatgctgaattgccttttttgtttgcatcctttatttttaatattcataatgtcgtgtgcttaaaagtgggctttgaagtgtgtgctgcttactcctttcatctttctccccgcttccccagtctttaaacattggacgctatttactcagctacccagtagagcttggagctgacctttcttgagaagttggtatggtgtaacactaaagtaggtggntcgngtgtgttctcattacctggttatgatagatatgcacatcaa

SEQ ID NO: 22313 - DNA, 238 bp, Homo sapiens
  misc_feature 31: n = A,T,C or G
gtgggcattaattttttgactgcagctctgnttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagc

SEQ ID NO: 22314 - DNA, 310 bp, Homo sapiens
aaagggacaatagagacaagaagagaaggagatagaccctataaaagtgaggcaaagtcatagaatcaagaaatcttagaaaacaaaccacaaagcaaaccactgtattttttaacactacccagaaacagctttgtgaacttatattccctgaacctctactcattctaaaagttcaagaaaattaaattcacataaaaatgagctacagaaaggtattgagatcaaattacatacaaagttattatacgaggaaaaagggacagagtatctctccagacataaaaacttgcaatgaaaaaatgcacac

SEQ ID NO: 22315 - DNA, 383 bp, Homo sapiens
  misc_feature 12, 13, 15, 16, 21, 35, 36, 53, 56, 60, 71, 88, 89, 96, 107,113, 121, 123, 125, 138, 139, 155, 165, 166, 167, 172, 191,196, 197, 199, 202, 210, 211, 215, 218, 228, 229, 237, 239,244, 255, 257, 283, 291, 293, 294, 295, 296, 308: n = A,T,C or G
  misc_feature 309, 312, 316, 320, 324, 329, 338, 341, 347, 352, 353, 354,357, 371, 376: n = A,T,C or G
agtgtcccgcgnnanncgacncgttatctttggcnnaattagagtgatcatangtnatgncccgagcccantggataccgatgttagnnataatgngataggaccgnaggttnaatgtttnangnttgtcggaactgnngccatgattaacaggnacggccgggnnnattcngattgcgccgtatgagganaaatnntnggnccggcgcnngatntancagaacgaanncattagcngnaatgntttaatttgcngngatattttgtgttatataacacaaanatatttgngnnnnccttggcccaannaantttnaaanttanccttntttttcccnggnccccanttttnnntcntcttggcaattttnccccnggggggg

SEQ ID NO: 22316 - DNA, 369 bp, Homo sapiens
  misc_feature 11, 286: n = A,T,C or G
aaggaaaaagnacaggatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggcttggcgcttgtgacaactgccgcagacctgggggngaacccagtcccgaaggcactacttggccagtcctacaaccagtattctcagagataccatcagagaacaaacacttaatgtt

SEQ ID NO: 22317 - DNA, 329 bp, Homo sapiens
  misc_feature 54, 76: n = A,T,C or G
tcgtcccccggggaatttcggcccttatggcccgggatcagagtaaattcaagnagcaaataggtatcacaccagnagtaagttaacagaagatgaattgctggagatgagtgcttcaaaattagtgccagatgatgaggaaaaagacgtggaagaagcagttctagaaaacacattgacatgagataatctggcagaatggttcccatgattccagactgtttttgacttcttttatggatgttgacccttctatcatatgggcactgaaactaaagcaaacagtggaagaaggattggtactgtattagaagaaacatttttggaga

SEQ ID NO: 22318 - DNA, 365 bp, Homo sapiens
  misc_feature 13, 82: n = A,T,C or G
gaacagctaaagnaccacccgtctatgtagcaaaatagtgggaagatttataggtagaggcgacaaacctaccgagcctggngatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctattagaag

SEQ ID NO: 22319 - DNA, 400 bp, Homo sapiens
  misc_feature 2, 34, 36, 88, 122, 157: n = A,T,C or G
tngtccccggggaattcggccttatggcgggggnancaaaagccagtgattgcatccaagggaagataatgagaaacacacaggccgngaaaatcaggaaagcaccactaatcctttttgtngcaaaactttacttttcaaagtcctggggaagggngcaggaagccctcagcacgtggacttgagccctgtactcggaaatgcaaaatggaaaccccctaatagatcacagaactgaaaatatccaagagtctgagaggctgggggaggacaggagtgagaaaaggaagggggctggagtactgatcagaagataggagaaagcaacagtgcaaaatgcgggggaagggctgagtagacattcaatttaatctggctttttattttgctacaaactaat

SEQ ID NO: 22320 - DNA, 103 bp, Homo sapiens
  misc_feature 40, 67, 68, 96, 98: n = A,T,C or G
tttatggcccggggaggcattgaggcagccagcgcagggncttctgcttgagggggcaggccggagnntgaggaaaccgcggaataagtttttttntntttga

SEQ ID NO: 22321 - DNA, 358 bp, Homo sapiens
  misc_feature 1: n = A,T,C or G
naatccccttgtggagagacgctgccaatggtattgtcaattttatagcaagactttaatttttgtttttcaaacctctaagattaaacattaaatcacttgccaagccaagaaaaataatgaggaaaaaatacttcgatttaaaaacttgattcttcatatctcaaaataataagagctatttatgacaaacccacagccaatatcatactgaatgggcaaaaactggaagcattccctttgaaaacgggcataagacagggatgccctctcccaccactcccattcaacatagtgttgggaagttctgcccagggcaatcaggcaaaagaaagaaataaaaggtattcaattaggg

SEQ ID NO: 22322 - DNA, 105 bp, Homo sapiens
  misc_feature 45: n = A,T,C or G
ctttttcccgcccccagtattgataagtaatgaaagtgcacctgnaggtgagggtcaaaggagagtcaacatatgtgattgttccataataaacttctggtgtga

SEQ ID NO: 22323 - DNA, 366 bp, Homo sapiens
  misc_feature 1: n = A,T,C or G
naacaccaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgtttgatgttaactgagctac

SEQ ID NO: 22324 - DNA, 296 bp, Homo sapiens
  misc_feature 20, 22, 260: n = A,T,C or G
aagaataaatttaaccaagngnagcaagacttatacagtacactgaaaactacttaacactcatgaaggaaattaaagaagacctaaataaatggaaagacattacatattcatgttgggacacttaatgatgtaaagatggcaggactccccagagtgatctccagattcaatgcaataccaatcaaaatcccaacagactttttttaccggaaatgggaaaagccagtcctaaaacccctattgaattacaggggaanccttagtagcccaaccaatcttgaaaaagaacaaaa

SEQ ID NO: 22325 - DNA, 109 bp, Homo sapiens
aagggagaaggatgtttgtaccatgatcctccccgcataatctatggaattaggagtcctgtgtggagtcttatcaataaatatgcacattcatcaaatgtctacttaa

SEQ ID NO: 22326 - DNA, 239 bp, Homo sapiens
  misc_feature 11, 70: n = A,T,C or G
atggcgcgggnaaataaacaactgggactcttcctggcaaggggaactgattaataaaatgggtgcaaanattaattgatggtgtaaattaagaatcaaatccctgttttaaacatgttatacacacagtgcaatcaagaaaagcatttaaccaaatttgttcatgaattccattgtgtgctgttgaatagctaatttataattgcatttgtctgtaaaataatctattaataaaattg

SEQ ID NO: 22327 - DNA, 183 bp, Homo sapiens
  misc_feature 26, 93, 127, 131, 182: n = A,T,C or G
aatcggccattatggcccggggaganttggtctgttactcggtggtggcggagtcttacggaaagccgttttcgcttcacttttcctggctgnagagcgctttccccctggcgggtgagagtgcagnaganggaggtgcgagatgagcactatgttcgcgggacactctcctcatcgttttna

SEQ ID NO: 22328 - DNA, 360 bp, Homo sapiens
  misc_feature 5, 6: n = A,T,C or G
taagnngagcaacatccctgatgagtatttcaagcgttttaatgcattgcagtatctgcgtttatctcacaacgaactggctgatagtggaatacctggaaattctttcaatgtgtcatccctggttgagctggatctgtcttataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtattgaatgtctacgtgttgctaacgaag

SEQ ID NO: 22329 - DNA, 369 bp, Homo sapiens
  misc_feature 15: n = A,T,C or G
cgcaagggaaaagangaaaaattataaccaagctaatatagcaaggactaacccctataccttctgcgtaatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggtgatagcttggttgtccaagatagaatcttagttcaactttaaatttgcccacagaaccctctaaatccccttgtaaatttaactgttagtccaaagaggaacagctctttggacactaggaaaaaaccttgtagagagagtaa

SEQ ID NO: 22330 - DNA, 136 bp, Homo sapiens
  misc_feature 3, 5, 20, 33, 38, 43, 58, 59, 64, 66, 92, 104: n = A,T,C or G
ggncncagtaatgaaaggcngcagtagcaaatnagggncatgncaccgaaagcgggannggggngngaaacgaccaaagcgaaagaggctcnactgggatacanggccagccgagaaactccatgagcggtgagac

SEQ ID NO: 22331 - DNA, 360 bp, Homo sapiens
  misc_feature 10: n = A,T,C or G
aacaaatagnaaaggaatagtatcaacaccaacaaaaaggacgtccactcagagaccccatccgaaggtcactgacttcaaagaccaaaggtagataaatccacgcagatggggagaaatcagcccaaaaaggctgaaaattccaaaaaccagaatgcctcttctccaaaggatcacagctcctcaccagcaagggaacaaaactggatggagaatgaatgtgacgaactgacagaagcaggtttcagaaggtgggtaataacaaactcctccaagctaaaggagcatgttctaacccaatgcaaggaagctaagaaccttgaaaaagacgaattgctaactagaataaccagtttagga

SEQ ID NO: 22332 - DNA, 366 bp, Homo sapiens
  misc_feature 134, 135: n = A,T,C or G
agtgaaagccaggaacagaacattacacaataacttactgttgtttctacagagaagaaagctactgaggtctaaaaatacagctttataaaatgatagaattttgagtatgtactaatgggcattaatacttnntcctgtggtatttgaagaccgttttcacacaagcatcttcaaatatcagtgttatttagtctttgacaggtgttggatagcagttaaagattgaagtatgagggggcaatcctagatttatccattcagcagatacttattgcatgccttgtacatatcaggcactgggaataaaagttgtgaaagggaagtggatcaaattgctgcccttatggaaatcagtttatggga

SEQ ID NO: 22333 - DNA, 337 bp, Homo sapiens
  misc_feature 2, 14, 45, 61, 68, 100, 127, 132, 185, 234: n = A,T,C or G
gntcaaattttggnaatgtgcccaaagaaccctggccatggcctnatgactgagacatgcntataagngggggttcttggccttagggggctaaggaatngatattattgggtcaaaataaaatganggggngagacctgtaaatgcctcctagaccatattctgggtcttttttatggagttgnagatagagcagattttgagataagtattcatttagttaaagggggtggncatgaaattccttctcaaggagttggacttgagctaacttgcatgttaacaaataccactgttctggctttccaccatcctgtatgaatttgggaggttacat

SEQ ID NO: 22334 - DNA, 373 bp, Homo sapiens
  misc_feature 54, 177, 352, 355, 363: n = A,T,C or G
aaacccgaatgatactctcagcacagaagaataaagggagcgagtcattaacgntttctttttaaacctttatgatgacttccttatgaattactgaacgaacactggaatgggactcaggtatcctgaggacatctctcaactctggccttagttccccctctgtaaaattagggngccaacctaaatgatctacaaggtcccttccagcgccgccattctgtaattacatcatgtgtaacctgtattaaacatacacaagtgactgccaggcatgggaatgtaacttccgagtaaatgctttgggttgggtcagaatacactatgaacttctttccaaagacggggttgnggnaaaatagnggggtaattt

SEQ ID NO: 22335 - DNA, 368 bp, Homo sapiens
  misc_feature 290, 318: n = A,T,C or G
gacccaccaatggaaagcagctggcttcactgctcaggtgattatcctgaaccatccaggccaaataagcgccggctatccccctgtattggattgccacacggttcacattgcatgcaagtttgctgagctgaaggaaaagattgatcgccgttctggtaaaaagctggaagatggccctaaattcttgaagtctggtgatgctgccatttgttgatatggttcctggcaagcccatgtgtgttgagagcttctcagactatccaccttttggtcgctttgctgttcgngatatgagacagacagttgcgggggggngtcatcaaaagcagtggacaagaaggctgctggagcttggcaaaggtcac

SEQ ID NO: 22336 - DNA, 169 bp, Homo sapiens
  misc_feature 92, 116, 119, 142, 159: n = A,T,C or G
aatgcatttggaaattgaatcagcgatatctccggaagaaaattgattttgtaaatgttagctcacagcttttggaagaatctgttccaagnggagaaaatcagagtgtgacaggnggngatgaagaagtagtagatgaatnccaagagttaaatgcgnaaaaaaaaaa

SEQ ID NO: 22337 - DNA, 371 bp, Homo sapiens
  misc_feature 27, 29: n = A,T,C or G
gggaggatacacatggtttctcacagnanagagtcaaattcactagaacagtattaagaattttgctttcatgagagagtagtaaaagattctactccagagatgtagacacatgtggccactagaaaagctaaattaatattagcttctggtggaactggcatgcttttgggcacctcaactgatagttcaacattagcattatgaaagtcacatatacagttatttagaatctctgtggtgtatggtaatttaatgaaggctttacccaagtgtatgtgtgtgtgtgtgtgtgtctgtgtgtctgtgtgtagcttattagattcaatataaaaccctggcatgcttcctccttttcctgataagaggtg

SEQ ID NO: 22338 - DNA, 334 bp, Homo sapiens
  misc_feature 208, 209: n = A,T,C or G
tagcaagtatagcatgaggaaggaaaagtataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagnngggggtgattaaaataatttgaaggcgatcttttaaaaagagattaaaccgaaggtgattaaaagaccttgaaatccatgacgcagggagaattgcgtcatttaaagcctagtttaaccgccatt

SEQ ID NO: 22339 - DNA, 371 bp, Homo sapiens
atgattcacgtgcataaaaagtgacagttaatgttaaatggatgttccttttatttagattgcgtgattatggtattgtgctaatacttttgaatactggtagggtggggcaggttctggaggagcatatcctgagtcccttgatcttacagctgaatcagcccctgaaaacttaagtgacttgctcaaaatggcaaaactggcactgaaactaactggccttttaattgctacaatcagtactctttcttcagctccactttacttagatgaattatttaaccctcaaagccaagattgcttggaatgttaaaagatgataagaatgataaatcgggattggtttttccctcttaaactttttgagacag

SEQ ID NO: 22340 - DNA, 365 bp, Homo sapiens
  misc_feature 90, 295, 329, 356, 357, 361: n = A,T,C or G
ggaggaattgaaaatggggctttccagggaatgaagaagctctcctacatccgcattgttgataccaatatcaccagcattcctcaaggncttcctccttcccttacggaattacatcttgatggcaacaaaatcagcagagttgatgcagctagcctgaaaggactgaataatttgggctaagttgggattgagtttcaacagcgtctctgctgttgacaatggctctctggccaacacgcctcatctgagggagcttcacttggacaacaacaagcttaccagagtacctggngggcttggcagagcataagtacatcccaggttgnctaccttcataacaacaatatctctgnnaggnggga

SEQ ID NO: 22341 - DNA, 134 bp, Homo sapiens
  misc_feature 90: n = A,T,C or G
gctaaaaggaaaaccgaatgaattccacctcctttaaatacttactagtttaaaagaaaatctgttaattttttcctttttcatctgtgngttgtttgacctattacagcaaacatacatagcttttacaaaaa

SEQ ID NO: 22342 - DNA, 372 bp, Homo sapiens
  misc_feature 41, 354: n = A,T,C or G
ataagggatatgttgatgatcctcgaaacactgataatgcntggatggagacagaagctgtgaactaccatgacgaaacaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactattaaaaagggcagggnaaggccacttggcctatt

SEQ ID NO: 22343 - DNA, 372 bp, Homo sapiens
  misc_feature 358: n = A,T,C or G
aattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggnccagatagactctt

SEQ ID NO: 22344 - DNA, 288 bp, Homo sapiens
  misc_feature 281: n = A,T,C or G
aactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgataacctggttgtccaagatagaatcttagttcaactttaaaattgcccacagaaccctctaaatccccttgtaaatttaactgttagtccaaagaggaacagctctttggacactaggaaaaaaccttgtngaaaaaa

SEQ ID NO: 22345 - DNA, 307 bp, Homo sapiens
gtgtccaagtgatctcattgttcagttcccacctgtgagtgagaacatgcggtgtttggttttctgtctttgtgatagtttgctgagaatgatggtttccagcttcatccatgtccctgcaaaggatgtgaactcatccttttttatggctgcatagtattccatggtgtataaatgtttatttttaaaaacaactagtgtaatacactgttagctttgtttgtaggtgttgttattccataggcttttgttctttgggttagttttgaatttttccccatacgtgatgtatgtactttaatattta

SEQ ID NO: 22346 - DNA, 343 bp, Homo sapiens
  misc_feature 92: n = A,T,C or G
gttcaagtaaaataatgaaaataaagcaatttagttttcaattattagtattttttctctgtagatagtcttcatctaattttaaaattgcnatgataatataatagtttgagtatttgtatacactgatgaatttgagtatatatgatgaatattcatgtactttttatagaatctatttattagagatcccagtaaggcctatatattatagattaaccattagtgatttatgtataatgagtagaaaaagacagcaggaattaatattttttggtgttaaagattatttttaaatagtagtaatgaagtaattttaaatcaaataaactttgaaatattg

SEQ ID NO: 22347 - DNA, 238 bp, Homo sapiens
  misc_feature 59: n = A,T,C or G
gtgggaggattcttacatgttttctttgctttaagtgtaactggcagttttccattggnttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttg

SEQ ID NO: 22348 - DNA, 315 bp, Homo sapiens
  misc_feature 124: n = A,T,C or G
atttgatagtatattgttctcacagtaacatcattgtgggtttgaagatctgtgctaagttatgaaacaatggaatttatacactttatttgaagataaattgggtttatagggaattcttggnataaatattaacgtgtagattagtataacatactgtttattataattagaaaaagctgtgggcacttgaatcccagctacttgggagactgaggcaggagaatcacttgaacccgggaggcagagattgcagtgagcggagattgcacctttgcactccagcctgggcaacaagagtgaaactccatctca

SEQ ID NO: 22349 - DNA, 177 bp, Homo sapiens
  misc_feature 152: n = A,T,C or G
atttagggcaggatttcaagtaacagcctggacaaaacagcaagaccatatctctgcaaaaatttttatacaatttagccagttgtggtggtgcgtgccttgttcttagctacttaagaggctgaggagggagaatcagcctggggtgacangagcaagactccatctctaaaaaaa

SEQ ID NO: 22350 - DNA, 111 bp, Homo sapiens
  misc_feature 61: n = A,T,C or G
agggcgaacccagaaggaaactctggtggaggtccgtagcggtcctgacgtgcaaatcggncgtccgacctgggtataggggcgaaagactaatcgaacaaaaaaaaaaaa

SEQ ID NO: 22351 - DNA, 366 bp, Homo sapiens
  misc_feature 3, 22, 221, 223, 303: n = A,T,C or G
ganacgcacgccgggcgtgccngtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggngngggccttgcaaaatgatcaagcctttctttcattccctctctgaaaagtattccaacgtgatattccttgaagtagatgngggatgactgtcaggatgttgcttcagagtgtgaagtcaaatgcatgccaacattccagtttt

SEQ ID NO: 22352 - DNA, 335 bp, Homo sapiens
  misc_feature 88: n = A,T,C or G
gaaaagaatggcttctttccactagtcaattaaaacgtccagtatctccccaaataaagccttaggtttcttttaacctcttaatggntaattgaaaagagtacagaaactatcaaaatacttatccaatcaatggggggaaaagctatgtcttcagggacagtagagtgatgagaattttttagaaaacactattatccatcaaacttaaaagcatttggacctgatatttaaagataatggaagttttccacatattgaagtatttcaagacatcttccatccacaaaaatttatctttaagttttgtaaatatcaaagtaagtataagatga

SEQ ID NO: 22353 - DNA, 335 bp, Homo sapiens
gcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgttttgaagacaataagtggggggggtatctttgtttctaataaga

SEQ ID NO: 22354 - DNA, 176 bp, Homo sapiens
gtaagttattcatgaacagatttttaaaagaatggaatttttttcagcatgtgactggataagatagggaatagatttgcggtaacaagttcaacaaaagctgagtttggtgaaagagaattctttattgagttgttttcatcaaagagatggtaattctgtcatagggtagcagc

SEQ ID NO: 22355 - DNA, 364 bp, Homo sapiens
  misc_feature 208, 286: n = A,T,C or G
gaaaatatttgtaaagttaccttcagtaaaaagactatatccattaacttaagaatggcatgatactttaaatttttaaaatgaatttgataagggaattattttagaaaaataaagactttaagtttgatgtttggtttatttttcaataagatgacaaacgaagggtaaagtacatggaagactagatgagagggctatcacaggnagcacccatagactttagatacatatgcaaagggatttaataatctattcaccaatttggtgggggagggattcttgntttaggattatggggatagactaatacacaatattcacactagattgtacagatgaaattgatagcagattatcacat

SEQ ID NO: 22356 - DNA, 383 bp, Homo sapiens
  misc_feature 6, 147, 334: n = A,T,C or G
aatcangttcttgaatttgattctaagttgcatattataacagtctcgaaaattattttacttgcccaacaaatattacttttttcctttcaagataattttataaatcatttgacctacctaattgctaaatgaataacatatggnggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagngttaaattaattgataccagatttcactggaacagtttcaactgataat

SEQ ID NO: 22357 - DNA, 100 bp, Homo sapiens
  misc_feature 4, 18, 55, 76, 78, 91, 95, 97, 99: n = A,T,C or G
acanaataaaaaaaaaangaaaaaaaaaaaaaaaaaaaaaaaaaaaaaaaaaaanaaaaaaaaaaaaaaaaaaaananaaaaaaaggaaanaaananana

SEQ ID NO: 22358 - DNA, 282 bp, Homo sapiens
  misc_feature 2: n = A,T,C or G
angaataaaacatataaaaatagaattaacctgaattctgtttctttctagcaataagtaatatttatttttgggtatatggcctaatgagggagggggcaggaaggtcctgtccattttttttatgacatgcatttccaataaaagctttttatattttataggccaggcacagtggctcatgcctgtgatcccagcactttgggaggctgagatgggccaatcacctaaggtcaggagttaaagaccagcctggacaacatggcaaaactccatctctac

SEQ ID NO: 22359 - DNA, 231 bp, Homo sapiens
  misc_feature 60, 73, 97, 102, 169, 173, 211, 228, 230: n = A,T,C or G
attcagcattatgataaacccttgacatgacataccttatcttgaagaaatgaatgaccngacttgtccgagnagactaagaaggtactttccaagnagggnaagtcatagaatttaaagctgggaaggccctaagaatcacctaggccagacatttttagttcagggntggngccctttgaagttcatggatggatttcaaggaacttgngaatcacttgacattgngng

SEQ ID NO: 22360 - DNA, 100 bp, Homo sapiens
  misc_feature 81: n = A,T,C or G
attttcttctatcttaatgtgaatttcataattaatgtctatttattcagctattcattaaaatacaggattctttggcgnaaaaaaaaaaaaaaaaaaa

SEQ ID NO: 22361 - DNA, 333 bp, Homo sapiens
  misc_feature 120: n = A,T,C or G
ggacgtgatgattctgagactctatccagtctaacaagtgttgtgatgagttaaaggcagccaccttggccataggaatgaagagttgcaacatgtgttttgtgtatttgctttcttggngttatgtactcagctttgggccaccttcctcttatcttgaatagctgacttgtcctggtacctcccactttaatcttttgtttgtttgtttgtttgtttttgcctagcaccagtaagacaagaagagaatgctctagtatttagaataaagggagctcagattttgaaatgacaactacagaaagccttactctaacttactggagaaattta

SEQ ID NO: 22362 - DNA, 371 bp, Homo sapiens
gtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcaagcctctggttcagactgcagtaaccactattcctgcaccaactgacctgaagttcactcaggtcacacccacaagcctgagcgcccagtggacaccacccaatgttcagctcactggatatcgagtgcggggtgacccccaaggagaaagac

SEQ ID NO: 22363 - DNA, 372 bp, Homo sapiens
gacacatctggagactacaggaaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatgggagattttaaagtagaaataaatatgtattccatgtttttaaaagattactttctacctttggggtttcacagacattgaatatattaaat

SEQ ID NO: 22364 - DNA, 371 bp, Homo sapiens
  misc_feature 110, 173, 336, 363: n = A,T,C or G
gatgcacttctctacaaagggaagaaagagacagggagactaatcttgttggggacacagtctgagcatttgttagactaactagaaggttttacatagataaataatgngaaaactgagacacaaacacggttagcatggttctgattaaatatctagaaaatgacacagtnagcgttcaaacttaggcagtgtgtttgtgggtccttgcgtaacatagctgttatgttatactgtccaccaagctaatcccatattgccctgaccttctaaatctttttcctctacaaatatatacatgtaggtacgtgcaaatacacaatgaggtaatgctgnatgcatcctattttataaattggctgncttttatc

SEQ ID NO: 22365 - DNA, 346 bp, Homo sapiens
  misc_feature 28, 32, 53, 150, 155, 156, 185, 322: n = A,T,C or G
ggtccccgggaattcggccattatggcngggnacgaaaacaaaaagaaacagntgaagtttccaacactaaatcatcttcccaaatacctgcccgaccatcagtagcaaaagttccctatgggaaaggaccttcatttaatcaggaacgnggaanntcttcacatctgccaccacctccaaagtngcttgacagaagcatccacctccagatcgacaggcagtaccctggaagaccaggcccctttccctccaagcagcaagtagctgatgaagatgaaatattggaagcaaagacgaagacaacaatcagaaatttctgcngcagtagaacgtgctcgatgggga

SEQ ID NO: 22366 - DNA, 226 bp, Homo sapiens
  misc_feature 211: n = A,T,C or G
aacgaaggcaaacacctttacacgctagatggtggggacatcatcaacgccctgtgcttcagccctaaccgctactggctgtgtgctgccacaggccccagcatcaagatctgggatttagagggaaagatcattgtagctgaactgaagcaagaagttatcagtaccagcagcaaggcagaaccaccccagtgcacctccctggcctggnctgctgatggccaga

SEQ ID NO: 22367 - DNA, 349 bp, Homo sapiens
  misc_feature 1, 215, 242, 270: n = A,T,C or G
ngcagaaactttacaggccaggagagaatgggatgatatattcaacatgctgaaagaaaaaaactgtcagccgaggatactgtaactggcaatgctattctttagaaataaaggagacatagtctttccagacaagtgaaaatgagggaattcatcatcactagactggccctaagagaaatgattaattacttctgcatctgcgggaaaaaagngatatctaagcattatgaaaacatgcngataaaacatactaatagaacagatatntaggatgaaaaagagaagggactcaaacgttaacactacagaaaagtcaccaaattgcgtagataaacaataaggacag

SEQ ID NO: 22368 - DNA, 183 bp, Homo sapiens
  misc_feature 53, 140, 168: n = A,T,C or G
gaggcattgaggcagccagcgcaggggccttctgctgagggggcaggcggagnttgaggaaaccgcagataagtttttttctctttgaaagatagagattaatacaactacttaaaaaatatagtcaataggttactaanatattgcttagcgttaagtttttaacgnaattttaatagctta

SEQ ID NO: 22369 - DNA, 369 bp, Homo sapiens
ggcagttcagagttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacag

SEQ ID NO: 22370 - DNA, 268 bp, Homo sapiens
ctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattg

SEQ ID NO: 22371 - DNA, 355 bp, Homo sapiens
  misc_feature 113: n = A,T,C or G
gatcccgtaggagcctctctccctactgctgctacacaagaccctgagactgacctgcaggacgaaaccatgaagagcctgatccttcttgccatcctggccgccttagcggnagtaaccttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctact

SEQ ID NO: 22372 - DNA, 280 bp, Homo sapiens
  misc_feature 73, 112, 262: n = A,T,C or G
gggggaaacaaaccctttagttacaatatcttagggaaatgaatctacaataagacaaatttcaaatcaagtngctccactatactgcataagcggtttagaatcttaagcngatgcaaaaagaataaagcaaatgggaggaaaaaaaaggccgataaagtttctggctacaatacaagagacatatcattaccatatgatctaatggggggtgtcaagcccggattgtgttcattgagggaaaccttatttttttaactgngctatggagtagaagcag

SEQ ID NO: 22373 - DNA, 100 bp, Homo sapiens
  misc_feature 10, 18, 27, 29, 31, 32, 33, 35, 38, 43, 44, 46, 49, 50, 65,68, 80, 81, 82, 84, 86: n = A,T,C or G
cttgtgtganattcaaantaaaactangnannntnganaaaannanaannaaagaacaaaaaaanaanaaaaaaaaatannnananataaaaaaaaaaaa

SEQ ID NO: 22374 - DNA, 400 bp, Homo sapiens
  misc_feature 6, 22, 49, 60, 91, 96: n = A,T,C or G
tccccngggaatttcggccctntttggccggggacctcggtggtggccncttgcgcaganccagacttcgctcgtacctcgtgcgcctcgnttcgnttttcctccgcaaccctgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaacttttgtaagatgcaaagaggttggatcaagtttaaatgactgtgctgcccctttcacatcaaagaactactgacaac

SEQ ID NO: 22375 - DNA, 392 bp, Homo sapiens
  misc_feature 2: n = A,T,C or G
tnttggccggggcttctttccggtctttctggtctcggccgcagaagcgagatgacgaaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataacttggagtgccaaggctaaaagacgaaataccaccggaactggtcgaatgaggcacctaaaaattgtataccgcagattcaggcatggattccgtgaaggaacaacacctaaacccaagagggcagcttgttgcagcattccagttcatcttaagaatgtcaacgattagtcatgcaataaatgttctgggttttaa

SEQ ID NO: 22376 - DNA, 244 bp, Homo sapiens
  misc_feature 11, 22: n = A,T,C or G
gagttaagagnttttgtaatantaggtaaataaattgaatcccaggtccaaaagttctaaaagttggggaggttataaaaagtaatcttggaagggtggaaggctggtaatggaaaatgcagactctgcaagttacttgacttctctttgttttcacttccttgtctatagagtttaataaaacatgcttgaaatggacagtaatactcagtaaatgttagctatttagttttcactattatca

SEQ ID NO: 22377 - DNA, 283 bp, Homo sapiens
  misc_feature 11, 78, 156: n = A,T,C or G
atgagaccagnatgtaagctctcctccatccagctcctcaacagcaacaacaggaccacctcccaaactctgcctggngtgctctgatgaagcttcaggatgtcattatggagtcttaacttgtggaagctgtaaagttttcttcaaaagagcagnggaaggacagcacaattacctatgtgctggaaggaatgattgcatcattcgataaaattcgaagaaaaaactgcccagcatgccgctatcgaaaatgtcttcaggctggaatgaacctggaagccca

SEQ ID NO: 22378 - DNA, 100 bp, Homo sapiens
cggccctctatggcccggggtggcattgaggcagccagcgcaggggcttctgctgagggggcaggcggagcttgaggaaaccgcagaataagtttttttc

SEQ ID NO: 22379 - DNA, 100 bp, Homo sapiens
  misc_feature 17: n = A,T,C or G
tttatggcccggggaancaattcggagaagatagaaagtttgaagtggaaaactggaagaacagaagtacgggaaggcgaagaaaagaatagaaaaaaaa

SEQ ID NO: 22380 - DNA, 392 bp, Homo sapiens
  misc_feature 13, 350, 389: n = A,T,C or G
ggttggccagaangatctcgatctcttgaccttgtgatccgcccattctcggcctcccaagtgctgggattataggcgtgagccactgagcctggccttaaattttcttaatagcaagagtacaattatttctctttctttaacatgttttccccagtatttctcacctaaattcttttttgtgtaagcaaatctaataagaaaattggttttgcaagttagactagtcaacgtttattaggtgcatattcttttttattcaaggaataataataaacattataatagcaaactgacataacttgataaagaacttgatggaaccatgtctcatctcagccaggtgtggnggggtatgccttagtccgcactgcttgggaggccaaggnggg

SEQ ID NO: 22381 - DNA, 376 bp, Homo sapiens
ggaggcattgaggcagccagcgcaggggcttctgctgagggggcaggcggagcttgtggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaa

SEQ ID NO: 22382 - DNA, 376 bp, Homo sapiens
  misc_feature 31, 48, 208, 269: n = A,T,C or G
accaaacgattccctggttatgattctgaanccaaggaatttaatgcngaagtacatcggaagcacatcatgggccagaatgttgcaggattacatgcgctacttaatggaagaagatgaagatgcttacaagaaacagttctctcaatacataaagaacagcgtaactccagacatgatggaggagatgtataagaaagctcatgcngctatacgagagaatccagtctatgaaaagaagcccaagaaagaagttaaaaagaagaggnggaacccgtcccaaaatgtcccttgctcagaagaaggatcgggtagctcaaaagaaggcaagcttcctcagagctcaggagcgggcttgctgagagctaaacccagc

SEQ ID NO: 22383 - DNA, 286 bp, Homo sapiens
gatttacagttttatttttaacaaagttgcataccaccactatgagtttatttttttgaacaaattgtcaagctatccacaaacaagaaggattacaaaaagtgctttatgaatcctacctcaattagtatctggcaacaacagcttctataaatgagaaccataacacaaccactaaaataataaaaatggaaaagccaatacttacaaagtaaacgtgtcataatagagtttatatatatgtattggacttcttccttctagaattcttttaagagatcaacct

SEQ ID NO: 22384 - DNA, 378 bp, Homo sapiens
  misc_feature 80, 117, 127, 138, 160, 197, 259, 261, 337, 359, 367, 373: n = A,T,C or G
ctgcaaaaatagcttgctacatggatcaggccagtggaaatgtaaagaaggccctgaagctgatggggtcaaatgaaggngaattcaaggctgaaggaaatagcaaattcacctacncagttctggnggatggttgcnccgaaacacactggggaatggngcaaaacagtctttgaatatcgaacacgcaaggctgngagactacctattgtaggatattgcaccctatgacattgggggtcctgatcaagaatttggngnggacgttggccctgtttgctttttataaaccaaactctatctgaaatcccaacaaaaaaaatttaactccatatgngttcctcttgttctaatcttgncaaccagngcaagngaccg

SEQ ID NO: 22385 - DNA, 400 bp, Homo sapiens
  misc_feature 2, 10, 31, 73, 89, 93, 156, 205, 212, 216, 220, 287, 312,340: n = A,T,C or G
tnttatggcnggtcttcacaggctgcatacncactttgtgattgatggacacccagtgagcttcagtaaagcngccctggtcagcggcnccgnaagaatcaactcctgtccagcagcctgacatgacagagcacagcttgcccaaatacaaagttntttagagcactgaaagaaacacaaagccagccaggaggaacagtaactnttccttngggnggangctttcatcgagttgaacaggacttaaacgaatcatcagggaccggatatttccttatttctcattnggattcttaaccttgaatccaaagngtctgcaatggacaacaattgaaggagnggcaaacttacttgtatttgagagcacacgcaattcctactggggaaattactggtttct

SEQ ID NO: 22386 - DNA, 148 bp, Homo sapiens
  misc_feature 18, 36, 47, 49, 51, 63, 80, 96, 120, 122: n = A,T,C or G
cccgggggaggcatttgnaggcagcccagcgcaagnggcttctgctnangngacaggcggagnttgtgaaaaccccactntaacttttttttactnaatcctcatgtctaaaataacctngnccccacatgctagggtgttacctctt

SEQ ID NO: 22387 - DNA, 244 bp, Homo sapiens
  misc_feature 3: n = A,T,C or G
tcnaagttaattgcaaatgaaaagaggacttggaactgaagtatcaagaaggaggctgggtcttttcccaaatccctagttttactaagaatctgtcaaatagggaaatcccattttgctatcctacagggatctcataatgaacacatataaagaggaattttaaaattcttgtctccaaactgtttcttcctttatctagtgcatttcaataaattatgccatgatctatgaagttgcaaaa

SEQ ID NO: 22388 - DNA, 389 bp, Homo sapiens
  misc_feature 35, 42, 348, 377: n = A,T,C or G
taaacccgaagcctgctaaagaagcctaaaaaatntacctanttttaaaagttgagattttgacatgtcagctttcttggcattactcaatcctcatgtctaaaataacctggaccccacatgctagggtgttacctcttccctacttttatttcagtttcccttttggagaaccttttataactaatactggtattcttttattttctcactggagtattaatacttatattataagtcattctgcctgtgtcttagaggccaaagtacatgtctagtgactcttcaatgcaatgttataatgggatttttctcctggttagaagtttttgggctgaggtaaaaggncgggtactttctaagtttgaaggataagntttgtatacatg

SEQ ID NO: 22389 - DNA, 386 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgact

SEQ ID NO: 22390 - DNA, 373 bp, Homo sapiens
  misc_feature 175, 193, 252, 280, 282: n = A,T,C or G
aaggcgagtcgtccttagttgcagagccatggctgagcccgctggccagagttaaggttaaggcaccttttcaattacaaacctctgattatcttcggtagtctctatcttcagtgcctgcctgcaaatttgcctttctgccacttccagcagaacacagctctattactaaagngttttaaaaacatgttgnatcaatattcacagaaattagagtcctatgaggcactagaatccaaattcaacttttgncttcctttaattagcattttcctgcagngncaaatgttttttaaagaagccaagaggatttcagggcaatatatagacacttttttccctgtaccttttttatttgaccatattacttaaa

SEQ ID NO: 22391 - DNA, 360 bp, Homo sapiens
  misc_feature 4: n = A,T,C or G
tccnttaatatgagaagaaaataattttttcttattttgtccagaaagaagaaagtagatggagaagataggactataaaatactagaatggctttaatgagccacccaaaatattgattttattattatattgttacagtcataagaagttaatgtgtttaaactcctgtaacacattcatatggtttaatttccttgtaattccccaaagcaaaattcgcttgtaataatatttaaataaccataataagaaggaaaatattatagggtaagtcaactatacaattaaaaaaacaatcaaaagaatgaaatagcattttgtcattatactgctcagaagtaagacaaaagttatgtac

SEQ ID NO: 22392 - DNA, 361 bp, Homo sapiens
gggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaaatttttcccagtatttttat

SEQ ID NO: 22393 - DNA, 290 bp, Homo sapiens
atcatcagctgggcgcggtggctcacgcctgtaatcccagcactttgggaggccgaggtcggcggatcacttgaggtcaggagtttgagaccagcctggccaacatggcgaaatcctgcctctactaaaaatacaaaaattagccaggtgtggtggcgtgcgccttgtaatcccagctactcggctgaggcacaagaactgcttgcacccgggaggtggaggttgcaatgagccgagattgtgccactgccctccagcctaggcgacagagtgagactttgtcccaaaaa

SEQ ID NO: 22394 - DNA, 312 bp, Homo sapiens
  misc_feature 200: n = A,T,C or G
atagattttatgtattgattggcaacaattttgaggcagataacagtaaagagtcttgaggaagctgcagtttaccttaaatctcacaaaggtatcatttgggccagcactgcctgccccgttttgaagaatcatggcaataaaagaacatctttagactcatttttcgtgccccctcttaatacctagataattttggnaggtgttagtactttttaaaatatgtattatgtgggcggctgaggtgggcggatcatgagatcaagacatcaagaccatcctggccaacatggtggaaccccatctctacta

SEQ ID NO: 22395 - DNA, 370 bp, Homo sapiens
  misc_feature 19: n = A,T,C or G
gtgtgctatctgataagantgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttctta

SEQ ID NO: 22396 - DNA, 171 bp, Homo sapiens
  misc_feature 2, 10: n = A,T,C or G
gnattcggcnattatggccggaaatgccccaactaaatactaccgtatggcccaccataattacccccatactccttacactattcctcatcacccaactaaaaatattaaacacaaactaccacctacctccctcaccaaagccctaaaaaaaaaaaaaaaaaaaaaaaa

SEQ ID NO: 22397 - DNA, 261 bp, Homo sapiens
  misc_feature 1, 61, 260: n = A,T,C or G
naaatgaggaaaattattggtaaccaatttattttaaaagcccatcaatttaatttctggnggtgcagaagttagaaggtaaagcttgagaagatgagggtgtttaccgtagaccagaaccaatttagaagaatacttgaagctagaaggggaagttggttaaaaatcacatcaaaaagctactaaaaggactggtgtaatttaaaaaaagctaagggcaaaatgtacaaacttagaagaaaattggaagatagaaccang

SEQ ID NO: 22398 - DNA, 388 bp, Homo sapiens
  misc_feature 5, 30, 55, 94, 206, 314, 367, 373: n = A,T,C or G
gaaanccagagatgctgtatgcactgaatntggatggcgtccgttgccttcatgngaagaaaaatcatgtgataatccttatattccaaatggngactactcacctttaaggattaaacacagaactggagatgaaatcacgtaccagtgtagaaatggtttttatcctgcaacccggggaaatacagccaaatgcacaagtactnggctggatacctgctccgagatgtaccttgaaaccttgtgattatccagacattaaacatggaggtctatatcatgagaatatgcgtagaccatactttccagtagcntgtaggaaaatattactcctattactgtgatgaacattttgagactccgtcanggaagntacttggggatcaca

SEQ ID NO: 22399 - DNA, 186 bp, Homo sapiens
  misc_feature 3, 4, 27, 52, 154, 155, 161, 162: n = A,T,C or G
aannaagagttcaaccgttcgtgactnttgtagcgaatgaagttaaaaaaangtgctttctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaannaaaaannaaaaaaaaaaaaaaaaaaaaaaaa

SEQ ID NO: 22400 - DNA, 378 bp, Homo sapiens
ataaaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggagactggacggaaccacctcaatgcaaagattctacaggaaaatgtggg

SEQ ID NO: 22401 - DNA, 389 bp, Homo sapiens
  misc_feature 1, 19, 31, 213, 214, 228, 290: n = A,T,C or G
ntaaccacatgattctagnacaggatagttngaaaagtactaccaaagatagtggagaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtgctnngtcccgatcaaggnagtatactttttaaagtattttgtctgatttttaaaaaaaattgactgaatttattcaaagntgaaagtgtcctttctctctctctttaataaactcagtttgggacttgataaataatcatagtcttaaatgttagaaatcctatataatattatttatt

SEQ ID NO: 22402 - DNA, 369 bp, Homo sapiens
  misc_feature 205, 335, 343, 361, 366: n = A,T,C or G
ctgccatagttcatgagcttaatacatagctttcttttaagaaaggagccttttttttcaactagcttcctggggtaaacttttctaaaagataaaatggaaaggaactccaaactatgatagaatctgtgtgaatggttaagatgaatgttaaatactatgcttttttgtaagttgatcgtatctgatgtctgtgggactaacnggatcacttaatttttaccttattttggctctaatttgaataagctgagtaaaaccaccaaagatcagttataggataaaatggcatctctaaccataacacaggagaattggaaggagccctaagttgncactcagnttaatttcttttaatggntaggntta

SEQ ID NO: 22403 - DNA, 381 bp, Homo sapiens
  misc_feature 42, 43, 70, 224, 310, 313, 365: n = A,T,C or G
cattatggcgcggagacaccacccgatatggctgagatcgannaattcgataagtcgaaactgaagaagnacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactntgtaagatgcaaagaggttggatcaagtttaaatgactgtgctgcccctttcacatcaaagaactactgacaacgaaggccgcgcntgncctttcccatctgtctatctatctggctggcagggggaagggaaagaacttngcatgttggttgaagg

SEQ ID NO: 22404 - DNA, 388 bp, Homo sapiens
  misc_feature 20, 23, 28, 51, 160, 175, 206, 207, 209, 335, 336, 356, 371: n = A,T,C or G
gggcctcgtttttcctttantcnaggangttacgttggtgttgaggttggnatacgtatcaaggacagtaactaccatggctcccgaagttttgccaaaacctcggatgcgtggcccttctggccaggcgtctgcgaaatcatatggctgtagcattcgngctatccctgggggntgcagctttgtataagtttcgtgtggctgannanagaaagaaggcatacgcaggatttctacagaaactatgatgtcatgaaagattttgaggagatgaggaaggctggtatctttcagagtgtaaagtaatcttggaatataaagaatttcttcagggnngaattaccctagaagtttgncacttgacttggggntcctgaactatgacaca

SEQ ID NO: 22405 - DNA, 400 bp, Homo sapiens
  misc_feature 17, 18, 28, 42, 53, 97, 100, 164: n = A,T,C or G
cttatgggccggggctnnccaacttggnacgctgcagaatgnttcccgcaaanaagggtggcgagaagaaaaagggccgttctgccatcaacgaagnggnaacccgagaatacaccatcaacattcacaagcgcatccatggagtgggcttcaagaagcgtgcncctcgggcactcaaagagattcggaaatttgccatgaaggagatggggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttgggttaccctatgtacctgttaccacttttcaaaaatctacagacag

SEQ ID NO: 22406 - DNA, 327 bp, Homo sapiens
  misc_feature 3, 7, 57: n = A,T,C or G
atnaagnacaaaggtgtccttcataatgaagttaaagtgagtatactgtggagaggncttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacat

SEQ ID NO: 22407 - DNA, 388 bp, Homo sapiens
  misc_feature 5, 6, 15, 30, 53, 55, 61, 111, 201, 202, 207, 208, 338: n = A,T,C or G
aagcnnaaccaggangtttggggttaattnaactcaaaaattttcacaagccngnagggcntatatcagatttggccaactgaatggcgtctgtcctgtcatccatatggngcctggaaatatttaccagtcaaggtcaaggtcagcatctgtggttaaaaatatagcattctgacctaaaaaagttattttgcagatgannggggnntcaactcaggacctatccaaatgaggaatttttaaatattctttttttttcctatttttagacatcaattctatagattctgactttttctaacctcttatagacatgccaaatgctggcaaaaagaagngctttttggatatggcagcaccttgtaaaaataaagcagtaagcaaaatc

SEQ ID NO: 22408 - DNA, 365 bp, Homo sapiens
  misc_feature 210, 349: n = A,T,C or G
gtaaccataggaaaatagatatttcctagtatgatttctgagtttcttactgcaaagcaacagttataaattggtatacatgtgtctctgtaatagggataatattgatatatctgttgctacactatttaagaatcattctatcttatgttgtcttgaggccaagatttaccacgtttgcccagtgtattgaattggtggtagaagggnggtccatgttccatttgtagatctttaagattttatctttgataactttaatagaatgtggctcagttctgatccttcaagcctgtatgggttgggattttcagtaggggacagttgatgtggagtcaatctctttggnacacaggaagctttat

SEQ ID NO: 22409 - DNA, 374 bp, Homo sapiens
  misc_feature 4, 110, 172, 204, 208, 234, 268, 312, 324, 328, 366, 370: n = A,T,C or G
gctnggtgaggtgccgccatttcatctgtcctcattctctgcgcctttcgcagagcttccagcagcggtatgttgggccagagcatccggaggttcacaacctctgtggnccgtaggagccactatgaggagggccctgggaagaatttgccattttcagtggaaaacaagnggtcgttactagctaagatgtgtttgtacttntggntctgcatttgctacacccttccttgnagtaagacaccaactgcttaaaacataaggatgnttcagttcctccatttaacagatatgaagagcattttaagaggngcagcctctggnaggnggatcaaactagaactcatatgccatactagatattgnttgncaat

SEQ ID NO: 22410 - DNA, 256 bp, Homo sapiens
  misc_feature 4, 52, 204, 205, 207, 253: n = A,T,C or G
gaangttaatctatttcataaagaagtcacactacatgatctagctgctggnagcgggcaggcttttccctcttgtcccctccacctcacatctatcagtttgccacagaaagatgagagatgccattggacagaatgtgaccttcctaatgatgtccttttttgtgacaggaattttcttaacttgatttttttgatttaatnngngataaatttatagtcctatacattttaaataaaattgtttttcagngat

SEQ ID NO: 22411 - DNA, 369 bp, Homo sapiens
  misc_feature 5, 50, 56, 102, 139, 206, 263, 279, 302, 314, 318: n = A,T,C or G
cacangagaaaagtgtgtgctttagtattagaggagataggcagagaagncctgcntagttccttcgtgcagcttcttgcccctgttgacgtggaatgctgngtctgctttagcacgcacgctccgaatgactcctggngctaggccatgctggctgctgtcactgagcgggactcaggccaagaggcgtgacctcgggccagccnggctgttgtgcagacgcctcctctgcagaacgcatcagtttctattctgcagttgcngagccagcccccgcgngaggaacgtgcataatgagtgcncacccatcatgncaangggcatactttagtgagcgccatcctgctgaacggggattttcaagggggt

SEQ ID NO: 22412 - DNA, 386 bp, Homo sapiens
  misc_feature 19, 20, 361: n = A,T,C or G
gatcacagtgattcccgannaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagncgatacaatgcgtagatagaagaag

SEQ ID NO: 22413 - DNA, 166 bp, Homo sapiens
  misc_feature 4, 10, 15, 23, 41, 46, 47, 48, 49, 51, 55, 57, 60, 78, 80,101, 102, 151, 160: n = A,T,C or G
gatntttagngtaantacatctnagctttgagggctcctgngacannnngncggntnaanaggttccctggttgcganantacatgagataaatcatgaannccactatcatcctccttctgcttgcacaagtttcctgggctggaccggntcaacaganaggctt

SEQ ID NO: 22414 - DNA, 375 bp, Homo sapiens
gaacacaaagtggcatgaatgcagccacatgttccgcatggatatagccacgtgggacctacacattgcaaggagctgcatcttgtgcctacactcctttctcctatgtcagtgctctaccacttgagcctggtatgcatgttgactgttctcagcaacctcaaatcatgcactgatctcttccctgggtattccttatctgccttttaaccttggctgcatgcatatgttattccatcctgtggtactacctgaccacctggtgaaacaatatcattttcggctgggcgtggtggctcaccgcctgtaatcccagcactttgcgaggccgaggcaggtggatcatttgaggtcaggagttcgggagcagtctgg

SEQ ID NO: 22415 - DNA, 366 bp, Homo sapiens
  misc_feature 14, 59, 323, 360: n = A,T,C or G
gaaactttcaactnctttgcctttcctggcctttactggatcccaaaagcatttaaggnacatgttccaaaaactttgaaaagctaaatgtttcccatgatcgctcattcttcttttatgattcatacgttattccttataaagtaagaactttgttttcctcctatcaaggcagctattttattaaatttttcacttagtctgagaaatagcagatagtctcatatttaggaaaactttccaaataaaataaatgttattctctgataaagagctaatacagaaatgttcaagttattttactttctggtaatgtcttcagnaaaatattttctttatctaaatattaacattctaagnctacca

SEQ ID NO: 22416 - DNA, 371 bp, Homo sapiens
gggctgcgtcgggctgcaggaagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcatt

SEQ ID NO: 22417 - DNA, 386 bp, Homo sapiens
  misc_feature 51, 202, 204, 205, 206, 365, 377: n = A,T,C or G
gaatcacatgaaagctggaatcttatgaacttaatcccttcattaacaggngaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatncnnngctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgnatattctcttgnctggctgca

SEQ ID NO: 22418 - DNA, 365 bp, Homo sapiens
  misc_feature 12, 20, 207, 208: n = A,T,C or G
ggacgtgcagcnctggcagngcagtgagctgtctggccttttgtccttgatccttgggtaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggnnatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaag

SEQ ID NO: 22419 - DNA, 371 bp, Homo sapiens
  misc_feature 335: n = A,T,C or G
atcagaattgatttccctctttaataaagaatgggatagagagattcttcttaatatccttaccctatttgagaatataaatgacaacataaaaaatgaagggctcgcatcatccaggaaagaattcagcagaagttcactttttttcttattcaaagagtctggagtttgtgttaagaaaatcaaagcactagcaaatcacaatgatctggtggtgaaagtaaaagtcctgaaagtattaaccaaactctaatttggagtctgtcccaaacaatattgagatatttgcaggtggtacgatgtgatttgtaaattctttggttttcattgggcgnatatggtaaagagatcttttcagctgctattttgga

SEQ ID NO: 22420 - DNA, 370 bp, Homo sapiens
  misc_feature 19, 29, 101, 205, 206, 207, 260, 303, 325: n = A,T,C or G
gaagattgtaaaaataatnagttactggnatctgtcactgacctttgtttccttattcaggaagataaaaatcagtaacctaccccatgaagatatttggngggagttatatcagtgaagcagtttggtttatattcttatgttatcaccttccaaacaaaagcacttactttttttggaagttatttaatttattttagactcnnngaatataatcttgcactactcagttattactgtttgttctcttattccctagnctgtgtggcaaattaaacaatataagaaggaaaaatttgaagnattagacttctaaataaggggngaaatcatcagaaagaaaaatcaaagtagaaactactaatttttt

SEQ ID NO: 22421 - DNA, 267 bp, Homo sapiens
  misc_feature 91: n = A,T,C or G
gggagaggaggcagggacagacccagcagcacccacctgatcgagaagagcagacaccgtgctcctggaatcacccagcatgttgcaaggnctcctgccagtcagtctcctcctctctgttgcagtaagtgctataaaagaactccctggggtgaagaagtatgaagtggtttatcctataagacttcatccactgcataaaagagaggccaaagagccagagcaacaggaacaatttgaaactgaattaaagtgtaaaaaaaaaaa

SEQ ID NO: 22422 - DNA, 400 bp, Homo sapiens
  misc_feature 6, 8, 27, 231, 232, 233, 383: n = A,T,C or G
ctcggntnttatggaccgggcacgtgngaagaagtaaatacatttggaaaacaataaactaaaaaaaatcccttcaggattaccagagttgaaatacctccagataatcttccttcattctaattcaattgcaagagtgggagtaaatgacttctgtcctacagtgccaaagatgaagaaatctttatacagtgcaataagtttattcaacaacccggtgaaatactgggnnntgcaacctgcaacatttcgttgtgttttgagcagaatgagtgttcagcttgggaactttggaatgtaataattagtaattggtaatgtccatttaatataagattcaaaaatccctacatttggaatacttgaactctattaataatggnagtattatatatacaag

SEQ ID NO: 22423 - DNA, 400 bp, Homo sapiens
  misc_feature 9, 38, 181, 309: n = A,T,C or G
ttttttctncccgggtaactcggcctttatggccggangacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcangaatgtgaaaaaggaaaaaaatactgttgggctcaaactaaattcaaagaagtactttattgcgactcttttaagtgccttggatgagaagtgtcttaaattttcttcctttgaagctttaggcaganccataatggactaaaacattttgactaagtttttataccagcttaatagctgtagttttccctgcactgtgtcatcttttcaaggcatttg

SEQ ID NO: 22424 - DNA, 377 bp, Homo sapiens
  misc_feature 52, 82, 124, 205, 207, 220, 258, 266, 311, 313, 329, 362: n = A,T,C or G
gaggcattgaggcagccagcgcaggggcttctgctgagggggcaggcggagnttgaggaaaccgcagataagtttttttctntttgaaagatagagattaatacaactacttaaaaaatatagncaataggttactaagatattgcttagcggttaagtttttaacgtaattttaatagcttaagattttaagagaaagtatgangncttagaagagtancatgaggaaggaaaagataaaaggtttctaaaacatancggaggtngagatgaagcttcttcatggagtaaaaaatgtatttaaaagaaantngagagaaaggactacngagccccgaatttaataccaatagaagggcaangcttttagattaaaa

SEQ ID NO: 22425 - DNA, 321 bp, Homo sapiens
  misc_feature 56, 194, 204, 206, 268, 287: n = A,T,C or G
acctgtaatgaaaaccttgaaaactattacctggaggtcaatcaacttgagaaggntgacataaagagcttctgcaagatcctggggccattatcctactccaagatcaagcatttgcgtttggatggcaatcgcatctcagaaaccagtcttccaccggatatgtatgaatgtctacgtgttgctaacgaagncactcttaangnatatctgtatcctggaacaatattttatggttatgtttttctgtgtgtcaagttttcatagnatccatattttattactgnttattacttccatgaattttaaaatctgagggaa

SEQ ID NO: 22426 - DNA, 367 bp, Homo sapiens
atatcaatagatgcagaaaaagcatttgctaaaattctatttttcttcatgacaaaaactctcaataaattaggcctagaaggaatatacttctacataataaagtccccgtagagcaaacccatggctgacatactgaatggagaaaagaggaaagcctttcctttaagaagtggaataagacaaaggatggccactttgaccattcctattccgcatagtacctagaagttctaaccaaagcagtcaggcaagaacaagaaataaaaggcacccaaatcagaaaagaggaagtcagattagtccctctttgtagatgacgtgatcttatataggagaaaaaccttaagacttctccaagaaaagt

SEQ ID NO: 22427 - DNA, 366 bp, Homo sapiens
  misc_feature 57, 108, 206: n = A,T,C or G
ggtaggagcctctctccctactgctgctacacaagaccctgagactgacctgcaggncgaaaccatgaagagcctgatccttcttgccatcctggccgccttagcggnagtaactttgtgttatgaatcacatgaaagcatggaatcttatgaacttaatcccttcattaacaggagaaatgcaaataccttcatatcccctcagnggagatggagagctaaagtccaagagaggatccgagaacgctctaagcctgtccacgagctcaatagggaagcctgtgatgactacagactttgcgaacgctacgccatgggttatggatacaatgctgcctataatcgctacttcaggaagcgccgagg

SEQ ID NO: 22428 - DNA, 376 bp, Homo sapiens
  misc_feature 6, 15, 51, 57, 85, 141, 207, 209, 211, 308: n = A,T,C or G
gagtgngaaatcttngagaagaatttctctttagttctttgcaagaagggngagatnaagacactttttcaaaaatggcaatggnatcatgaattcctcaagcaggcctgggttattgaaaatgaagagcaggaatatgtncaaactgtgaagtcatccaaaggtggtcccggatcagcgggtgagcccctatcctaccttcaatcnangntcggatgtcgctgccctgcataaggccataatggttaaaggtgtggatgaagcaaccatcattgacattctaactaagcgaaacaatgcacagcgtnaacagatcaaagcagcatatctccaggaaacaggaaagcccctggatgaaacactgaagaaagccctt

SEQ ID NO: 22429 - DNA, 266 bp, Homo sapiens
  misc_feature 2, 61: n = A,T,C or G
gnctcccaaaataagtcaggcacagtacaacagtgtggagcccctctcatcatatcccgcntgcaaaattcagggagacttggagctcaaaacgcattgacttcttagttgtctccatttgttctgggttaggtgatggatccacagtgacttagcagctttgatgacagccggggcttctggaggcttggcggcatgttaaaaccacctgggtctattccagatggattaaatcaggctctctgggactggggtccagacatcat

SEQ ID NO: 22430 - DNA, 261 bp, Homo sapiens
  misc_feature 32, 247: n = A,T,C or G
gtaatcccagcactttgagtaggcagaggcgngtggatcacttgaggtcagaagttcgagaccagcctggccaatgtagcgaaaccccatctctactacaaatataaaaattggccgggcctagtggcgcatgcctgtaatcccagctactcgggaggctgaagcaggagaatcgcttgaacctgggaagcggaggtttcaggtgagccaagatcccaccattgcattctagcctgggcaacagagngagactctatctct

SEQ ID NO: 22431 - DNA, 367 bp, Homo sapiens
  misc_feature 243, 343, 356, 366: n = A,T,C or G
gacttttacagattgtggccagtgaggatattataatcctatgtaaacagaaaagtcccacttaccgattcattctttcactgtttgtatctgcgcccagaattctcagtggcgtgggggtgagggtgggtggcgattgccttagagggaacccctaaattggttttggataagtttgagcccttgaccttaatttcattgctaccactctgatctcttagcacatttcttaggattaagggnccaaaaatgctggtctaaggggttgccatggtgttgaacaatgcaactttttatttaaaaaagctctgcactgccatgtatgaaagtctctttatgatgnttgggttttttgncattttttgnt

SEQ ID NO: 22432 - DNA, 376 bp, Homo sapiens
  misc_feature 6, 51, 207, 209, 326: n = A,T,C or G
gacgangaagaggaggagcagttggttctggtggaattatcaggaattatngattcagacttcctctcaaaatgtgaaaataaatgcaaggttttgggcattgacactgagaggcccattctgcaagtggacagctgtgtctttgctggggagtatgaagacactctagggacctgtgttatatttgaagaaaatgttgaacatgcngntacagaaggcactaataaaacagtgctaaaatataaatgccatacaatgaagaagctcagcatgacaagaactctcctgacagagaagaaggaaggagaagaaaacataggtggggnggaatggctgcaaaataaaggataatgatttctcctatcgacccaacatg

SEQ ID NO: 22433 - DNA, 376 bp, Homo sapiens
  misc_feature 51, 52, 54, 58, 62, 206, 208, 312, 322: n = A,T,C or G
gaactcggtggtggccactgcgcagaccatacttcgctcgtactcgtgcgnntnggtnccgnttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgantngggaatgaggcgtgcgcccgccattatgcactgtacattccacaagcattgccttcttattttacttcttttagctgtttaactttgtaagatgcaaagagggntggatcaagnttaaatgactgggctgccccctttcacatcaaaagaactacttgacaacgaagg

SEQ ID NO: 22434 - DNA, 143 bp, Homo sapiens
  misc_feature 2, 13, 32, 38, 40, 66, 67, 70, 71, 72, 73, 104, 112: n = A,T,C or G
cnggggaaaaacntaaatttaaaaataccctngcaaantnaaaaaaaaaaaaaaaaaagaaggagnnagnnnnaaaaaaaaaaaaaaaaaaaagaaaggggggnaaaaaaanaaaaaaaaaaaaaaaaaaaaaaaaaaaaaaa

SEQ ID NO: 22435 - DNA, 146 bp, Homo sapiens
  misc_feature 97: n = A,T,C or G
gacataaacattggttacctgtaaaaggtgaaaaaaaaaaacaggttcagattttctgcttaaatatcaaagggcaaatggaacatttttacgatcncctaaaattcttgaaataggccaagatttttcatatacaaaggcaacag

SEQ ID NO: 22436 - DNA, 221 bp, Homo sapiens
  misc_feature 59, 63, 205, 206, 220: n = A,T,C or G
ggatataccgttgtattaaaaacaagataaaaaagctgccaagatttttggcgagtggntggnctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaatnnaagttattataacng

SEQ ID NO: 22437 - DNA, 289 bp, Homo sapiens
  misc_feature 2, 6, 80, 82, 84, 192, 210, 225, 240, 242, 263, 276: n = A,T,C or G
gngtancttctgttcatctatggtccggggaaaggtatgaagcatgacttttccccaggtagcagcttgccttaaagggnantntacgggcttttgcttgaacaaggcacagaagatgaaagctaactatgatttaaaaaaaaatatatatatatatatatatatatacacacatacatacttgctgagggngggaagaatgtgggacanaataagtatagaggntgtgatggggggganantggattaagtcccagatacanacaaaacaaagcnaaacaaaacagag

SEQ ID NO: 22438 - DNA, 376 bp, Homo sapiens
  misc_feature 89, 208, 362: n = A,T,C or G
gcttttcgatccgccatctgcggtggagccgccaccaaaatgcagattttcgtgaaaacccttacggggaagaccatcaccctcgaggntgaaccctcggatacgatagaaaatgtaaaggccaagatccaggataaggaaggaattcctcctgatcagcagagactgatctttgctggcaagcagctggaagatggacgtactttgnctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggnggatgagaatggca

SEQ ID NO: 22439 - DNA, 167 bp, Homo sapiens
  misc_feature 8, 9, 158, 160: n = A,T,C or G
gtaatttnngccttatggccggcctgtgggcttgagcatggtactgaagtgaaggagttctcaggataaggggcaacagtgtgcagtgtaggctgagaatagacccaggatttgcaggaccagctaggagaaagttggcagggaagcgggtctttggnanaaaaaaa

SEQ ID NO: 22440 - DNA, 366 bp, Homo sapiens
  misc_feature 50, 51, 206, 207, 208: n = A,T,C or G
tattgaaattgatttattaagagaaaatcgtaatacgcatttacagtaanngggacctctgctatattttgtatagtagatggccatatgtaggaaagggcatacattatagcacaatttaagttatatcaaatctgagtttgagtcacagatctgtacttcagtaattatgaccctggctaagttagtccatctatttgaatctnnnttttctcatctatgaaaatagatagaaatgctgtctcttttataagattgaggtgaaaggtaggaaaaagacatcagtatgtcaaggtttcagcacagtgtctggcacatagtagttacccactccatgtttattaatattataattttaattataat

SEQ ID NO: 22441 - DNA, 100 bp, Homo sapiens
  misc_feature 5, 18, 27, 32, 33, 46, 49, 50, 52, 58, 61, 66, 67, 78, 80,82, 83, 89: n = A,T,C or G
ttatntctctgcgatgcnccaataaanaccannatttactccctgnctnnanaaaaantantgtgnnagaaagggggnantnnaaaaantttactttcgt

SEQ ID NO: 22442 - DNA, 378 bp, Homo sapiens
  misc_feature 114: n = A,T,C or G
ggagaaacgacacaggttaggagacgtcgctttgaacgtgctataggaccttctcaaacacacaccatcagaattcaatattcacctgccagactggcttatcaagacaaaggngtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaata

SEQ ID NO: 22443 - DNA, 377 bp, Homo sapiens
  misc_feature 289, 290, 336, 355: n = A,T,C or G
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggggctttctatctcttgnnctacactgaattcacccccactgaaaaagatgagtatgcctgccgngtgaaccatgtgactttgncacagcccaagatagttaagtg

SEQ ID NO: 22444 - DNA, 382 bp, Homo sapiens
  misc_feature 54, 57, 58, 208, 213, 318: n = A,T,C or G
attgctaaaaaataaataaaagctagatactggaaacctaactgcaatgggggnggnntacccacatgacttattatgcgtaaagccaaatttccagtttaagtaattgcctacaataaaaagaaattttgcctgccattttcagaatcatcttttgaagctttctgttgatgttaactgagctactagagatattcttatttcactnaatgnaaaatttggagtaaatatatatgtcaatatttagtaaagcttttcttttttaatttccaggaaaaaataaaaagagtatgagtcttctgtaattcattgagcagntagctcattttgagataaagtcaaatgccaaacactagctctggattaatccccatcattactg

SEQ ID NO: 22445 - DNA, 382 bp, Homo sapiens
  misc_feature 202, 208, 209, 282, 314, 371: n = A,T,C or G
gaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgngggcgnntaagaaaaagtttgcctgcaatggtactgtaattgagcatccggaatatggagaagtaattcagctacagggngaccaacgcaagaacatatgccagttcctcgnagagattggactggctaaggacgatcagctgaaggttcatgggttttaagtgcttgnggctcactgaa

SEQ ID NO: 22446 - DNA, 372 bp, Homo sapiens
caataccattacatggaacttttctgtaatgggtacaatgaagaagtttctaaaaacacacacaaagcacattgggccaactatttagtaagcccggatagacttattgccaaaaacaaaaaatagctttcaaaagaaatttaagttctatgagaaattccttagtcatggtgttgcgtaaatcatattttagctgcacggcattaccccacacagggtggcagaacttgaagggttacttgacgtgtaaatgctggtattttgatttcctgtgtgtgttgccctggcattaagggcattttacccttgcagttttactaaaacactgaaaaatattccaagcttcatattaaccctacctgtcaacgtaac

SEQ ID NO: 22447 - DNA, 376 bp, Homo sapiens
  misc_feature 11, 51, 206, 208, 209, 270, 338: n = A,T,C or G
ataccatcagnagaacaaacactaatgttaattgcccaattgagtgcttcntgcctttagatgtacaggctgacagagaagattcccgagagtaaatcatctttccaatccagaggaacaagcatgtctctctgccaagatccatctaaactggagtgatgttagcagacccagcttagagttcttctttctttcttaagcccttngnnctggaggaagttctccagcttcagctcaactcacagcttctccaagcatcaccctgggagnttcctgagggttttctcataaatgagggctgcacattgcctgttctgcttcgaagtattcaataccgntcagtattttaaatgaaagtgattctaagattttgggt

SEQ ID NO: 22448 - DNA, 371 bp, Homo sapiens
  misc_feature 260, 311: n = A,T,C or G
atcctaatattgcattaaatatactcaatttgttagcttattttaaatatctttttggaaattttagatgttaattattcagcagttacattctgattgagttttgttaagaagagtagaataacggtgtcacaaatgtttagttgttgtttttataacaatcctccaggtgataaactccatgaaggcaggtaggagagcccaacttgtttattgccaaattcccagacacttgtccaatgtctgggaatctacgtggnaaattatctgttattttgttgcatgtgggaggaaatgcgctttaagtgggnggcctcttttggagcctgtcagttccatgtcaattaaacattatcaaaatatctggtttt

SEQ ID NO: 22449 - DNA, 377 bp, Homo sapiens
  misc_feature 38, 207, 208, 234, 348: n = A,T,C or G
aggaaagaagggccctggcaggccaacaggctcaaagnaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctnngtactagcttcagtataaaaactgtncagatttttgtatagctgataagattctctgtagagaaaatacttttaaaaaatgcaggttgtagcctttttgatgggctacctcatacagttagattttacagcttctgatgntgaatgttcctaaatatttaatgggtttt

SEQ ID NO: 22450 - DNA, 190 bp, Homo sapiens
  misc_feature 2, 6, 8, 11, 14, 16, 26, 30, 44, 47, 56, 57, 59, 60, 102,103, 147, 181: n = A,T,C or G
anaggngngantgnancaaaaaaacnaaanaaaaaaaaaaaaanaanaaaattttnntnnaaaaaaaaaaaaaaaaaaaaaaaaaaaaaaaaaaaaaaaaanntttttttttcttccccccccccccccgccttttttttttttttnccctttttttttttccggggggggggggttttcnttttttttt

SEQ ID NO: 22451 - DNA, 371 bp, Homo sapiens
  misc_feature 357, 360: n = A,T,C or G
gtagtatctgaatttgtcttttaaaatgagtacatatataggcaataaatatatatgctcagatcaatatacttgtttagaaaaacttcaagacattcaaaaactaggaaggagtatgtttaatagtatttgtataaatttggtggttatgtttttttattttgtttctgttttgtgtagaggtaaaaactatagttttattacagcataattcattttgagctccactatgacatttcaaagactgcccagtttggaagtctgtcatgatttttactctttcactccaattcagtaattgttgatagtattacttacctagtccatccatactcatattattcaaatatatagggnggnacttttgaaac

SEQ ID NO: 22452 - DNA, 371 bp, Homo sapiens
  misc_feature 51, 132: n = A,T,C or G
atatgaggaggtagccaaaatgcctcccttccagaaaaaaacattagtatngataggagctcaaggtgtaggccgaagaagcttgaaaaacaggttcatagtattgaatcccactagatttggaactacggngccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagttta

SEQ ID NO: 22453 - DNA, 372 bp, Homo sapiens
  misc_feature 206: n = A,T,C or G
tgatttcaaatgtagaaaatcctaaggaattcactaaaaagaactgatagaagtaatgagcttagcaaggttgcagggtacaaggtcagtatagaaaaatcagctgtatttctgtacaatgcaatgaacaatctgaaaatgaaattaaaccaattttatttacagtggcaccaaaaggaataaaatacttagaaataaatttaatngaacaagtgtaatacactctgaaaactacaaaacaatgttgaaagagattaatagggttaagaaggcaatactcaccaaattgatctgtagattcaacatgattcctattagaatcccatctggcttctttgtagaattaacaagatgatcatgggaattcatatg

SEQ ID NO: 22454 - DNA, 212 bp, Homo sapiens
  misc_feature 5: n = A,T,C or G
aagcnaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatata

SEQ ID NO: 22455 - DNA, 372 bp, Homo sapiens
  misc_feature 205, 319: n = A,T,C or G
ggccgtcacttccggttctctgtcgtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggngagacttcgagagccctgtcatcttctaaacagagcagcagcagcagagatgataacatgtttcagattgggaaaatgagggtacgttagtgttcgcgattttaaaggcaaagngctaattgatattagagaattttggatggatcctgaaggggaaatgaaaccag

SEQ ID NO: 22456 - DNA, 109 bp, Homo sapiens
  misc_feature 11, 12, 27, 30, 37, 38, 39, 45, 47, 52, 57, 79, 80, 81, 83,84, 86, 87, 90, 94: n = A,T,C or G
tttgccttttnnccttagctacaaatntanggggggnnnggaaananaaaanaaaanaaaaaaaaaaaaaaaaaaaaannntnntnnaanaaanaaaaaaaaaaaaaaa

SEQ ID NO: 22457 - DNA, 372 bp, Homo sapiens
  misc_feature 74, 76, 268, 341: n = A,T,C or G
ggagagaaatcgcttggacttcggggcggcctcggacggccatggcctttaccctgtactcactgctgcaggcngncctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgngttaccttttattatttggatgaatatcagggggagaaaatggagactcagaagaggacatgccagtagaagntattacttttggtcattattggaatatttat

SEQ ID NO: 22458 - DNA, 370 bp, Homo sapiens
ggatctggccaggagtcacaggatatacacccattctggagctttcctctgttgttctagaagatgttatttgattagttggggctgggagcaggggatatatgattttgtggaaaaggtatcagataatcaaatcaggtctgcctctgctatagccagtgtgctgctgattaaaagggaacaaaaggaaggtgcaaccgtaagagcagacacaacctgagatgcccttgagatttaggagaacaggagggcgccctttctgttgtgacctgactcttaaaagaaatcttctaaaagaattctttaatttggtaatgagttgaagtccagggtaatggaagctctagggcagagaacaaaagaattgcaa

SEQ ID NO: 22459 - DNA, 126 bp, Homo sapiens
agttgtgtactgctgaaaatgcaggcttttgtaacagtgtgatctttactgatgcactcatgacaagtacccaatgtattttagctattttagtagtatttgttcaataaatacgcaagctgtaag

SEQ ID NO: 22460 - DNA, 372 bp, Homo sapiens
  misc_feature 146, 204, 209, 331: n = A,T,C or G
gctataatggatttggtaatgatggaagcaattttggaggtggtggaagctacaatgattttgggaattacaacaatcagtcttcaaattttggacccatgaagggaggaaattttggaggcagaagctctggcccctatggcggnggaggccaatactttgcaaaaccacgaaaccaaggtggctatggcggttccagcagcngcagnagctatggcagtggcagaagattttaattaggaaacaaagcttagcaggagaggagagccagagaagtgacagggaagctacaggttacaacagatttgtgaactcagccaagcacagtggnggcagggcctagctgctacaaagaagacatgttttagacaa

SEQ ID NO: 22461 - DNA, 371 bp, Homo sapiens
  misc_feature 112, 166, 266, 287, 338, 352: n = A,T,C or G
ggacatttgaacacaaacttttatgaagtataagctcagaatactgaaaatggcacagactgacacaacacaatatttttcttatttgtgtattaaatgtcataaataaggnaaattctaaaacactgacctctgagtttgtgcagtttattcccaattcatgtgngttattcacactcttcttgtattttaaaaaatgatatagaaagatatatttagaattttataattagatcagaattttatacacatacatgtgtgtgtgngcacacacatacacacacagncatgcatcactttaacaatgtgaatacattctgagaaatgtgtccttaggngattttgcccttgngcaaacgtaatagagttca

SEQ ID NO: 22462 - DNA, 373 bp, Homo sapiens
  misc_feature 113: n = A,T,C or G
gatcccgtaggagcctctctccctactgctgctacacaagaccctgagactgacctgcaggacgaaaccatgaagagcctgatccttcttgccatcctggccgccttagcggnagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgaggga

SEQ ID NO: 22463 - DNA, 253 bp, Homo sapiens
  misc_feature 43, 56: n = A,T,C or G
gataaaaagaagaaatataaaattgactcaaattactattggnagaaaattgaggnttttccctaaaaatacgcagtagctgtttacactgatcacagtaatcatgtaattgtgaaatttcctatttcattttgagcctatattatgagccctgagagtaactatgcccacttgacagaacgtaattaagaaagccctatttcaacaagggaaatttgcattcactgcccttgacccataacttattgacatt

SEQ ID NO: 22464 - DNA, 257 bp, Homo sapiens
  misc_feature 32, 54, 74, 91: n = A,T,C or G
gatgctttggtgaaaattctaaacttctaatngaaagcatgatttgagcttggnactacccaacaaaagttggngaatcactcaggaaggntaacattcagagggaagcaggtgatgcttacaaactctgaagcaccacatagtctgttcaaaggcttcatatcactgatataaagcagtgggtaggatggcatctgcccatttttaaatacagatgcttaaggtttctcttaggacatgggtatcagggcttactc

SEQ ID NO: 22465 - DNA, 204 bp, Homo sapiens
  misc_feature 60, 82, 98, 104, 112: n = A,T,C or G
gggggggcagtcaggtctttcccttcccatgaggccatatctcaggctatcacatggggngaaacctggggcaatacctggntttcctaggcagaggnccctgngggcttgngcagggtattgggtctctgggtacttgagattggagaatggggatgacttttaccaagcatactgccttcaagcactttttaaacaaagcac

SEQ ID NO: 22466 - DNA, 386 bp, Homo sapiens
  misc_feature 92, 114, 204, 205, 322: n = A,T,C or G
ggaggctgacgagtggcggtttaagcccatcgagcagctgctgggattcaccccctcttcaggttgatactgcctggatggtcacctctggngcgcagcaagtgcaaagccagngggggactttctcacagcttacatagccatccagagatccacagctacgtcactgaattgttaatgcacatttgtacttggtttctctgnntctattcacaggcaacaaatacttatatgtgtgatctttcagggaatgttttgtttatttgtttttaaaagtattgggaatcagattaagacaatcagtttcagagaaccaggaggnttggggttaagagatactcaaaaattttcacaagccaagtagggcatatatcaagatttggcca

SEQ ID NO: 22467 - DNA, 371 bp, Homo sapiens
  misc_feature 208, 264: n = A,T,C or G
aagcagaggtggcagcattcagcagtatatttataaacaggaacctgtacagaagtgccctggaagaaggcctgctctaaattatccagtgtatggagaaacgacacaggttaggagacgtcgctttgaacgttctataggaccttctcaaacacacaccatcagaattcaatattcacctgccagactggcttatcaagacaaaggngtccttcataatgaagttaaagtgagtatactgtggagaggacttccaaatgtggntacctcagctatatcactgcccaacatcagaaaacctgacggctatgattactatgccttttctaaagatcaatactataacattgatgtgcctagtagaacagcaa

SEQ ID NO: 22468 - DNA, 370 bp, Homo sapiens
  misc_feature 51, 53, 54, 57: n = A,T,C or G
gaacaataaaattagcaaagttagtcctggagcatttacacctttggggangnnggnacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagtt

SEQ ID NO: 22469 - DNA, 376 bp, Homo sapiens
  misc_feature 209: n = A,T,C or G
ggaagcgacgcgaggagctgttcatcgaacagaagaaaagaaaactccttccagacactattttggagaagttaaccacagcttcacagactaacatcaagaaatcgccaggaaaggtgaaagaagttaatttgcaaaagaaaaatgaagactgtgaaaaaggaaatgactccaagaaagttaaagtacaaaaagtacagtctgtcagncagaataaaagctacttggccgtaaggctaaaagaccaagatctgagagattcaaggcaacaagcagcacaagccttcatacataattcattatatgggccaggaaccaacaggactactgtaaataagttcctgtctcttgccaacaagaggttaccagtgaaaag

SEQ ID NO: 22470 - DNA, 371 bp, Homo sapiens
  misc_feature 336: n = A,T,C or G
acagcaccctcctgaaaactgcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggngtcctggtacatgtgcagaaatgggatggaaaatc

SEQ ID NO: 22471 - DNA, 388 bp, Homo sapiens
  misc_feature 4, 48, 49, 50, 87, 117, 202, 203, 206, 335, 354: n = A,T,C or G
gatncctgagctgacagcattcgggccgagcatgtctcgctccgtggnnntagctgtgctcgcgctactctctctttctggcctggnggctatccagcgtactccaaagattcaggnttactcacgtcatccagcagagaatggaaagtcaaatttcctgaattgctatgtgtcctgggtttcatccatccgacattgaagnnganttactgaagaatggagagagaattgaaaaagtggagcattcagacttgtctttcagcaaggactggtctttctatctcttgtactacactgaattcacccccactgaaaaagatgagtatgcctgccgngtgaaccatgtgactttgncacagcccaagatagttaagtgggatcgagacat

SEQ ID NO: 22472 - DNA, 202 bp, Homo sapiens
  misc_feature 4, 6, 110, 121: n = A,T,C or G
tcgntncttaggccggggtcctttcgttgcctgatcgccgccatcatgggtcgcatgcatgctcccgggaagggcctgtcccagtcggctttaccctatcgacgcagcgnccccacttggntgaagttgacatctgacgacgtgaaggagcagatttacaaactggccaagaagggccttactccttcacagatcggtgtaa

SEQ ID NO: 22473 - DNA, 382 bp, Homo sapiens
  misc_feature 13, 58: n = A,T,C or G
ggagcatttaagnaagcatcctctgccaagtaccaaaaggaaagaagaaaaagggccnaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctg

SEQ ID NO: 22474 - DNA, 371 bp, Homo sapiens
  misc_feature 13, 18, 50, 207, 208, 229: n = A,T,C or G
atcaactacaatnaaaanagcgatttgctgaaggaaaaatcggactgcanatcattccaaggccaaactgcaactgagccacccactcccaaacaggaaaccctggtgaaggttcaaggaagcacggagattctctccaacaaaggtccagttaggaaacgacgctgagaggatgacgacaacgtgcaacagcagaaagatgcttgnnagcagagtcaggggcaccagngaatgccacaaaagttctctttcccactgtttaatttgacaagagaagaatttgaaggatatgaacattttcaagaactctgctgaggtcacttagagcgccatcacaacttatttgggtgactaattgcctagattgtaag

SEQ ID NO: 22475 - DNA, 362 bp, Homo sapiens
  misc_feature 51, 54, 210: n = A,T,C or G
gcctctttttccggctggaaccatggagggtgtagaagagaagaagaaggnggntcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcnggatgtacagaactgaaattcgaatggcgaggatggcaagaaaagctggcaaccttctatgtacctgcagaacccaaattggcgtttgtcatcagaatcagaggtatcaatggagtgagcccaaaggttcgaaaggtgttgcagcttcttcg

SEQ ID NO: 22476 - DNA, 369 bp, Homo sapiens
  misc_feature 2, 25, 185: n = A,T,C or G
gnagcactgttcacaatagcaaagnacatggaatcaatctaaatgtccatcaatgacacactggataaagaaaatgtggtacatgtgcaccatggaatatatgcagccataaaaaagaacaagatcatgtcttttgtgggaacatgaatgaagctggaggctatcatccttagcaaactaatgcntaaacagaaaaccaaatactgcgtgtcctcacttattagtgggagctaaatgataagaacttatgaacacaaagaaggaaacaatagacactggggtctgcttgagggggaagggtggaagggagaggagcagaagagataactatcaggtactgggcttaatgcctgggggatgtaataatgc

SEQ ID NO: 22477 - DNA, 337 bp, Homo sapiens
  misc_feature 56, 171, 332: n = A,T,C or G
aattcaccgaattcgaataccctaacaagccgcaacgtaaaatccttggaaaaggngtgtgctgacttgataagaggcgcaaaagaaaagaatctcaaagtgaaaggaccagttcgaatgcctaccaagactttgagaatcactacaagaaaaactccttgtggtgaaggntctaagacgtgggatcgtttccagatgagaattcacaagcgactcattgacttgcacagtccttctgagattggtaagcagattacttccatcagtattgagccaggagttgaggtggaagtcaccattgcagatgcttaagtcaactattttaataaatngatga

SEQ ID NO: 22478 - DNA, 148 bp, Homo sapiens
gaaaacacaccacattgaaaatcctgcccagcagcagccgcagcccgccaacagcagcgctgttagtgagctaagtaagcactggcttcgtagaaaaccataacatcggccatcttggaaaagagaaaaacaatggagttacttatct

SEQ ID NO: 22479 - DNA, 388 bp, Homo sapiens
  misc_feature 5, 28, 30, 53, 54, 58, 210, 243, 286, 333, 335: n = A,T,C or G
gaacncggtggtggccactgcgcagatnanacttcgctcgtactcgtgcgggnngggnggcgcttttcctccgcaaccatgtctgacaaacccgatatgggctgagatcgagaaattcgataagtcgaaactgaagaagacagagacgcaagagaaaaatccactgccttccaaagaaacgattgaacaggagaagcaagcaggcggatngtaatgaggcgtgccccgccaatatgcactgtncattccacaagcattgccttcttattttacttcttttagctgnttaactttgtaagatgcaaagaggttggatcaagtttaaatgactgngntgccccctttcacatcaaagaactacttgacaacgaaggccggggccctgcct

SEQ ID NO: 22480 - DNA, 116 bp, Homo sapiens
  misc_feature 3, 7, 29, 55, 80: n = A,T,C or G
cgnaganacttacaccataattaaacagngagttatagacttgctgagtttggcntagatagtgcactcatttaatctgngcctctcaaaacttcagaatattagcatattaccac

SEQ ID NO: 22481 - DNA, 375 bp, Homo sapiens
  misc_feature 28, 30, 55, 59, 110, 162, 208, 210: n = A,T,C or G
ggctcttttgtccgacatcttgacgagntntgcggtgtctgctgctattctccgngctncgcaatgccgcctaaggacgacaagaagaagaaggacgctggaaagtcggncaagaaagacaaagacccagtgaacaaatccgggggcaaggccaaaaaagangaagtggtccaaaggcaaagttcgggacaagctcaataacttaggntnggttgacaaagctacctatgataaactctgtaagggaagttcccaactataaacttataaccccagctgtggtctctgagagactgaagattcgaggctccctggccagggcagcccttcagggagctccttagtaaaggacttatcaaactggtttcaaagcac

SEQ ID NO: 22482 - DNA, 358 bp, Homo sapiens
  misc_feature 11, 30, 55, 109, 205, 327: n = A,T,C or G
aataacaaagnaattttgcctgccattttngaatcatcttttgaagctttctgtngatgttaactgagctactagagatattcttatttcactaaatgtaaaatttggngtaaatatatatgtcaatatttagtaaagcttttcttttttaatttccaggaaaaaaataaaaagagtatgagtcttctgtaattcattgagcagngagctcatttgagataaagtcaaatgccaaacactagctctgtattaatccccatcattactggtaaagcctcatttgaatgtgtgaattcaatacaggctatgtaaaatttttactaatgncattattttgaaaaaataaatttaaaaatac

SEQ ID NO: 22483 - DNA, 215 bp, Homo sapiens
  misc_feature 1, 5, 207, 208: n = A,T,C or G
nagtnctaaaacattgcagtgtgcctgtatttctttactgcaagtggcactgttctcaacaagttatctcgaagaaaatggcagtgttcatcaatacaaaaattgttatatccagcaggtgggattctacatagccaatctaataagagaactctttgtaaaactaggttaaaaattcagaatgtcttgatcattaccagtaatctnnaaggaaa

SEQ ID NO: 22484 - DNA, 389 bp, Homo sapiens
  misc_feature 2, 53, 54, 203, 204, 205: n = A,T,C or G
gnttcccgaatttgtgctttattacattttggatggagagcccttaagtattnntgatcgggtttgaaccattttgggagaattaattacagtgccaagtacatagtaagtgtttaaagagcacagcctttccaagtgacctcagccaacatacagcacttaactccctcaattttatttgtaaaacagggatgataatactnnntacctcatagggttgttatgaggattacataaattaatgcatataaaacatttaaaacttgtctggtactttgtaagtattcagtgccatcccaatcaagctaccaatgactttcttcacagaattggaaaaaactactttaaatttcatttgggaccaaaaaagagcccgcattgccaagtca

SEQ ID NO: 22485 - DNA, 247 bp, Homo sapiens
  misc_feature 3, 54, 57, 144, 145, 208, 209, 211, 212: n = A,T,C or G
ganctgtgtgtgtcctacacaatggttctattctgtgtcaaacacctctgtatnttntaaaacatcaattgatattaaaaatgaaaagattattggaaagtacaaaaaaaaaaaaaaaaaaaaaaaaaaaaaaaaaaaaaaaannaaaaaaaaaaaaaaaaaaaaaaaaaaaaaaaaaaaaaaaaaaaaaaaaaaaaaaaaaaaaaannannaggaaaaaaaaaaaaaaaaaaaaaaaaaaaaaaaa

SEQ ID NO: 22486 - DNA, 388 bp, Homo sapiens
  misc_feature 2, 28, 53, 56, 64, 203, 206, 361: n = A,T,C or G
antccattgaagttctagttatttctgntgttgctgtggatctacagatacgnganattttggnataactagaatcttgatttctttcataaagttctgccatgttctatttctttccttaatgtttttttcttccctactgttttatcccccctttgctttggaaggatattgctgcatatcgagctaaaggaaagcctgangcngcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagntttttttttcttggctataaagcattt

SEQ ID NO: 22487 - DNA, 368 bp, Homo sapiens
  misc_feature 28, 36, 114, 154, 161, 207, 252, 254, 289, 328: n = A,T,C or G
caataaaaaatagaattacatttctctnactagggngggtctcaagctcttttatttttttaaagtactacaggaaattctgggtaaaatctaagactctaggctgggagtggnggctcatgtctgtaatcctagaactttgaaaagctgcggnagatggntcacttgagctcaggagtttgaaaccagcctgggcaacatgggganacctaccctctacaaaaaataagataattagccaggctttgtagngngtgcccatagtctaagctacttgggaggctgaggngggggaaccacctgagcctgcgaagccgaggcctgcagngtgccaagattggcccactgcactccagcctggggaacaa

SEQ ID NO: 22488 - DNA, 231 bp, Homo sapiens
  misc_feature 6, 28, 30, 55, 56, 58, 205, 209, 224: n = A,T,C or G
atatcnaggaggctaggagttcgaggtntncctggccagcatagcgaaaacttgnntntactaaaaatacaaaaattagtcaggcatggtggtgcaccgtctgtaataccagcttctcaggaggctgaggcacgaggatcacttgaacccaggaggaggaggttgcagtgagctgagatcatgccagggcaacagaatgagactntggntaaaaaaaaaaaaangggactt

SEQ ID NO: 22489 - DNA, 387 bp, Homo sapiens
  misc_feature 31, 47, 49, 199, 203, 204, 246, 365: n = A,T,C or G
ccctcgggtgttattcttaatgtttttgtcnaagcttcttaaaaatntncacttgggttcagccatagttcaccttccctgttccaggtttatttaattccaaaggtgagagttggagtgagatgtcttccatatctatacctttgtgcacagttgaatgggaactgtttgggtttagggcatcttagagttgattgangggnnaagcagacaggaactggtgggaggtcaagtggggaagttggngaatgtggaataacttacctttgtgctccacttaaaccagatgtgttgcagctttcctgacatgcaaggatctactttaattccacactctcattaataaattgaataaaagggaatgntttggcacctgatataatctgc

SEQ ID NO: 22490 - DNA, 245 bp, Homo sapiens
  misc_feature 12, 112, 171, 209: n = A,T,C or G
gcgcccccgaancgtttactttgaaataattagagtgttcaaagcaggcccgagccgcctggataccgcagctaggaataatggaataggaccgcggttctattttgttggntttcggaactgaggccatgattaagaggggcggccgggggcatttcgtattgcgcccgntagaggtgaaattcttggaccggcgcaagacggggccngagcgaaagcatttgccaagaatgttttcatttttc

SEQ ID NO: 22491 - DNA, 167 bp, Homo sapiens
  misc_feature 13, 22, 72, 94, 124: n = A,T,C or G
gaggcattgaggnagccagcgnaggggcttctgctgagggggcaggcggagcttgaggaaaccgcagataantttttttctctttgaaagatanagattaatacaactacttaaaaaatatagncaataggttactaagatatatgcttagcgttaagtttttaacg

SEQ ID NO: 22492 - DNA, 121 bp, Homo sapiens
  misc_feature 7, 19, 27, 31, 32, 35, 70, 80, 101: n = A,T,C or G
ttttttntgcccgggagcnttcggttncttnnggnccgggggaaagcagggctgcacattgcccttgttnctgcttcgantattcaataccgctcagtatnttaaatggaagtgattctaa

SEQ ID NO: 22493 - DNA, 364 bp, Homo sapiens
  misc_feature 131, 146, 204, 205: n = A,T,C or G
atttattggaattgcattttgagatccaaagctgcttattgaatttccatatgaggggagtttgtgtgaggacccagcaacagacaagctgttttccagaaaaagctactcacatcaaattaatatccggnttctttaaaattgcnggaacatggctagaccaagcttttattctattatctgaccagagttgggaatagaagnnaattgttactattttcatggctagagtactaacaactccagaaaaatacaaggctggagggtaagagacactgacgctatggtcagaatatgtaacatacttctggagttctggaggattagagatgagaaatggggcaaaagcaatgtttgggaaatt

SEQ ID NO: 22494 - DNA, 376 bp, Homo sapiens
  misc_feature 6, 331: n = A,T,C or G
caggcnatatgataaaaaagaattagacatcaagtcattaaaagacatataggaaccctaaatgcttattgttaagtgaaaaccaatctgaaaaggctttctatgttgtatgattgcaattatatgacattctgggagaggcaaaactatcgagcgagtcaaaggaccagtggttgcttgagagttgaggggaaaggagggatggcaggtaggtgatttttaggacagtgaaagtactctgtagggtactgtaatttgtcaaaatgcagagaatggaaaacagtgagcggaaaacacagggtaaaccctagtgtcaactctggacttcagntaataacagtgtaccactattggctcatcaattgtaacaaatgaa

SEQ ID NO: 22495 - DNA, 370 bp, Homo sapiens
  misc_feature 30, 52, 55, 58, 206, 207: n = A,T,C or G
ggcccttactgcaggaaaaaggtcccggtntagctgagcagtcaagatgtgnganttngccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggnnccccaagagtgatgagatgaatgtgaaggtgctggactttgagcactttctgcccatgctgcagacggtggccaagaacaaggaccagggcacctatgaggattatgtcgaaggacttcggggtgtttgacaaggaaggaaatggcaccgtcatgggtgctga

SEQ ID NO: 22496 - DNA, 147 bp, Homo sapiens
  misc_feature 140: n = A,T,C or G
gacactctccttcgggaaaatgttatgtggaggaggacgaataaatttattttgttttccaaaaaaaaaaaaaaaaaaaaaaaaaaaaaaaaaaaaaaaaaaaaaaaaaaaaaaaaaaaaaaaaaaaaaaaaaaaaattnttttttg

SEQ ID NO: 22497 - DNA, 153 bp, Homo sapiens
  misc_feature 4, 8, 15, 17, 18, 19, 21, 22, 25, 27, 28, 30, 52, 59, 60,61, 66, 67, 68, 71, 72, 74, 75, 76, 78, 80, 84, 85, 94,95, 96, 98, 99, 100, 108, 109, 126, 139: n = A,T,C or G
aaanaaanaaaaaanannncnngangnnanaaaaaaaaaaaaaaaaaaaganaaataannnaattnnntannannnantnaatnnaatataatnnntnnnattatttnnttttttcttcgcccccnccccccccgctcnctttttttttttca

SEQ ID NO: 22498 - DNA, 378 bp, Homo sapiens
  misc_feature 3, 30, 31, 203, 209, 314: n = A,T,C or G
ggnagcagcctctctccctactgctgctanncaagaccctgagactgacctgcagggcgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctnagcggngatggagagctaaagtccaagagaggatccgagaacgctctaagcctgtccacgagctcaatagggaagcctgtgatgactacagactttgcgaacgctaccgcnatggtttatggatacaatgctgcctataatcgctgcttcaggaagcgccgagggaccaaatgag

SEQ ID NO: 22499 - DNA, 390 bp, Homo sapiens
  misc_feature 49, 51, 53, 162, 205, 207, 286, 308, 328, 332, 362: n = A,T,C or G
gaggtcagggaggaagggatagccagcgcttaggaagtgctggagtcgngngntttggctgcgcgtgatcctgcgtgggtcgggaggtgtttctgtgtaggtgtctggccctttcatcagtcgtgcggaggaccgcgtgatttccttccagttctcctcggntttcaggaaaagcctaaagattagactgtaagaaaagaaaatngnagccatgtttcgaagacctgtattacaggtacttcgtcagtttgtaagacatgagtcccgaaacaactaccagtttggntcttgaaagatccctgaatcgngtgcacttacttgggcgagngggncaaggaccccttgtcttgagacaggggggnaggaaaaaaatccagtcacaaatatttt

SEQ ID NO: 22500 - DNA, 370 bp, Homo sapiens
  misc_feature 28, 203, 209, 279, 348: n = A,T,C or G
ataactggttccttctagctgtgtcctnacatggtagaggggatgaggagtctcccttaggcctctactataagggcatttaggtctcttctacaagggatcacccattcatgagggctccgccctcatgatctaattacttcccaaaggccccacttcttaatacaatcaccttggaagttagaattccaacatatgaattngggggnccacaaacattcagaccatagcacagtatattaccctaacactaaaacctgctaatgacattttaagaanggaaaaaacatacaagcagcatgatttcatttacataaaatttttaaaaatgcaaactaacctataggngacaaaaagcagaacaatggga

SEQ ID NO: 22501 - DNA, 363 bp, Homo sapiens
  misc_feature 15, 62, 203, 205, 207: n = A,T,C or G
gttagcccatttttntgctgctgataaaagctacctgagactgggcactttacaaaagaggnttatgatggacttacagttccatatggctggggaagcctcacaatcatggcagaaagcaaggaggagcaagttgatttacttagatagcaccaggcaaagagagagcttgtgcagggagactccagtttttaaaaccaacngntntcatgggacttattcactatcacgagaacagcatgggaaaaacctgccctcatgattcaattacttcccaccaggtccctcccacaacacatgggaactcaagatgagatttgggtggggacacagtcaaaccatatcaacaggtatcccggaact

SEQ ID NO: 22502 - DNA, 315 bp, Homo sapiens
  misc_feature 55, 173: n = A,T,C or G
ataggtttggtcctagcctttctattagctcttagtaagattacacatgcgagcntccccgttccagtgagttcaccctctaaatcaccacgatcaaaagggacaagcatcaagcacgcagcaatgcagctcaaaacgcttagcctagccacacccccacgggaaacagcagngattaacctttagcaataaacgaaagtttaactaagctatactaaccccagggttggtcaatttcgtgccagccaccgcggtcacacgattaacccaagtcaatagaagccggcgtaaagagtgttttagatcacccccctc

SEQ ID NO: 22503 - DNA, 383 bp, Homo sapiens
  misc_feature 7, 30, 208, 209, 210, 211, 261: n = A,T,C or G
ataaccntgatgtgcctagtagaacagctntagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatggnnnnaaacttgacaatcattacactaaaacagatttgataatcttattcacagntgttattggttacagaccatttaattaatatttcctctggttattcctcctctccctcccattgcatgggtcacacctgtaaaagaaaaaagaatcaaattgaatatatcttttaagaattc

SEQ ID NO: 22504 - DNA, 119 bp, Homo sapiens
  misc_feature 2, 4, 39, 44, 51, 52, 55, 77, 94: n = A,T,C or G
gncnaaaaaaaaaaaaaaaaaaaaaaaataattaataanaaaanaaataannaanaaaaaaaaaaaaaaaacaaaanaaaaaaaaaaaaaaaanaaaaaaaaaaaaaaaaaaaaaaaaa

SEQ ID NO: 22505 - DNA, 125 bp, Homo sapiens
  misc_feature 1, 3, 36, 38, 39, 40, 42, 43, 44, 83, 85, 86, 110, 111, 120: n = A,T,C or G
ncnaaaaaaaaaaaaaaaaaaaaaaaaaaaaaaaanannntnnnaaaaaaaaaaaaaaaaaaaaaaaaaaaaaaaaaaaaaanannaaaaaaaaaaaaaaaaaaaaaaanntttttttcnggccc

SEQ ID NO: 22506 - DNA, 295 bp, Homo sapiens
  misc_feature 3, 32, 39, 57, 59, 61, 124, 145, 148, 186, 205, 213, 235,250: n = A,T,C or G
ctntccaatttgaacttatttgatttattttncccgagntattataatatgcggggncntntaatcaatcttctattattcaatcatctatccatttattaattcaacaaatatttattaaagngcctaccatgattatgtgctngtncgaaaagacaaggacatttactaggggggattgtgggnccaatcggcatcataagcntggggggnagcaaaagacaataatcacatncaacgggcaccaagntcagctcaactttagaattcagcagggaacagtacagatgggcct

SEQ ID NO: 22507 - DNA, 203 bp, Homo sapiens
  misc_feature 6, 16, 58, 116: n = A,T,C or G
gattancattttcagnaagacggattatctagtagaatgatcatatatatgcgtacgnaaaaatggaccacagtgacttatttgtagttgttagttgccctgctacctagtttgtnagtgcatttgagcacacattttaattttcctctaattaaaatgtgcagtattttcagtgtcaaatatatttaactatttagagaatg

SEQ ID NO: 22508 - DNA, 335 bp, Homo sapiens
  misc_feature 1, 106, 205, 206, 209, 210, 263, 331: n = A,T,C or G
naaatacattttgattattctcattgtagttaagttactgttagtttggggcaatacattctttccttcctcatccttttaaaattaaatatataagatgtatgtnttgttttattacattaagtgctatttttaaaaaattcattgtgtgtatatgaactaatacttgatttgtttctgtatagcatgattaaagataattgannatnntgcacttattttaggcccttggaaatttgtattctaatactttttaagaatgnccatttattttgtacataataaattagctttgtatatgaaaatggggttgaatcaaataaaaaaaagnggcg

SEQ ID NO: 22509 - DNA, 371 bp, Homo sapiens
  misc_feature 53, 57, 62, 97, 204, 206, 212, 341, 359: n = A,T,C or G
gaagcccgaggcgcgggtggggaacatgtttgagtcggactcggcaggggagngggnccggngtctggcggatgcggtcgtgaagataggtactggntttggattaggaattgttttctcacttaccttctttaaaagaagaatgtggccattagccttcggttctggcatgggattaggaatggcttattccaactgtcagcngnggggtnccaggctccatatcctctacatggaaaatatgtcaaagagcaggagcagtgacttcacctgagaacatcccagcgggaggacaagagaaatcatgtttattcctcaggaatactgaagtgccctggagnaagctgccattcttctgnaacaatgttatc

SEQ ID NO: 22510 - DNA, 230 bp, Homo sapiens
  misc_feature 4, 5, 47, 209, 225, 226: n = A,T,C or G
aacnnagtggttaaacacatacccatctaaatttttttatagccttncatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggncatgaagaacgtagcnnaaaa

SEQ ID NO: 22511 - DNA, 388 bp, Homo sapiens
  misc_feature 202, 204, 208: n = A,T,C or G
attcctaatggagtgtgtgtatacttgttgagtgttcataagtgtatgtttaaatactcccaaattacatcttttttagtagcagtaactttgcctatattcatcttacttattatcataataaaccagatttagactcattagttacatttcattttgcatttaaattttaatttctcatttatctaatttatttaaagcncngggnctcagactttagcacacaccagaatcacctacagagcttgtgtcaaacagatggctgggcaagaaattcctaggcaatgttgatgctggtgatttgggaactacacattgcaaatatctgctttaaaattttggtattttttggcttaacctggtgcccaaagccaataagataataact

SEQ ID NO: 22512 - DNA, 389 bp, Homo sapiens
  misc_feature 30, 50, 100, 103, 204, 207, 210, 296: n = A,T,C or G
atggccacgacatgaaggacacagccagtntgaagtcctctagtagtctngaacccaatcttttttgtgatgaagagattcccatcaaatccgaggaggnggngacccacatgtggacagcaccttcattttgtgcagagcttgcttattcttctgcttctaagagttgttctcaaggttctagcaccccaaggaaacaacctnggnggngcccctttggtgccctgaagtttggaacctccagtgctggagttgtcacctggagctaaggcacaactggaagaacttatgatggntggagatctcctggaagtatctctggacgagactcaacacatatggcgggattttgcagggccacacacccaccctctgaagacagattcttg

SEQ ID NO: 22513 - DNA, 154 bp, Homo sapiens
  misc_feature 1, 50, 101, 117, 128, 145, 152: n = A,T,C or G
nggcaaaaagggagccaagaagaaagtgggtgatccattttctaagaaanattgggatgatgtgaaagcacctgctatgttcaatataagaaatattgggnaagacgctcgtcaccnggacccaaggnaccaaaattgcatctgnggggggnaa

SEQ ID NO: 22514 - DNA, 375 bp, Homo sapiens
  misc_feature 120, 207: n = A,T,C or G
caagtctttgctattgtgaataatgccacaataaacatacgtgtgcatgtgtctttatagcagcatgatttatagtcctttgggtatatacccagtaatgggatggctgggtcaaatggngtttccagttctagatccctgaggaatcgccacactgacttccacaatggttgaactagtttacagtcccaccagcagtgtgaaagngttcctatttctccacatcctctccagcacctgttggttcctgactttttaatgattgccattctaactggataaaatactggcaaaacgaatccagcagcacatcaaaaagcttatccaccatgatcaagtgggcttcatccctgggatgcaaggctggttcaatat

SEQ ID NO: 22515 - DNA, 354 bp, Homo sapiens
  misc_feature 5, 30, 110, 156, 262, 263, 270, 309, 318, 332, 340, 352: n = A,T,C or G
cgacnagcaccgcgtccggcagcgccagtncctacactcgcccgcgccatgggctctgtctccgagctcgcctgcatctactcggccctcattctgcacgacgatgaggngacagtcacggaggataagatcaatgccctcattaaagcagccggngtaaatgttgagcctttttggcctggctttgtttgcaaaggccctggggcggggggaacattgggagcctcatctgcaatgtaggggccgggggacctgctccagnngctgggngctgcaccagcaggaggtcctgcccccttccactgctgngtggtccanctgaggagaaaaanggggggancaaagaaaaaanaa

SEQ ID NO: 22516 - DNA, 389 bp, Homo sapiens
  misc_feature 2, 13, 29, 33, 210, 211, 212, 267, 333, 350: n = A,T,C or G
gngacctacaagnattggagagaagtggntttngtcagggagaaaatggccagatgatgagctgcacatgtcttgggaacggaaaaggagaattcaagtgtgaccctcatgaggcaaccgtgttacgatgatgggaagacataccacgtaggagaacagtggcagaaggaatatctcggtgccatttgctcctgcacatgctttggaggnnngcggggctggcgctgtgacaactgccgcagacctgggggtgaacccagtcccganggcactactggccagtcctacaaccagtattctcagagataccatcaggagaacaaacactaatgntaattgcccaattgagngcttcatgccctttagatgtacagggctgacaagagaag

SEQ ID NO: 22517 - DNA, 318 bp, Homo sapiens
  misc_feature 4, 16, 25, 26, 34, 45, 67, 90, 103, 104, 140, 144, 146, 184,190, 218, 251, 269, 295, 306, 307: n = A,T,C or G
agangatttcctttgnacttgcggnngtcgagtnaagctgaaagnaccacttttgcacaggtcgggncatgtcaagaagggggcattttnccttttgacaagnngactgggcttttcaccagaggtttgggttgggttcngggngngcttcagaaagaaggactccgggaatgccctacacccnggaaantcatattataggatgggagggaaagggnccagggttcacacttagaaaggcccaaactttncgggaaacatctgatgangaaaaagaagtatttttgagactgcngccctattaannaaaggtaacat

SEQ ID NO: 22518 - DNA, 179 bp, Homo sapiens
  misc_feature 23, 34, 147, 163, 178: n = A,T,C or G
caatcataaagctatatcgaggnggggagcttancccactatgcacattgtaattattcattgtggctgtccagttctatgatgcattctggcattttgtaagctgctctgactagcaatatatagattcatttaatgtgttaacanttggttaataaatgtntttcaaaaagggggng

SEQ ID NO: 22519 - DNA, 218 bp, Homo sapiens
  misc_feature 3, 39, 51, 141, 183, 197, 200: n = A,T,C or G
atngaaggtgactcatttttctgcacacttttttgatgngatgcttgacgngaggcccgacactaggattctcaatgcaagaatccagtaccttgcacatagaagtagcaacccgtcccttgcctattttcatcttgctgntttcttttttttaaaaaaatggatgtgacttgttttgaatgntttgtattatactnggngggggggggggcataaat

SEQ ID NO: 22520 - DNA, 400 bp, Homo sapiens
  misc_feature 6, 12, 42, 47, 48, 62, 66, 68, 77, 87, 98, 112, 133, 219,220, 222, 251, 310, 348, 384: n = A,T,C or G
ttatgntcgggngaggacatatgaaatggcaaattgaggttntgtgnngtggaacagtaggngttnantgcaaagtngcgaccttgnaatggaaaggnctgaaaaaaaatcntcagaacagaagagacaaggnagctgtgtcttagaaaaagaatgtctccttcaaaaacacatctctatggatttgtacctcatttaggtttgggaattgaatttggnnanttgtgtagtatggaaaaatcacaacttgnaaaattaactacagagagcccagattactgatacttctaaagcacctggcagaatctgntacaaacttcttaggagaaagataccattcaaccaagnttcacaagattcctaaacataaatatcttctaaagnttaactcacaacctca

SEQ ID NO: 22521 - DNA, 268 bp, Homo sapiens
  misc_feature 51, 54, 219, 237: n = A,T,C or G
tgtatggcccgggcattcaagctctacaattatcttcttttgtgacacagnagnacagacaagaatagagattatcaatgttatataaaaggatgttacttaccaaacaagtttctgaggtttttgttttttgttttctgttttgtttctttttaggtaccaccttcccagactttcttgttactgtaacgtttatttcttcaaacagatcataaagcnagcggatattatccaggngtgcaaaagtgattaaccatgtgattttcag

SEQ ID NO: 22522 - DNA, 372 bp, Homo sapiens
  misc_feature 171, 178, 229, 275, 307, 349, 351, 361: n = A,T,C or G
gcccggcgaagccacagaaaaccgcccctgctacagagcaggagttgccgcagcccccaggctgagacagggtctggaacagaatctgacagtgatgaatcagtaccagagcttgaagaacaggattccacccaggcaaccacacaacaagcccagctggcggcagcagcntgaaatnggggaagaaccagtcagtaaagcaaaacagagtcggagtgaaaagaaggcncggaaggctatgtccaaactgggtcttcgggggttacaggagttantagagtcctatccggaaatctaagaattcctntttggcatcacaaaaccagatgtctacaagagcccctgcttnanatacttacanagttttttggg

SEQ ID NO: 22523 - DNA, 383 bp, Homo sapiens
  misc_feature 1, 4, 27, 53, 54, 203, 204, 205, 262, 363: n = A,T,C or G
nagnccttgtgttagttgtatctgaanttgttatgtatctctctaccttctgnnaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagnnngacttttatgaacaactattttgagaacatgcacagtagtatgtttttattactggnttaatggagtaatggtacttttattctttcttgatagaaacctgcttacatttaaccaagcttctattatgcctttttctaacacagactttcttcactgnctttcatttaaaaagaaatt

SEQ ID NO: 22524 - DNA, 364 bp, Homo sapiens
  misc_feature 27, 28, 29, 50, 52, 91, 204, 205, 265: n = A,T,C or G
caaccgaaaagttgttaagactggtcnnnaatttctccacagtatccagngncagaagacagtggagcaatatatacatatttcttaaggngataatatgggtaattaaagttaaatataaatccattctctccttcaaatataaaagctacagtaaaagcatttctgtggggttattgtttctataaatttctcagggaaacnnccatcggctaaatgcaaggcaaccaagagttaattgaagaaactgtcaaagaacttatgngagcatttattatatttaaatctagaaaaagactaaaacaaaagtgtaaccttagggtgacagatgggattgtaaatattatagcttctgacaatgcag

SEQ ID NO: 22525 - DNA, 362 bp, Homo sapiens
  misc_feature 120, 178, 203, 208, 260, 278: n = A,T,C or G
ggggcattcctgagctgacagcattcgggccgagatgtctcgctccgtggccttagctgtgctcgcgctactctctctttctggcctggaggctatccagcgtactccaaagattcaggnttactcacgtcatccagcagagaatggaaagtcaaaatttcctgaattgctatgtgtnttgggtttcatccatccgacattgnagggngacttactgaagaatggagagagaattgaaaaagtggagcattcagacttgnctttcagcaaggactggnctttctatctcttggactacactgaattcacccccactgaaaaagatgagtatgcctgccgtgtgaaccatgtgactttgtcac

SEQ ID NO: 22526 - DNA, 208 bp, Homo sapiens
  misc_feature 32, 186, 188, 197: n = A,T,C or G
tttcacatgttttatggaattgttcacctggnttgaaataataaaatgtggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaggggnanttttttttnggggggggccg

SEQ ID NO: 22527 - DNA, 329 bp, Homo sapiens
  misc_feature 27, 60, 106, 206, 209, 321, 322: n = A,T,C or G
gagctgctttatcatttttttttctcnttttaaaaatgaaaacagactgggcacgggggntataatctcagcactttgggaggccaagccaggcggatcacaaggncatggagtttaagaccagctgggccaatatggggaaaccctgtctgtactaaaaatacaaaaatcagctaggcgtggggggcaccctgtattcccagctnctnggaaggctgagacgggagaatcgcttgaacctgggaggcggaggttgcagtgagccgagagcacgccgctgcactccagcctgggcaacaaagcgagactccatctccaggnnaaaaaaa

SEQ ID NO: 22528 - DNA, 377 bp, Homo sapiens
  misc_feature 23, 25, 51, 201, 294, 299, 360: n = A,T,C or G
gacccttcgtttttcctttagtngnttgacgttggtgttgaggttggcatncgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgnggaaagaaagaaggcatacgcagatttctacagaaactatgatgtcatgaaagattttgaggagatgaggaaggctggtatctttcagagtgnaaagnaatcttggaatataaagaatttcttcaggttgaattacctagaagtttgtcactgacttgngttcctgaactatgaca

SEQ ID NO: 22529 - DNA, 383 bp, Homo sapiens
  misc_feature 4, 267, 368: n = A,T,C or G
tgancgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgnttatattttagatactgaaaggtgctatgcttctgttattattccaagactggagataggcagggctaaaaaggtattattatttttcctttaatgatggngctaaaattcttcct

SEQ ID NO: 22530 - DNA, 151 bp, Homo sapiens
  misc_feature 4, 27: n = A,T,C or G
taanccttgtgattaggatgactgttncaggcttagctttgtgtgaaaaccagtcacctttctcctaggtaatgagtagtgctgttcatattactttagttctatagcatacttgcatctttaacatgctatcatagtacatttagaatga

SEQ ID NO: 22531 - DNA, 372 bp, Homo sapiens
  misc_feature 15, 17, 27, 61, 72, 73, 129, 222, 224, 227: n = A,T,C or G
ttatggtccggggancncttccggcgnttgacgacctacgcttacgagtaacatgcctctngcagagggatnngcttcatccctctccagaaagtaggagaagaggaaacacaagaagaaacgcctggngcaagagccccaattcctacttcatggatgtgaaatgcccaggatgctataaaatcaccacggtctttagccatgcacaaacggtagttttgngnggnggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaagg

SEQ ID NO: 22532 - DNA, 172 bp, Homo sapiens
  misc_feature 2, 26, 27, 28, 29, 30, 65, 150: n = A,T,C or G
gnacccctgaagctgacagcattcgnnnnnaggatgtctcgctgccgtggggttagctgtgctcncgcttcatctctttctggcctggaggctatccagcgctctccaaagattcaggtttactcacgtcatccagcagcagaatggaangtcaaatttcctgaattgctat

SEQ ID NO: 22533 - DNA, 330 bp, Homo sapiens
  misc_feature 174, 234: n = A,T,C or G
tctaggatttctcacactttatgttcaacagagctatataaatatgctcctatgtattcccttaaagcccatcttctttctactatatctttttcctcattttacttccttttttgagggagttatgtgggatagaagaaaaatggacttcttcatttataacatacctgaagntgggagtattttaatccttaaacagattaaaatgagctgggtgtggtggctcacacctgnaaccccagcactctaggaggctgagggaggcgtatggcttgagctcagtagttggaaaccagactgggcaacatgacaaaatcctgtttctacgaa

SEQ ID NO: 22534 - DNA, 247 bp, Homo sapiens
  misc_feature 5, 156, 165: n = A,T,C or G
ggcgncaaacctaccgagcctggtgatagctggttgtccaagatagaatcttagttcaactttaaatttgcccacagaaccctctaaatccccttgtaaatttaactgttagtccaaagaggaacagctctttgaacactaggaaaaaaccttgtngagagagtnaaaaatttaacacccatagtaggcctaaaagcagccaccaattaagaaagcgttcaagctcaacacccactacctaaaaaat

SEQ ID NO: 22535 - DNA, 355 bp, Homo sapiens
  misc_feature 17, 57: n = A,T,C or G
gaaatgataacaaaggntttagaataatacataaacttagtaaagcaatggcagggnttgagaggattgacttcaactttgaatgttctagtggccaggcgcatagctcatgcctgtaaatccagcactttgggaggccaaggtgggaggattgcttgagcacaggaatttgagatgtgcctgggcaatacagcgagatcctgtctctacaaaaataaaaataattagccaggtgtggtggtgcactataatcccagctacttgggaggctgaggtggaaggattgcttaagtccaggagttcaaggctacagtgagctatgatcacacctgggtgacaggccaagaccctgtct

SEQ ID NO: 22536 - DNA, 201 bp, Homo sapiens
  misc_feature 17, 42, 44, 57, 65, 67, 69, 75, 77, 79, 86, 88, 89, 99, 128: n = A,T,C or G
tgtatggtccggcaatnccgatattagtataatgagggaaantnccaggaagtaggntttttttngntnctaagntngntttatgngnngagacaaggngctgtttagctttgggtctaataattttngggttgaaaaagaatgagttgcaacttgcctagagatgaattttaggaggactctgaggaaaccagattggca

SEQ ID NO: 22537 - DNA, 170 bp, Homo sapiens
  misc_feature 17, 21, 28, 35, 40, 41, 51, 57, 60, 64, 69, 74, 87, 90, 93,98, 100, 108, 130: n = A,T,C or G
atttttggtctccagantccnttatttnattatgntcggnnagagaggagntaagcntgngctntagtntttgngggtaggcctggnttnccngaggngnggggggangggaaccactcctttgtggagntcgccaggttcatttgtttgtggatttgcacagtcggctg

SEQ ID NO: 22538 - DNA, 364 bp, Homo sapiens
  misc_feature 9, 31, 204, 209, 210: n = A,T,C or G
aagttccgntgaaatactgtgatcaaaacanaaaattgcctatttattgcggtcaaagggacattttgtagtctaacctgattttcgaaattgattattgataatttaagatatttttcatagttatatgagttacctttagtaatgatagacaataaataaagaactaagaagttgtcatgaaagtcatagccagagcaggtngggtnngagaaagaaataaagggcatccaaactagaatggagaagtcaaattgttctctatgcagatgacatgatgttatatatataaaaacaaaactaaagactctaccaaaaaactcatagaactgataaatttagaaaagttagaagatacaaaatt

SEQ ID NO: 22539 - DNA, 400 bp, Homo sapiens
  misc_feature 16, 49, 53: n = A,T,C or G
acttcttttgtactcncagaggtccccttctttttattatggtcgcggnctancccatcagggctaaagtttggagttttaatgccctcactaggacttgacactaggatttggacccacagaacggaaattgcagctgaactccctgaagcagggacactagaaatgctttcagacagtgaaatgggggctaagaaaattcttcctgcaagcctacagaggcagctatgaaaatttttctcttaggggctctggggggggaaaagttactaccttgtgtaggaccgaatccccaaacctgtgtgccacgtgggaatgggatacatttttattctccccttatgtgctggcattcttcaacaagtcaaggaaatgatattcccataggaaaaataataca

SEQ ID NO: 22540 - DNA, 100 bp, Homo sapiens
  misc_feature 7, 17, 44, 56, 77, 86, 97, 98: n = A,T,C or G
aaatctnacactggggnctattgaaaaggggcaacacatagctngttctttcaagnaatggaaagttctcacctcanaataatagnatcttcaaagnnga

SEQ ID NO: 22541 - DNA, 400 bp, Homo sapiens
  misc_feature 8, 10, 30, 31, 36, 51, 58, 59, 84, 85, 86, 89, 90, 91, 93,121, 133, 237, 239, 240, 242, 344: n = A,T,C or G
ccggagancntcgtttctttatggcggggnngcccntcaatcttacaaagnaccatcnnactcaagccccaggatgaggagggnnnatnnntngggccagccaagaaaggtaactacccanctgattttaggngcttttccccttttaacatttaaaatttattccagctgaaaatgtgatgtgtaaatacacatggaaagaactttggataaaatatatctgtaattatttatacngnngngctttattttgcaaaacatctgtttatttaaatagctaatatatgcaccagtaaaaacaatgtgaaagttacagaaggacatacagaggttataagtattgnttgatgtccttctaattctaattctcccctaacccctgctgaggcaaaaactggta

SEQ ID NO: 22542 - DNA, 387 bp, Homo sapiens
  misc_feature 3, 27, 52, 168, 206, 261, 308, 376: n = A,T,C or G
ggncatccacataaaaaagttggatcntgctgggaacagtggtttatgccantaatcccagcgctttgggaggccaagtgagaggattgcttgaggcaaggagttcaagaccagtctaggcactataggaagacctcatctcttaaaagaaaaaaaaattggccaggngcggggggtcacacctgtaatcccaacactttgggagncccaggagggcagatcatgaggtcaggagatcgagaccatcctggctaacatggngaaaccccgtctctactaaaaaatacaaaaaattagccgggcatggnggcaggcgccttgtagtcccagctactcgggaggctgaggcgggagaatggcatgaacctaggaggcngagcttacata

SEQ ID NO: 22543 - DNA, 375 bp, Homo sapiens
  misc_feature 5, 27, 371, 372, 373, 374: n = A,T,C or G
gagcnaggaggagttgagagaacggancggacgccatggcgaccaacatcgagcagatttttaggtctttcgtggtcagtaaattccgggaaattcaacaggagctttccagtggaaggaatgaaggccagctgaatggtgaagcaaatacacccattgaaggaaaccaggcgggtgatgcagcttgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcatannnng

SEQ ID NO: 22544 - DNA, 346 bp, Homo sapiens
  misc_feature 161, 210: n = A,T,C or G
atactatatattatatataaaaaaaaattttttttgagacggagtcttgctctgtccccaggctggagtacagtggcacgatcttggctcgctgcaacctccacccactaggctcaagtgattctcctgcctcagcctcctgagtagctgggactacaggngcgtgccaccatgctcggctgatttttatatttttagtagagacggggngtcaccatgttggtcaggatgatctcgatctcttgacctcatgatctgcccgcctcagcctcccaaagtgctgggattacagacatgagccactgcacttggccttctaaagttttttaataaacattcccttctg

SEQ ID NO: 22545 - DNA, 371 bp, Homo sapiens
  misc_feature 4, 28, 120, 360: n = A,T,C or G
gtancattggtgaaaaggtagacatggnaaaaactgcaattacttttgcaccaacctaatagatgaatgaagcagaacagagattccagaaatagacccatagaaatatgcccagttggncttttttattttttttttaaattgagacagggtctcactctgtctcccaggttggagtgcagcagcatgattgtagctcattgcggccttgaactcctgggctcaagaagtcctcctgcttcagactctcaaagtgctgagattgcaggtgtgagccactgtacctggccctccaattgatttttgacaaaggtgcaaaagctattcaaagagcaaaggatagtctttccaacaaatggnattggaacaac

SEQ ID NO: 22546 - DNA, 366 bp, Homo sapiens
  misc_feature 7, 10, 14, 21, 207, 294, 361: n = A,T,C or G
atccagnagncagnaacaagntaatcctaaaaatgtgtgtgcattaaataacaatgcctcagaatatataaatcaaaaattaacactgaaaggagaagtcgaaaacccacaattatatatagatgtttcaatgctcctctctcagtaactgatataacaagttgatagaaaaatgtagatgacatgaataacactgtcaacaacgtnggcttaattgacagttacagaacgcttcatctgcgtagctgaatacacattcttcttaagtgcacatgcaacatttacctcaaatgngttacacaaaaataagtctcagtaattttagagggaattgaacattaaaaagttacctgaccgcggngaagt

SEQ ID NO: 22547 - DNA, 388 bp, Homo sapiens
  misc_feature 3, 16, 26, 28, 29, 52, 55, 203, 207: n = A,T,C or G
ggncctggaggcgganaagaaggcgntnntggcgggtggaggttcgagcgcnggnctcgctccggagccgctgcacatttcggaatcttctgcggcttgtccatagtgtgaataaaaactaaatcacatctataattctactgaactggtcacacagacgctgccatatatgtcacagtacactgaaaaggagccagcagcantggnccaagaatctggtaaggctgtctggcccaaaccagcaggagggtatcagacaattacaggcaggagatatggaagaagacatgcttatgtcagttttaaaccatgtatgaccagacatgaaagaagcttaggtcgggctggtgatgactatgaagtgttggaactagatgatgttccaaag

SEQ ID NO: 22548 - DNA, 157 bp, Homo sapiens
  misc_feature 7, 24, 117: n = A,T,C or G
ttatggnccggggttcaaactagnataggacaggttatcaacgaaacttctcagcatcacgatgaccttgaataaaaattgcacacactcagtgcggcggtatattaccagcgggantaaaaaagaaatccatatcttaaagaaacagctttcaagt

SEQ ID NO: 22549 - DNA, 372 bp, Homo sapiens
ataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccatt

SEQ ID NO: 22550 - DNA, 370 bp, Homo sapiens
  misc_feature 348: n = A,T,C or G
gatagaactagacagaaaaccgcaaggatataggtgaactcaacaccactaactgacaaaatctagttgacacttacagaacactctacctaataagaatacacattcttttaaagtgcttatggaaaatatatatcaagatagagtatatcctgagccataaaaatctgaaaaatttgaaaaatttttttaaattgaaattagcctgggagcagtggctcacgcctgtaatcccagcactttgggaggccaagacagacggatcacatgaggtcaggaatttgagaccagcctggtcagcctggccaaaccccatctctactaaatatacaaaaattagccaggtgntgggggggtgggcaccttgtag

SEQ ID NO: 22551 - DNA, 388 bp, Homo sapiens
  misc_feature 204: n = A,T,C or G
attttatattcactctcagtagttgtaaacacattcttaaagtagcattttcagttatgaataagcaaggatgaaataagtattagggtaagggaaatggttgaggctttcctaagtgaagtgtaaaaaccacagctttctttttaatgggatgtctaatatgcatttatctgttcaagcatgttaagatttccatgaaaatgncctgaaaaatcaagattcttcattgagggtgaggatctcccaatgggagactgctctgaaaagagcatgtgctttttgaattagataacctactataatcatgggatgttcttgaatacttagcaaacataccagcatcccaaagtcaccaagataaaccctcctactccaacatcacatgatc

SEQ ID NO: 22552 - DNA, 293 bp, Homo sapiens
  misc_feature 202, 203: n = A,T,C or G
atagctggttaaccttgagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattnncctcattttgaattatgtgcactaccatagctacatcagtttgatacagtattgaaaaattatcagttatattttgctggttatgatcta

SEQ ID NO: 22553 - DNA, 155 bp, Homo sapiens
  misc_feature 57, 72, 76, 77, 81, 82, 95, 96, 97, 116: n = A,T,C or G
aaaaaataaaaaatgtatagttaatggagggaaaaaattgaaaatgcgctgaaaccngaagatgttcagggnttcnnaggnngttgatgcctcgnnntactactggtttttgtccnttggttttgtgtcctcgttcttttcttgcttatccattt

SEQ ID NO: 22554 - DNA, 218 bp, Homo sapiens
  misc_feature 209, 210, 211: n = A,T,C or G
gaaggcattgaggcagcccagcgcaggggcttctgctgagggggcaggcggagcttgaggaaaccgcagataagtttttttctctttgaaaggtagagattaatacaactacttaaaaaatatagtcaataggttactaagatattgcttagcgttaagtttttaacgtaattttaatagcttaagattttaagagaaaatatgggggnnntagaaga

SEQ ID NO: 22555 - DNA, 311 bp, Homo sapiens
tcttatggccgaggacttgaggctgggtacagtggctcacacctatattctcagcgctttgggaggccaaggcgggcggatcacctgaggtcaggagtttgagaccggcctggccggcatggtgaaaccctgtctctgctaaaaatacaggagttggccgggtgtggtggccgggcgcctgtggtcccggctactcgggaggctgaggcaaggagagttgcttgagcccgggggacagaggttgcagtgagtcaaggtcacaccattgcattccagcctgggggacaagagtgaaactccatctcaaaaaa

SEQ ID NO: 22556 - DNA, 235 bp, Homo sapiens
  misc_feature 5, 20, 96, 166, 196, 222, 223, 226: n = A,T,C or G
atggnccgggtgactcgagnaatctaatagcattattattacaccaggctatggtctctgtgcagccaaagctcaataccccattgctgatttggnaaagatgttcactgagcaaggcaaaaaagtcaggtttggaattcacccagttgcaggccgaatgcctggncagcttaatgtgctgctggctgaggctggngtgccatatgacattggggggggggnnggntgagatcaa

SEQ ID NO: 22557 - DNA, 368 bp, Homo sapiens
  misc_feature 2, 33: n = A,T,C or G
gnattcctgaatctgacagcattcgggccgagnatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaaga

SEQ ID NO: 22558 - DNA, 157 bp, Homo sapiens
  misc_feature 149: n = A,T,C or G
gtgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtanaaaaaaaa

SEQ ID NO: 22559 - DNA, 388 bp, Homo sapiens
  misc_feature 205: n = A,T,C or G
taacaattacaaatatatatgcatgcaacatcagaatacctaaatatataaaacagatattaaaggatcagtggagagataaattgcaacataataatagcaggggacgtcaatataccactttatttttttttgtttccagtggggttggagaatacccccactttaaacaatggacagattatacagacagaaaaattaagtncagactagaaaaacagtacaaaagatcaatgaaactaagaattggttttttaaaaagataaacaaaatctacaaacccttatctagactaagaaaaagagaggggaagactcaaataaataaaaatcagaaatgaaagaggagaccgtacaactgctaacacagaagtacaaagtaacataag

SEQ ID NO: 22560 - DNA, 375 bp, Homo sapiens
  misc_feature 302: n = A,T,C or G
ggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacaggagaagattcccgagagtaaatcatctttccaatccagaggaacaagcatgtctctctgccaagatccatctaaactggagngatgttaagcagacccagcttagagttcttctttctttcttaagccctttgctctggaaggaagttctccagc

SEQ ID NO: 22561 - DNA, 384 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtga

SEQ ID NO: 22562 - DNA, 366 bp, Homo sapiens
gattggaggtgcttattttctgcatttcgtgtggaagctcaacttcgagaactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcacttcatgaacaggaaaccaaacttgaatggatcatttttcatgaggtattttggttaccaccaaagtctacgcaagaattgtatgcccaatccgttatgaatggggtaagaagacttgttacccaagtt

SEQ ID NO: 22563 - DNA, 389 bp, Homo sapiens
  misc_feature 8, 12, 208, 212, 213: n = A,T,C or G
gggaaggnaagnacgcggtcgtaagggctgaggatttttggtccgcacgcctcctgcttcctgactcaccgctgtccgctctcgccgagggaacaagtcggtcaggaagcccgcgcgcaacagccatggcttttaaggataccggaaaaacacccgtggagccggaggtggcaattcaccgaattcgaatcaccctaacaagccgcancggnnaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgtgaattcacaagcgactc

SEQ ID NO: 22564 - DNA, 182 bp, Homo sapiens
ggtgtaacggtggatgagaccgaatggagcagctggtgtggggcaaggggcacgtacacaagcacgagaattgactcagggtaagtgcgttacagagaggaactctaggcaggagttgctgcagctgggccagagggagggccccagggacaaggtctgcatggaggaagggaaggtgacca

SEQ ID NO: 22565 - DNA, 208 bp, Homo sapiens
  misc_feature 33: n = A,T,C or G
gaatcttagttcaactttaaatttgcccacagnaaccctctaaatccccttgtaaatttaactgttagtccaaagaggaacagctctttggacactaggaaaaaaccttgtagagagagtaaaaaaatttaacacccatagtaggcctaaaagcagccaccaattaagaaagcgttcaagctcaacacccactacctaaaaaaaaaaa

SEQ ID NO: 22566 - DNA, 369 bp, Homo sapiens
  misc_feature 2: n = A,T,C or G
anacaccaaacctggtaattaccctaaacttttttgaatattccaaaagtggggttgaaaacaagttctttgcaattatttggagcaagaatttctgatttatattttgacatttgttacatttttccatgaaaagtgtaagcatgcaatgaaatgatctaatcataaatagccactgtgatatcacagcattgctctgagcaatgttcatgatcatcacagagaaaacacagaaatgtaatgatatgaatgattgcgaactcccttgtctactactgcaaaatagtttccaataccagtgttgacctggaattctaatctcatgaacaatagcctttcagctggaaaggggagaaagtgtttctatct

SEQ ID NO: 22567 - DNA, 370 bp, Homo sapiens
  misc_feature 7, 265, 320, 368: n = A,T,C or G
catcggngtagccggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgncatgcttcatcattccctctcatctcaggtagaagggtgacacagttgtaagggntacagagacctatgtaagaattcagaagacccctgactcatcatttgngg

SEQ ID NO: 22568 - DNA, 371 bp, Homo sapiens
tgagcagcaggtgttcaagaaaggcttgctgaattgaattgagttaggtgacaaagtagtcattttggaagccaaggacaccatggtgtggcctgacagtatacatgagattccccttgttctgactggaattcttagccaaagctcacccctgtttctctggccgaaccttctcaccacgaaaagtgcagttcctgaggcctgttacatgggcaaactacagtagcaatctggcatttaccatctctgttttcccagcaatgaaatgaaaatagccccagctcctcttttataaaatgctgcaagattcctccttcccccactggtaggaccaaggaaactatcagggaatttgcatatgtctaaagcac

SEQ ID NO: 22569 - DNA, 313 bp, Homo sapiens
  misc_feature 175: n = A,T,C or G
ggatttgttggacaggacacagcactaatctcaaaagaaaaatttgatgaataggtcttattcatagtttttgctcatcaaaagacagcattaagaaaatgaatagacaagccacagaatgagttaaaaaaacagaaattcccagcatttacaagggattaaagatgtgtatcangaatatataaagaacctctgaaggccaggtgtggtggtttacacctttaatcccagtgctctgggaggccaaggtgggaggatcatttaaagctaggagttcaagaccagcctggtaacatagtgaaacaagattctg

SEQ ID NO: 22570 - DNA, 376 bp, Homo sapiens
actgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaat

SEQ ID NO: 22571 - DNA, 388 bp, Homo sapiens
  misc_feature 2, 10: n = A,T,C or G
gnatgtcagnatcatgtaggatttgtaggcccctttgagaactttagattttattattctgcatgagattggaaaccactggagttctgaggcaaagaacatataatttggtttactttctaaagcaattgctctgagagcttaaaaaaagaataaaatttaggaaggcaaaaggggaagcaggaataataatcagggcaacttcaatcatttggaaggaaacaatggtgacttggacaaggttgtcggagtagaggtggagagaactagattaagtgtacattttgaaggctgagctagcaagatttgttgttgattatgtagagagcataagagaattggagctcaaggataatgacaatgtatatagcctgagcatctgaaatga

SEQ ID NO: 22572 - DNA, 370 bp, Homo sapiens
  misc_feature 335, 355: n = A,T,C or G
gtagtaaaacataaagactattgcaataaaaagtttccaggccagtgacttgtttaattacattcacatttttacattcactttgcctttcaaagcaggagtattttataaaactgaaataaaactttaaattgtcaagctggtgcttaaagttatgtaaaatctgatttaagtttatttcatttccaaggaaaggaccctgaaaggaggggacagggagcttcctaggtctgttgataaactaactgatgctttgtcaagtcttccaagttttcactgtaaataatacaactaacaatgtaattttgctgttttctaatagagaatgaatgaantattaatgtattacatttgntttcatgataaaaca

SEQ ID NO: 22573 - DNA, 369 bp, Homo sapiens
gtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttaccttggcaaccatattgtcacctgtacctgtcacacatcttgaaaaataaaacgataatagaactagtgactaattttcccttacagttcctgcttggtcccacccactgaagtagctcatcgtagtgcgggccgtattagaagcagtggggtaccgttagactcagatggaaaggta

SEQ ID NO: 22574 - DNA, 377 bp, Homo sapiens
ggggaaggcctgaggagacataacagagctgaatccaggttctcggtggcatgttaggttttgacgtgtgtgcatgtgtgaaaggcttcatgactatgggatatttttgtctcaatagtgatcattctaggaaggccgtgccattgtgatgggctctgggggcacagcctgctggctgacttccactccttttttcctctgtcctgtaacagagaaacactaagtatgttggtgcacacatgatccagatcgagagggaggccagtgctgtggcacagtgggtagagccaggcagcctgaggttaatacctaccttgcttgattgctgtaagttctagaaatcatgcatgtaacgtggctgacacattgtgctaaat

SEQ ID NO: 22575 - DNA, 364 bp, Homo sapiens
  misc_feature 18: n = A,T,C or G
aaatgttagcataaaagnaacttggagaggaaaaaagtattaacaaaactgcagtctgcacctctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcaccctgaggtccggagaccagcctggccaacatggtgaaaccctgtctctactagaaatacaaaaattagccaggtgtggtgggcgggcgcctgtaatcccaactactcaggaggctgaggctagagaatcacttgaacccagcaggcggaggttgcggg

SEQ ID NO: 22576 - DNA, 375 bp, Homo sapiens
  misc_feature 14: n = A,T,C or G
gagtaactggaagnaaagtaactggaaaaacacagggagaaattgttaagtggaagtgagagctcatccaaaaaaagacagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattgactaacaaaaaaacttgaagaaaggagagaagagaaaagaaaagaggaagaacagagagaaattaagaaggaaattgagaggagaaaaactggaaaagaaa

SEQ ID NO: 22577 - DNA, 151 bp, Homo sapiens
  misc_feature 110: n = A,T,C or G
caggcatggtggtgggtgcctgtagtcccagctactcatgaggctgaggcaggagaatagcgtgaacccaggaggaggagcttccagtgagctgagatcgtgccactgcnctcctgcctgggtgaaagagagagactccatcttaaagaaa

SEQ ID NO: 22578 - DNA, 376 bp, Homo sapiens
  misc_feature 225: n = A,T,C or G
gcaaattgtaatatatataatcctgaactcatgaccatgtctcggtttatttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggngtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttc

SEQ ID NO: 22579 - DNA, 365 bp, Homo sapiens
  misc_feature 307: n = A,T,C or G
tgccccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgncccaacaattatattactaccactgacatgactttcaaaaaaaaaaaaaaaaaaaaaa

SEQ ID NO: 22580 - DNA, 371 bp, Homo sapiens
gatttgaaaataaaacatagttgtaaacataaaccagtatgtctttgtaaagccaataatatatcattttataggagcattgtcttcttgtgtttttcaagttgactatgtagttcaatgtcagtctccattttaatatcttgtttgtttatcagcctgagcatatttcattttaaaatgtatttgttggagaagtcatggtggttttttgtttttcacaagtcaagtagcttgaacactatcacttgtccaatgggaaagttgatgcttatctttatggcaaatgcttggttgaataatatatttgcaaaagatgttaattctacagagagctaaataaagttaagatacctgtaaaacagtttctccag

SEQ ID NO: 22581 - DNA, 375 bp, Homo sapiens
gggcgcaatagtatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaacct

SEQ ID NO: 22582 - DNA, 376 bp, Homo sapiens
aagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatatcttgtcaagcatttatcatgatactgctgaccagaagtgactgctgtggtagctgtaatttgtcatgtaattgaagactgagaaaatgttgggtccagtcgtgcttgattggaaattgttgtttctaaatctatatgagaattgacaataagtatttttattataactcagcccatacatatatactatgtatgcagtgcatctgcatagaacagttccttatcctt

SEQ ID NO: 22583 - DNA, 148 bp, Homo sapiens
aacactgaactgacaattaacagcccaatatctacaatcaaccaacaagtcattattacccccactgtcaacccaacacaggcatgctcataaggaaaggttaaaaaaagtaaaaggaactcggcaaatcttaccccgcccgtttact

SEQ ID NO: 22584 - DNA, 372 bp, Homo sapiens
gtaggaagtttccagctttacccagtaaacaagtgaatgggaaacctaaggtattaaaatctgacctttctatccgatgacaaactcatttccagtctgtgaactcctggacaaagcaaactaaccactgaaaagctcgaaaatagggcaagacgacattaaccttgtgaaagtctgctttgaaaaaaggcattctgtcaagctgtgtatttttttcttgattattcaatttatttcgttattcaaatttaattcagaaaatagctcagttggtttcagggggaatggggtgggaggggtttgggcacataaatttatgatgataattttaaatgtacgatcattaagttgtatgcctcagtactataacag

SEQ ID NO: 22585 - DNA, 365 bp, Homo sapiens
  misc_feature 318: n = A,T,C or G
actaaggggagggcgcatacccgagtacgattgtatgaagaaaatatggaggaactgttacatgttcggtactaagtcattttcaggggattgaaagactattgctggatttcatgatgctgactggcgttagctgattaaccccatgtaaataggcacttaaatagaagcaggaaagggagacaaagactggcttctggacttcctccctgatccccacccttactcatcacctgcagtggccagaattagggaatcagaatcaaaccagtgtaaggcaagtgctggctgccattgcctggtcacattgaaattggnggcttcattctagatgtagcttgtgcagatgtagcaggaaaatagga

SEQ ID NO: 22586 - DNA, 389 bp, Homo sapiens
  misc_feature 11, 70, 211, 372: n = A,T,C or G
gaggacacagnaactaaaactactacttacatctaacagacacactacaagttgaatcaatttgaaaatnatgtttttatgcttccatagggaacattttggttatttaaattgttcataatgtcccatatttcacctgttcagtgtatactgtactttgcaatcatctttccttttttcacattggtaaaaataagtggcatccataggntcatgatttttaatttgttgcctctgaagatttcactccatcaagatctgccaatcttcaatattctggctaaatcttggtatgtggtttttaaacagtcactccgtttcaaagtctgtctttccttatagaatgtggaaaattatttctccataccttgngattttgacctgagtgc

SEQ ID NO: 22587 - DNA, 399 bp, Homo sapiens
  misc_feature 8, 225: n = A,T,C or G
ttatggcnagggatgtagaacagcatcttctgtttccccaacgtcaaccacggtgtctggcatatggtaggttttcaggtcatgtttgctgagtaaattgaaaatgaatgaacttaatttaagcactcttttctaaagatatgtaagggctatgtgcttcagtacagttgacctttttccatttagggtccttaaaaatgacaaaactattacaaatatttcttntttagtggtaaaagtgaaaagtagtatgacttagctttttatgaacttatatagcgcttcctcccatgataataatcactagttatcaaaagtaatttcttatagggccgagggcagtggctctcccctgtaatcccagtgctttgggaggccaaggtgggaaggattgcttga

SEQ ID NO: 22588 - DNA, 367 bp, Homo sapiens
  misc_feature 224, 270, 314: n = A,T,C or G
ggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtggntttttttatttctactgtcaaatgatgtgcaaaaccttttactggntgcatggaaatcagcctagttttataatccttaaatcttaatgntcctcaaagcttggattaaatacatattgggatggttactctcttgcaccaaa

SEQ ID NO: 22589 - DNA, 190 bp, Homo sapiens
  misc_feature 153, 189: n = A,T,C or G
gccagtgaagcagcctccttatatttggcccaaactcatcttgatcaaccaaaaacatgtttctgccttctttatgggacttaagttttttttttctcctctccatctctaggatgtcgtctttggggagatctctattatatcttggatggntggcaaaagggcttcctaaaaataaaaaataaaatng

SEQ ID NO: 22590 - DNA, 376 bp, Homo sapiens
  misc_feature 341: n = A,T,C or G
gacagcaccctcctgaaaactgcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgaacgaagtcactgcagatgacagggaaagtcaagagcaccataaccttagatgggggggngtccctggtacatgtgcaggaaatggggatgggga

SEQ ID NO: 22591 - DNA, 371 bp, Homo sapiens
aatcaaaagtctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtggtaggatgaaacaatttgggagaagatagaagtttgaagtggaaaacttggaagacaga

SEQ ID NO: 22592 - DNA, 172 bp, Homo sapiens
  misc_feature 1: n = A,T,C or G
naacgtgatgaaaccctgtctctattaaaaatacaaaaattaggcgggcgcctgtagtcccagctactggtaggctgaggcaggagaatcacttgaacccgggaggtggaggttgcggtgagttcacaccatttcactccagccggggcaacaagagcgaaactctgtctaa

SEQ ID NO: 22593 - DNA, 362 bp, Homo sapiens
  misc_feature 6, 206: n = A,T,C or G
atgtgntctcatttttcttggacactggacaaaagctcaggatccattagtgtagatacaaaaggctgtcacactagttcattgccttcactggcagagggcagctgcctcatgcgaaaaggcaaagggcccactgagctgttaacacttaagtcatctgtggacagcagcgttaaaagagcactgaagcctctggggcttcaggnggggcaggcaatcctgcctggatgctgctgtggggcttcatgggagtttgcccctgcctgtgctaaagcatctagctggttccagcacccactcacctgtgtgctccctcctgcaaggagtggaacacagcaagtcttgagtgagtggagtttgat

SEQ ID NO: 22594 - DNA, 367 bp, Homo sapiens
  misc_feature 18: n = A,T,C or G
aattaaatgtatcaagtnagagaaacaagaggaaaaaaaaagattgacttgaacaaagcctaagggacctgtgggattgggataccatcaagcaaaccaacctatgtattatgaaagtcccagaaggagaagagagaaagcacggagagattatttgaagaaataatagcctaaaacttcccaagtttgatgaatgacatgaatataaacatacatgaggctcagtgaactccaagataggatgaactcaaagagacctccactgagtcatattataatcagactgttaaaagacagaggatcttgaaagcagtgagagagaagcaactcatcacatacaaggaatcttcaataagattatcagcag

SEQ ID NO: 22595 - DNA, 344 bp, Homo sapiens
gtaatgcagttttaggggtggatttttaagtagcccaaggggtaggaaacctgcacagaaagaagctgcgttgtgaaaatgttgaggaggaaagtgctgcatcgctacgtgatgtggaagagactgcagtgtctgggcattgttgggaatcccgggtattttaaccatgaaacatctgacaacaaattatgtgtctagatatgtttatgtgtgaatgttcatgtatcaggggattcagtttcacagttttaacttcaattttcttgtttaccccacaaatgacaaaattgcgtcattctttctctttgcccctttccaacaccaccccacaattttttaaacaa

SEQ ID NO: 22596 - DNA, 219 bp, Homo sapiens
  misc_feature 68, 87, 112, 124, 128, 203, 204: n = A,T,C or G
cctaattgattgccaaaaatattaatttcgaaaggctcatttggtgcagctattctaggagctttggnatctctgccttagtaaaangacaactccaaacagaaattgtgcntcttgaaggcgngccnaatttgttaacattagtcagatactgcacttttaatttaatgcaactcacttgtctttgttcatacatgggcagnntatggcacttcaagt

SEQ ID NO: 22597 - DNA, 367 bp, Homo sapiens
  misc_feature 305, 335: n = A,T,C or G
acaaacagctagttatatggtaaacagattattatgcctttttgcaattctgaatatgattctagtatttgtgtagatgtatttggtactttttcccctaattccaacactagtttatatatatagcgaataaatctagttgtataaatttttaaatgccgtcagtagaaagcacacaaggttatgatttttttaattactggcttctgatttctttcacttctgatccttttcctttttctcagatgtaagctgagtcttgatcattttaagacaacgatgggtagaattttgagattaatggntaattttcccttttttggtaaatttcaggncccctctcactatgcttttgtccagaaggatc

SEQ ID NO: 22598 - DNA, 369 bp, Homo sapiens
  misc_feature 207: n = A,T,C or G
gttgcttgggaatgcagcccaaagcgggtggtaaactcccacggtgctgggattacaggtatgagccactgtgtgcagccccagtcctcaaggtaagcaacagaagcatcccaggataggaaagtctcatactttgattgacaaggtcaaattgtatcgttttcacatgtttttaaaaaagtacttgtacatcacaatttatactgnaattaaaacaagtaaacctttaaaagcatgaaatgcaaaggagtacttagttttgattaattgatttaacaaaaagtatgagattgtttgacaggttgcctaaatggtaatgtttttggattgcttcctgaaaaaaatagggcttgaagctgttgatgtaag

SEQ ID NO: 22599 - DNA, 371 bp, Homo sapiens
  misc_feature 346: n = A,T,C or G
gggattctgtatttatgattttagaatactacctgctggaatatttcatttggctttttagctttgggagcatgtagcatagggagagttgaaagttcctaattaggaatgggatggtgttcagccgctctcgtctgcacttaagcaactggtgtaggtttcttttcttgcctacctgcaagtgcacgctacaagccgggccctctgctctgacctcacacaggtcacttaagaatttgaagaaggccaatgtcctgtggccattagacagtagtgtgagagatggaaagaggtgccttttgtaattacgaagaaactgtgtcctggtttttatgaaaatgcttgnctttttattcttttcaacttaaatg

SEQ ID NO: 22600 - DNA, 358 bp, Homo sapiens
  misc_feature 16: n = A,T,C or G
ttatggccggacctgnttggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtattttatatcaataaagtatagtaaagcagtttc

SEQ ID NO: 22601 - DNA, 377 bp, Homo sapiens
caagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctc

SEQ ID NO: 22602 - DNA, 371 bp, Homo sapiens
  misc_feature 9: n = A,T,C or G
atagcaagnattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatctggtatcggtggccacttggatggatttttttacattctgttccccagttacaggaaggagtccctttggtgtgtgaatatgtgtgcctgtagagggtggggcaagggtggggtggggatggaaatgtgtggcatgcacatgagttgaaattcttttatgcatttttttgaagaaaaaaaaaaa

SEQ ID NO: 22603 - DNA, 290 bp, Homo sapiens
  misc_feature 141: n = A,T,C or G
gtgcatatgtttatatggctgtgtagtgacatgcagtaccatgcttcgggagtgcatagtttggctaggagacattcacttataccatctcctgtgtgtacacagagcccttaaagcgtggtttggccaaatttgtatcangagtatcatgggagctgcaatagtcagaactttaaatggtgtatcttattaaatcgtgtacaacccaaaggaaattttttctacttcccttacaaaggtactgaagatgaagaaaaaagagtagaaaataccaggttagagaacttaac

SEQ ID NO: 22604 - DNA, 352 bp, Homo sapiens
  misc_feature 188, 233, 322, 323: n = A,T,C or G
aatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagncactcttaattaatatctgtatcctggaacaatattttatggggntatgtttttctgtgtgtcagttttcatagtatccatatttttattactggtttattacttccatgaattttaaaatctgagggaaatgnntttgtaaacatttatttttttttaaagaa

SEQ ID NO: 22605 - DNA, 370 bp, Homo sapiens
  misc_feature 9, 205, 245, 248, 251, 324, 362: n = A,T,C or G
ataaaaganctgtagggtgggacatattgggatgtattatatttggaaaatgcaatctgccataatgtcataacctttgttaacttaaaaaagatattttaggccaggcacagtgacacacgcctgtaatcccaacactttgagaggccgaggcgggtagatcaccttgaggtcaggagttcgagaccagcctggccaacgtggngaaaccccttctccactataaatacaaaaattagctgggnggnggngggcacacaccttgtagtaccagctactcaggaggctgaggcaccgagaatcacttgaaccctgggaggcaanaaggtttgcagtgagcccgagatcgcgccacttgcacntctccagc

SEQ ID NO: 22606 - DNA, 375 bp, Homo sapiens
gggatggttaatgggtacaaaaatacaatcagatagaatgagtgagatctagtatttgatagcacaacagggtaattacagtcaacagtaatttattgtatattttaataaaaataaataaatgagtataattggaatgtttgtaacacaaggaaatgataaatgctttaggtgatggacacctcatttaccctgatgtgcttattacacattgtttacctatatcaaaatatctcatgtacagccaggcacggtggctaatgcctgtaatcccaacatttagggaggctgaggcaggcagatcacttgaggccaggagttcgagaccagctcggcaaatatggcgaaaccccgtctctactaaaaatacaaaaa

SEQ ID NO: 22607 - DNA, 123 bp, Homo sapiens
  misc_feature 27: n = A,T,C or G
caacctcttggaagaaatatatttgcntattgaaaagccagaggatttctttagtgtcattgccgattttggctataacagtgcctttctagccataataaaataaaacaaagtcttgaaaaa

SEQ ID NO: 22608 - DNA, 369 bp, Homo sapiens
ttatgaggaagtattagacaactgagggacattttagtctatctctcttgaaaaactgtgtactcttcaaaattccttatactctgcaaaaatgtcaaagatgaaatatcattaaaaaatgctgagaggccaggcacaatggttcacacttgtgatcccagcactttgggaggccgaggtaggtggatcgcttgagcccaggagtttgatcccagcctgggcaacacagtgagaccccatctcttaaaaaagtgcaaaaattagccgggtgtggtgatgtgtgcctgtggtcctagctacttgggaagctgaagtgggaggatcacatgagcccgggaggtcgaggctgcagcgagccaagatcataac

SEQ ID NO: 22609 - DNA, 354 bp, Homo sapiens
atatgtaaaggtagtagcattagtgtgtaattgatttgttttcctagatatgttgaatttctgttgttctgtgcttggtctcttgctggtcccttttgtgaccagttgcataaatttgttaggtggttagcagcatggaatgctgaatttttgtgtgaggcagaatagttaactgagttatgttcatataaacaccatgcctttgtcttccaacaattttttttaattgaggtgaaattcacataaaataaaattgatattttagagcaaagaaatcacaggagcgtttagtacattcacagtgttgggcagccaccacctctgtctcattccaaagcattttcatcactccaa

SEQ ID NO: 22610 - DNA, 182 bp, Homo sapiens
  misc_feature 13, 39: n = A,T,C or G
gagtatatgaganggagaagggaggggtggacaaaagantgaaggacgacccatccatctccatggctggaagatgctgtggtcagaaaccacaaaggcagaccaggtgagaattacacatggcagatgtaaggggagaggagaagcattcgtggtttttcaggactgaagggactccatca

SEQ ID NO: 22611 - DNA, 381 bp, Homo sapiens
tattgtttgatagctaaagtgctttcactgatgaccatctgaccagtttaattgtcagctgatacatgtcagaactccttcatatactggctaatttctgtcagtttctaaatggtaactgctaatgtcaaggcagttcaaaaatagcaaaaacttgatttcctcttaatatcttgaagatcatattcatgggcaccagcgagtctggaaaataaatctgatggatttttctcatcatatttagaataaacaaattaatgctagaaattgtttctaacaggagataataaaggaaatgggcaaacaaaaataaatatatagcttctgtgagccaattgttttttgtaaactggatgagatttttttaatgtaggcaagaat

SEQ ID NO: 22612 - DNA, 400 bp, Homo sapiens
  misc_feature 15, 17, 37, 69, 163: n = A,T,C or G
tgatcctaaagagcncnttttgacacccccccccctncttttaacccttagagttaataagggttttantactctcttctgtccctattgttttcaaaggaatgaggtgtttaggtggctggaaaagcatttgtaggaagttagatttgaatatagacaaggngggttattcacgttgagaatgttatttgaagaatgcctgtgaagccaggtgtgggttctactcagtgccatagatagactgagtcttctctcgtaggttaccattacatagtaatttttgattctgaatttcacattaaattattttggagtttatacagaccctaaattttaaaatctgtacatttattatttttgatggattaagatgaatattgctgatttaaatttttattta

SEQ ID NO: 22613 - DNA, 268 bp, Homo sapiens
  misc_feature 11, 20, 30, 37, 39, 49, 63, 73, 99, 102, 146, 148, 210: n = A,T,C or G
cccccgggacnctccggccnctccggcccngggaggncngccgaccccntgggaagggcaaantgtgtcagangccccctagtcaactcctgtaacttnacntctggtacttgtgaagtggttagcaactcacttttgaactttcnanttctgctacttttaaaagaaatgtagtctttgtagtacgaaaataaattaaaaattgttaantgtatattttttggtttgtattataataaaatgcaaacatgactgttctatgattata

SEQ ID NO: 22614 - DNA, 315 bp, Homo sapiens
  misc_feature 2, 11, 24, 38, 69: n = A,T,C or G
anctcggcctntatggccggagcnttatgtaaatttantggttctgcagattaaatctggttttcttantttgtttcaacaaaatcttcttacctgctttacatttttatttgtcggtccaagcagattcattaaggtttgagaatccagtgatagaaaattgttgcaaagtacatgaaacaagtacttcatcacagttctcccagttctgagaggtatggtgggcttaaaaagaaatacagacctgttctcagtttgcttcagaaaacaatcttgcactaagtaaaccacccatttcacatttctcaaaaaaga

SEQ ID NO: 22615 - DNA, 387 bp, Homo sapiens
  misc_feature 25: n = A,T,C or G
ggccgggaagtgccaatcctttgantgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaaagaaggccctgaagctgatggggtcaaatgaaggtgaattcaaggctgaaggaaatagcaaattcacctacacagttctggaggatggttgcaccgaaacacactggggaatggagcaaaacagtctt

SEQ ID NO: 22616 - DNA, 106 bp, Homo sapiens
gtatgtcttttaattttgttcaatgtgttatcaactgttttaaggaatggggattgaaattcgtgtgcaaactgatatgtatataactcctgaggcaacagaagtg

SEQ ID NO: 22617 - DNA, 333 bp, Homo sapiens
  misc_feature 4, 59, 179, 206, 209: n = A,T,C or G
aaancaactgtttctaaaggaatacagttcagccatgtgaaggacatttacactgttgngaaacagatctccagtaactttttcatcttgcaaaactgaaactccatacccattaaacaactcccctttttgttttctcctcagtggaatagaattttgactccatataaatcaagaancacctaaattctttagttgtttgtgtnggngagatctaaggtcatggtaaacattaagttcttaaaatttttgggagggacagtgcacctctcctctgaattgttagcaattaaattgagtaggttttaaatgtctattcattggaagggtttg

SEQ ID NO: 22618 - DNA, 376 bp, Homo sapiens
  misc_feature 32, 73, 78: n = A,T,C or G
gattgtttcttgaaggtaaattgctaattttntacagtgtaattctgttcttcacaaaataggtttcacttanttctntatttaaactgttggtcagaaaatgatctgcaattcaagtaagtctgcattacttttttctttaaaaagtactttaacatgccttatttattatattagcaaatgagctaataacagatgaaattttcattttttgacagatataaccttgcataagtagtatttaggggtgattttgatactatctttaggagttttgcattggatattaaaaaatatattggcacaatgtattggaagaaaatgagtagtatcctggtttaatttttaataatttagggacattttaaaaaatcaa

SEQ ID NO: 22619 - DNA, 366 bp, Homo sapiens
  misc_feature 29: n = A,T,C or G
gagcatttaagaagcatcctctgccaagnaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaat

SEQ ID NO: 22620 - DNA, 171 bp, Homo sapiens
  misc_feature 2, 7, 8, 10, 150: n = A,T,C or G
anctgannangtgttgttgcccctggtaaatccctgctcagtacgaagaggaacccgcaggttcagacattttggtgtatgtgcttggctgaggagccaatggggcgaagctaccatctgtgggattatgactgaacgcctctaagtcanaatcccgcccaggcaaaacaa

SEQ ID NO: 22621 - DNA, 380 bp, Homo sapiens
acatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcata

SEQ ID NO: 22622 - DNA, 389 bp, Homo sapiens
  misc_feature 16, 20, 150: n = A,T,C or G
agccttgactgtctcntagngggtgggctttttgttgatgagggaggggaaacttttttttttctatagacttttttcagataacatcttctgagtcataaccagcctggcagtatgatggcctagatgcagagaaaacagctccttggngaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatct

SEQ ID NO: 22623 - DNA, 191 bp, Homo sapiens
  misc_feature 3, 42: n = A,T,C or G
gancttgtaaaaggccttcacttcctctttattcctgaaganatttttgctgtctgtaaaattttggattgatgctaatttaccactttcagtatgttccgctgttttctggtctccatagtttctgatgatacatttatggtatttcaaattgttctcctctgtgtaattcttcatttttttttttcctg

SEQ ID NO: 22624 - DNA, 297 bp, Homo sapiens
aacctgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtc

SEQ ID NO: 22625 - DNA, 312 bp, Homo sapiens
gtttgaaaacaggcactcttcccctgagatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactc

SEQ ID NO: 22626 - DNA, 376 bp, Homo sapiens
  misc_feature 18, 328: n = A,T,C or G
aacaaaataaccgaaatnaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatgggggctttccagggaatgnaagaagctctcctacatccgcattgctgataccaatatcaccagcatt

SEQ ID NO: 22627 - DNA, 372 bp, Homo sapiens
  misc_feature 306: n = A,T,C or G
caggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgcttgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatgggngtagttctgagtcccgagacttttctgcgtgatggctatgccttgcacacaggtgttggtgatggg

SEQ ID NO: 22628 - DNA, 114 bp, Homo sapiens
  misc_feature 18: n = A,T,C or G
acacacctgagtcccagngtatctcttgaacccaggagccggaggttgcaatgagctgagatggcgccactgcactccagcctgggtgacagagcgagaacttgtctcaaaaaa

SEQ ID NO: 22629 - DNA, 371 bp, Homo sapiens
  misc_feature 9, 13, 315: n = A,T,C or G
cacataganaaantaatcttgttgtttggccttcaagtatgagttggatttggatttggatggtggagaaagttaatccatgcaggggaattagaacaagtgtatgggtgaatgtttaatggtatacattgcaaacatcaaatttcattgactggaatgtaacatgtataaagtgagtgagtagaacatgaaccctaaaagattaggtgggacaagactatggaagccttacataccctgctatcactctaagaagactctattcaatagaaaatggagaatcattaaaaggttgaagggcatgattataagtgnggttttgtcaagactaaaaccgtaaaactgacataaaaaagaataatagaaagttt

SEQ ID NO: 22630 - DNA, 400 bp, Homo sapiens
  misc_feature 3, 13, 106, 314, 365, 374, 390: n = A,T,C or G
tcnggccgggcantccaacctccctctggagtttcctgttactgcctgttgcaggcaaatgtaaagtctagaaaataatgcaaatgtcacggctactctcactacnttttgcttggttcacttttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcacccgntgggaccaatgccttaattaaagaattttaaaaaagttgtaataaagaaanatttttttnggcattcctctaatgntggggggttt

SEQ ID NO: 22631 - DNA, 382 bp, Homo sapiens
gctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgtttgaaggcacaagcacagagtcagaaagc

SEQ ID NO: 22632 - DNA, 381 bp, Homo sapiens
  misc_feature 10, 327: n = A,T,C or G
ctcagcagantgctttaccaattgaagtaaaatgtggcaggctggagttattgaagcagagtggcagtcttcagtttgcagagtaggggtctgtcttttaaactctgagtgcaaacttcagagttcttgccttggctgcagtttttttccttcaagaatgcagtactaacatttatttgagtggagttactgaacagtaacatagctgtgatttttggtatttgaaacactggttttaaatattttgacttgttgagggtatgttttatatagcaagacattatatagcagtaaaaaatgggggtttatcttctatataattcctgnttttattattaacaaaacagtcctaaatagcagccctcaattgtgaaaaaattt

SEQ ID NO: 22633 - DNA, 131 bp, Homo sapiens
agcccagcgacttctgagggccccttgcaaagtaatagggcttctgcctaagcctctccctccagccaataggcagctttcttaactatcctaacaagccttggaccaaatggaaataaagctttttgatg

SEQ ID NO: 22634 - DNA, 399 bp, Homo sapiens
  misc_feature 4, 59, 282: n = A,T,C or G
cccngggattcggcctttggccggggacaaccttagccaacctttacccaaataaagtntaggcgatagaaattgaaacctggcacaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagcacagctaaaagagcacacccgtctatgtagcaaaatagngggggaagatttataggtaggaggcgacaaacctaccgagcctggtgatagcttggttgtccaagatagaatcttagttcaactttaaatttgcccacagaaccctctaaatcccct

SEQ ID NO: 22635 - DNA, 376 bp, Homo sapiens
aaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgtttttgttgtttgattcagcaaaaatctcccagtgacaacatcgcaatagttttttacttctcttaggtggctctgggaatgggagaggggtaggatgtacaggggtagtttgttttagaaccagccgtatt

SEQ ID NO: 22636 - DNA, 302 bp, Homo sapiens
  misc_feature 4, 5, 33, 54, 61, 86, 89, 95, 103, 116, 130, 150, 173, 189,197, 214, 262, 266, 275, 287: n = A,T,C or G
gggnncccccccttaattttttttaaggggggncccccccgggggggggggggnttttaancccaaaaaaaaaaggaggggggggnccncaaaangaaccccnttttcccaaaagnaacccccacccggnccccaaaaacccaaaaattngggccccaagggcccttttcccnaaaaaaaaaaaccggncttttttnaaaaccccctttaaaancccccaccaaacccccccccccccaaccgggggggggaaaaaaacccnaggncccagggtnggggaatttttnaaaaacccccttttt

SEQ ID NO: 22637 - DNA, 382 bp, Homo sapiens
ggattcctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattggaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatc

SEQ ID NO: 22638 - DNA, 391 bp, Homo sapiens
  misc_feature 2, 70, 81: n = A,T,C or G
angagaaccaaatacaatctgttggaaccctatggaagctttcctttttacagcagcaaatgaagattantaacttactantacttttgatatgcgtgcactggacactcctgtaatggtccatatggatcatgtatctgcagtgcttgatgtggattactctcccactgggaaggagtttgtgtctgctagtttcgataaatccattcgaatctttcctgtagacaaaagtcgaagcagggaggtatatcatacaaagagaatgcaacatgttatctgtgtaaaatggacttctgacagcaagatattatggtgtggatctgatgaaatgaacattcgcctgtggaaagctaatgcttctgaaaaattgggtgtgcttacatcacgagaa

SEQ ID NO: 22639 - DNA, 400 bp, Homo sapiens
  misc_feature 9, 16, 68, 75: n = A,T,C or G
cccgggaanctcggcntctttggccgggaaggtcaattgaagtagaaaatgactttctgccggtaganaagactnttgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggc

SEQ ID NO: 22640 - DNA, 177 bp, Homo sapiens
  misc_feature 44, 46, 67, 125: n = A,T,C or G
tatggcgcggggaaatccttagttcaactttaaatttgcccacngnaaccctctaaatccccttgtnaatttaactgttagtccaaagaggaacagctctttggacactaggaaaaaaccttgtngagagagtaaaaaaatttaacacccatagtaggcctaaaagcagccaccaaa

SEQ ID NO: 22641 - DNA, 390 bp, Homo sapiens
  misc_feature 8, 54, 57, 62, 63, 64, 125, 204, 209, 216, 237, 329: n = A,T,C or G
gacttccngttagcattatcttttttatagctctaatgccatctttactagganggngggannnaagtaagttgattttcacacatgactaaataccattatctctttagttctacggcattcanaggcatttcttgcctgtttcttgcctattaggtctgggctaatttgagtaatagatttaatattgtagatatatattgncatanggggggntaggcagcacctaaggagagntattggaatatcagtatcatgtttctccaaatacatttctgctcatttacttttctctctacttagcttggggctaatatttttcctaaggncagaggctccttttggcttacttaaataatttatgtgtgcttattttttggaataggattc

SEQ ID NO: 22642 - DNA, 286 bp, Homo sapiens
  misc_feature 12, 24, 52, 72, 89, 110, 271, 274, 276: n = A,T,C or G
attttggaatantgactatcatanatcataacagtgactgatgttggttgtnttggttgggtttagggtganccattttaagggtgccnaatgaaatattagtatttgtnccccgaaagaatttattggtttgatcttattacctagattgagattttttaatctttcctctacctaaactgacaatgaattggttatacatcatgcataagctacacttttatattagtttatatttgttattctaagacttgggtttcatcaataaagntgngntttaagccgc

SEQ ID NO: 22643 - DNA, 299 bp, Homo sapiens
  misc_feature 2, 39, 43, 49, 52, 79, 93, 119, 124, 153, 159, 230, 242,254, 265, 285, 286: n = A,T,C or G
cnggccttgtatgaagcaggagaaagggaaaggggacanacgnaaacgngtncaataccatccttaccaccagaagctntccacaacttcgcnggaggggtgcaggaaatacaccaagnacagnaaggcatgacatgaacaaagttctgggancggggnggtgaaaggggacattgagaaatgcctcacagctatcgtgaagtgcgccacaagcaaaccagctttctttngcaggagaagcntcatcaagccangaaaggggggngggaactcgcccataaaggnnttgatcagggatt

SEQ ID NO: 22644 - DNA, 168 bp, Homo sapiens
  misc_feature 49, 52, 138: n = A,T,C or G
gttctctgctggctttccaagcaaaagaattccattcattcattcatgnatncattcatccaacacactcactgagctctcactgcatggcaggccttgttgtttgggggcacttggagatatagctgtgggcaaggnagaggagcccgcttctcaaggagctggctt

SEQ ID NO: 22645 - DNA, 166 bp, Homo sapiens
  misc_feature 132: n = A,T,C or G
ggttacttatctattccagacttagtttcttcagctctaaaacaggagataacgcttactaaatttacttttaagagctgttgcaagaattagtgaaatgtacatcaagatgtattttaataaaaataatgngttcagtattttaaaaaaaattagttctttcaca

SEQ ID NO: 22646 - DNA, 167 bp, Homo sapiens
  misc_feature 4, 50, 145: n = A,T,C or G
aatnttattttaaaacaataaagccatgacatacgctttttaaagaagangcccagaattttttttatacgatggtaacatttgaagatttgtaatatcataatgctagttatctgcaaaaatcttgcaattttttaggattgtnggttttagtcaacatttctact

SEQ ID NO: 22647 - DNA, 380 bp, Homo sapiens
  misc_feature 1: n = A,T,C or G
naattcagaacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggat

SEQ ID NO: 22648 - DNA, 119 bp, Homo sapiens
attttaagtagagacggggtttcactgtgttggccaggctggtcttgaattcctgacctcaggtgattcacccgcctcagcctcccaaagtgctgggattacaggtgtgagccactgct

SEQ ID NO: 22649 - DNA, 371 bp, Homo sapiens
  misc_feature 4, 21, 222, 244, 356, 367: n = A,T,C or G
gagnatcatgttttcttaatntgctggaatttaaaaattgttttacttgtatcgaaattaaccttgatttataactatttttgtaataaaacaatgacagctgtagtaactatgatgggtgtaacaacatttttttaaagaagggaatctgtttatcgcttttcaaaatattttctaaagtgggggaagaaagtttatagactttccaagcacatttatggntttttattactattattatggntttaaaaagagtaactttatttctttttgtaaggaattaagtaatatcctttacagttctgtgaaaggacttattttttaactgtaatatttattagttttaaaatatttgnatctcatttgnaaca

SEQ ID NO: 22650 - DNA, 388 bp, Homo sapiens
  misc_feature 5, 26, 84, 202, 203, 205, 327, 356, 361, 377: n = A,T,C or G
caacnctggcttccacgcctgagttntaccaagtatgccacaccaaaaaggattatgaagaaattggacctagcatttgtcgtnacaatccagtgtttggagtcatgtcgtaaaattggcttcatagttattggggttagggaggtggggaagagataatctttctgattacctgttttgtctggatggctggttttgaggnngnaaacctgacttgaaatagtaacaccaaacatgattatacaggaatattttaataagtgtatcaccatgcagatgtagaagagagcgaaagtgattgtgtttttctttagattgaatatttgnatcttatgtgtaaccaaaagaagtgggtnttagntctttctgtgccctgntattttgggat

SEQ ID NO: 22651 - DNA, 167 bp, Homo sapiens
  misc_feature 4, 98, 155, 161: n = A,T,C or G
gggnggaaactgacgtacaatctttttttaatgtaggaagtgaatttttaacgctcacatttacagatgagaaactatggcttattaattacctaagngttaactattactattaaaatcgacaattgacataatttaaaaaattagttgttgtnagtggnctagta

SEQ ID NO: 22652 - DNA, 295 bp, Homo sapiens
  misc_feature 54, 55, 206, 208, 211, 216, 268: n = A,T,C or G
gaaacccagatgttccagaatgaccttgatttgtgcccccatcgaggaagagcnngagggggcacctctggaagatgtagatggaattcctattgatgctactcccatcgatgatcttgatggagtccctataaaaagtcttgatgatgatcttgatggagtgcctttggatgcaacctgaagactcaaaaaagaatgagcctatngnggnaaggntgccccatcaaaatgggaagctgtggatgaatctgaattggaagcacagggnccttgtttaacaaaacttttctaaaaa

SEQ ID NO: 22653 - DNA, 389 bp, Homo sapiens
  misc_feature 205, 246, 325, 384: n = A,T,C or G
gaggccttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgagnggcgggggaagagtagcatgaggaaggaaaagataaaaggnttctaaaacatgacggaggttgagatgaagcttcttcatggagtaaaaaatgtatttaaaagaaaattgagagaaaggnctacagagccccgaattaataccaatagaagggcaatgcttttagattaaaatgaaggngactt

SEQ ID NO: 22654 - DNA, 236 bp, Homo sapiens
  misc_feature 209: n = A,T,C or G
gtttacagtattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaaaaaaaaaaaaaaaaaaaaaaaaaaaaaaaaaaaaaaaaaaaaaaaaaaaaaaggngggggaaaaaaaaaaaaaaaaaaaaaa

SEQ ID NO: 22655 - DNA, 368 bp, Homo sapiens
  misc_feature 52, 110, 123, 203, 204, 207, 210, 366: n = A,T,C or G
cataagaggccaaataacatattgatggaaagcagatcagtggttaactggngctgaggaggggaggattgactgcaatggggcatgaggttactttttgcaataatggnaattttgattgtngtggtgactacggagatgtatatatttgtcaaaattcattgaactgtgcaatcaagatgagtacctattactggatatanntgnggnagtcagtaaagttgatttttaaaaaataacagcaagaagttaaaaaatgaaagttcttggtcctcattcttagtgattccgatacagcaggactgatacagggcccagaaatttgcattttcaacaacccccatgtataattatgctgcaggctgntt

SEQ ID NO: 22656 - DNA, 225 bp, Homo sapiens
  misc_feature 124, 204, 206: n = A,T,C or G
gaggcattgaggcagccagcgcaggggcttctgctgagggggcaggcggagcttgaggaaaccgcagataagtttttttctctttgaaagatagagattaatacaactacttaaaaaatatagncaataggttactaagatattgcttagcgttaagtttttaacgtaattttaatagcttaagattttaagagaaaatatgangncttagaagagtagcatggg

SEQ ID NO: 22657 - DNA, 364 bp, Homo sapiens
  misc_feature 5, 204, 205, 206, 291: n = A,T,C or G
atgcngtgttcagcaaagaccaaatattgagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatnnntaatttacctaagattacaaatcagaagtcatcttgctaccagtatttagaagccaactatgattattaacgatgtccaacccgnctggcccaccagggtccttttgacactgctctaacagccctcctctgcactcccacctgacacaccaggcgct

SEQ ID NO: 22658 - DNA, 386 bp, Homo sapiens
  misc_feature 2, 4, 83, 338, 344: n = A,T,C or G
anantttggctggggagcacttaattcttcccatttcaaaaggtaatgttgcctggggcttaacccacctgccctttgggcangggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgccccctgccccagggctncttcanaaagcatctgcatgtgaacaccatcatgcctttataaaggat

SEQ ID NO: 22659 - DNA, 366 bp, Homo sapiens
gcccttttccaagatggcgccgaaagcgaagaaggaagctcctgcccctcctaaagctgaagccaaagcgaaggctttaaaggccaagaaggcagtgttgaaaggtgttcacagccacaaaaagaagaagatccgcacgtcacccaccttccggcggccgaagacactgcgactccggagacagcccaaatatcctcggaagagcgctccccaggagaaacaagcttgaccactatgctatcattcaagtttccgctgaccactgagtctgccatgaagaagattaggaagacaacaacacactttgtgttatttgggggatgttaaagccaaccaagcaccagattaaacaggctgtgaagaagc

SEQ ID NO: 22660 - DNA, 298 bp, Homo sapiens
  misc_feature 50, 210: n = A,T,C or G
gggtgcggaggtcagggacaagatggtgccaccggtgcaggtctctccgntcatcaagctcggccgctactccgccctgttcctcggtgtggcctacggagccacgcgctacaattacctaaaacctcgggcagaagaggagaggaggatagcagcagaagagaagaagaagccggatgaactgaaacggattgccagagaattgggggnagatgacagcatattaaagtgagtgaccctgcgacccactctttggaccagcagcggatgaataaagcttcctgtgttgtgtgaaaac

SEQ ID NO: 22661 - DNA, 300 bp, Homo sapiens
  misc_feature 9, 42, 46, 47, 103, 121, 192, 195: n = A,T,C or G
aaaaccagnatttgtgcagaatgagcttgctgacacacagcntaannttgtaccgatgtttcatactaactccctctgagtttgcacatgggacccatgaggnggcatgaagaggtaactngcccatgccccgaggattttccagcccttccttttctttctatcaatcacctactaatcacagaatccacnggntacaccttttctactaaaataactctttaaaataagtacaatgggacagatttgagctgggctcctgtctccttgttaatcaaattgcaataaaatgttttctct

SEQ ID NO: 22662 - DNA, 364 bp, Homo sapiens
  misc_feature 12, 158, 161, 207: n = A,T,C or G
ataacaataagnctggctgcagtggctcgcacctgtaatcccattactttgggaagccatgacaggcagatagcctgaggtcaggagttcaagaccagccttgccaacatgacaaaacaccatctctactaaaaatacaaaaattagccgggcacggnggngagcacctgtagtcccagctactggggaggctgaggcaggagaatngcttgaacctcagaggcggaggttgcagtaagctgagattgcgcctctgtactccagcctgggtggccaagtgagactccatctcaaaataaataaataaatacatacccaataaattaaatgcttacattaaaaaagtaggagagctctcaaataa

SEQ ID NO: 22663 - DNA, 369 bp, Homo sapiens
  misc_feature 69, 88, 123, 132, 182, 218, 224, 275, 279, 286, 352: n = A,T,C or G
acggcaagggtacctacggtacctgaaaacaacgatggcatgttaaaacacttcccatttacctgttgntgctgctggctgttttcgngattcaagcaagtttcatctcaagagctttcctgnaaaggccgntgctttgagtcttcgagagagggagggagtgtgactgcgacgcccaatgnaaagaaggatgacaagtgctgcccgattatgagagnttctgngcagaagtgcataatcccacataccaccatcttcaaagaaagcccttcacnttangagcatntaaaccatcaaatcaacaaccaaacggtcaccccaaccacccaacaagaagagactaagaaagttntggaatcaggggaatac

SEQ ID NO: 22664 - DNA, 208 bp, Homo sapiens
  misc_feature 48: n = A,T,C or G
gaagcagaagaaaaaagacaagctaggaaacaaaaagctaagggcttnatgtacaaacttagaagaaaattggaagatagaaacaagatagaaaatgaaaatattgtcaagagtttcagatagaaaatgaaaaacaagctaagacaagtattggagaaatatagaagatagaaaaatataaagccaaaaattggataaaatagcacta

SEQ ID NO: 22665 - DNA, 135 bp, Homo sapiens
  misc_feature 2, 18: n = A,T,C or G
gnatgatgcccaatcagnatgtgccagttaaaacccatgaagaggttaaaatgactttgaatgacacgttagccaaaactaacagagaattattagatgtgaagaaaaaatttgaagatataaatcaggaatttg

SEQ ID NO: 22666 - DNA, 222 bp, Homo sapiens
  misc_feature 214: n = A,T,C or G
caggcacagtctgatgaaaagtcgctcattgccaagttgcaccaacataatgtctctcttcaactgagtgaggctactgctcttggtaagttggagtcaattacatctaaactgcagaagatggaggcctacaacttgcgcttagagcagaaacttgatgaaaaagaacaggctctctattatgctcgtttggagggaagaaacagagcaaaanaaaaaagg

SEQ ID NO: 22667 - DNA, 300 bp, Homo sapiens
  misc_feature 45: n = A,T,C or G
aaagatataaaattgtcttgagaaaccaaggaatataggtgggtntaaacccagttccttccagtaaacccttgcttctaaggtgccttacctggcccattgagaatccattccacaagcagagctggctgggcatctcctctctgctgagattcgaagatgtaaacagaaattataaattctccttgctgccaggaacgtgtggctacagcatatcaaagagggtcttggaaaccctggcattcaatatttgaggcaatcttccatgcctaagtttaaaaaacattgcaggatttagca

SEQ ID NO: 22668 - DNA, 303 bp, Homo sapiens
  misc_feature 34, 41, 42: n = A,T,C or G
acttgccaagatattagaattcccctttgggggnctatgannttccctggtttattttcccaaacagaaacctccaggttatgggcacttactttaattatctggcagaatttgcaagataattgcccagaactagcatattgattcacatttttaccttacccatccctattcttttattccaagctgcagaagatcaccacgtgattcacaggaataagcaaggttagctaaaacataggcaaaaagcttaaaaacaattaatgagagtaggctttaatgacaaatttatgataagctttg

SEQ ID NO: 22669 - DNA, 394 bp, Homo sapiens
tatacgcgcacacacttgttcaagaagttatgttgtggccttggatttgtttttccccttggaaatggttcttaactctgggattttagaaggttagaatattttttcaagagaacagtggtactcaaaagaatgaaaggtggccctacattttctgtattcatcacttaaaatttttaatttttccgagaactacaagtaacatttgaaccatgctgctgttgtaccttaaacaaaaactcagtgataaccagtatttagtctattaaaaatgctctttttgaagaaaaaagtttggaagctctgattagccagagtatagtatgagcttcactgagaaatatggggcccattttctttgtgaaaacctgggaaaatgcaagtgtgggtatga

SEQ ID NO: 22670 - DNA, 341 bp, Homo sapiens
  misc_feature 1, 54, 55, 57: n = A,T,C or G
natgagacccggcagcattcagcagtatatttataaacaggaacctgtacaganntnccctggaagaaggcctgctctaaattatccagtgtatggagaaacgacacaggttaggagacgtcggctttgaacgtgctataggaccttctcaaacacacaccatcagaattcaatattcacctgccagactggcttatcaagacaaaggtgccttcataatgaagttaaagtgagtatactgtggagaggacttccaaatgtggtacctcagctatatcactgcccaacatcagaaaacctgacggctatgattactatgcctttttaaagatcaatactat

SEQ ID NO: 22671 - DNA, 400 bp, Homo sapiens
  misc_feature 12, 29, 35, 42, 51, 70, 84, 85, 91, 129, 131, 140, 202, 216,311, 328, 354: n = A,T,C or G
atgatagattcntactctggtaagtaggnaagcanaagaatnaaagacttnctaggaaacaaaaagctangggcaaaatgtacnntcttanaagaaaattgggaggatagaaacaagatagaaaatganantattgtcangagtttcagatagaaaatgaaaaacaagctaagacaagtattggagaagtatagaagatggnaaaatataaagccnaaaattggataaaatagccctggaaaaatgagggaattattggtaaccaatttattttaaaagcccatcaatttaatttctggtggtgcagaagntagaagggaaagcttgngaagatgagggtggttacgtagaccnggacccatttagaagaatacttggagctagaaggggaggtgggtta

SEQ ID NO: 22672 - DNA, 224 bp, Homo sapiens
  misc_feature 45, 47, 65, 71, 80, 165: n = A,T,C or G
cagaactgaaattgctagcttgaaagggtaaattgtttctgtggntntgaagaaatttccagatntccctntatagtagntacaccattttataatcctacagcaaagtctgaaagtgtatttttcacacatcctttcaaaaacattcaaactttggatttttgnacatctaattggggagaaatgatatacttggtttcattttcaatctattcttatagatg

SEQ ID NO: 22673 - DNA, 125 bp, Homo sapiens
  misc_feature 11, 34, 75: n = A,T,C or G
gaatggttccnactacttgagaggctgagatggnaggattgcttgagcccagaattttgaggctacagtgagctngtatttgcgccactgcactccagcctgggtgacagacaagatcctgtctc

SEQ ID NO: 22674 - DNA, 216 bp, Homo sapiens
  misc_feature 4, 9, 53, 66: n = A,T,C or G
aggnctttnttttacttcccctaattgttgagtaaaaagtgattctcttaatntctgtattctgtntttcatatcaccagtagaagggcctgtggatctaaatagagcacattttaaggctacagagtagtagaaattgatgtttaagacaaggcagcttgttcaaaatctgaaaggcacacccagaagctttctctaaacattttggctcccatt

SEQ ID NO: 22675 - DNA, 398 bp, Homo sapiens
  misc_feature 56, 57, 91: n = A,T,C or G
gaaaagagcccaggaattgaaaatggggctttccagggaatgaagaagctctcctnnatccgcattgctgataccaatatcaccagcattnctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctgccaacacgcctcatctgagggagcttcacttggacaacaacaagcttaccagagtacctggtgggctgcagagcataagtacattcaaggttgctaccttcataacaacaatatctcttgtaggtggatcaagtgacttctgcccacctggcacaaca

SEQ ID NO: 22676 - DNA, 125 bp, Homo sapiens
  misc_feature 6, 11, 37, 46, 49, 57, 67, 78, 85, 100, 114, 115, 120: n = A,T,C or G
ctgctntgagnggtatatgacttttcttcagatctcntttctcctnatntcataagngatgcttgcngctggggttanagctcanctgtataatcctggnttgtttcctcatcnnaagantccta

SEQ ID NO: 22677 - DNA, 348 bp, Homo sapiens
  misc_feature 1, 61, 78, 250, 275: n = A,T,C or G
naagcagcccaaggactcggtggaaagagcagaacaccatagacaatatgtcgctttttgngacccaaggtgcttgcntgtttcttgctgcattcatcatcacctctgatggatacccctgggggcaatagtcaacgaggagacgatgtgactcaagcgactccagaacattcacagaagatctaatcttggtgaatgatcccgctacagatgaaacaggtttggctggtttggctgatattgcaccttncacagatgacttggcctccctcagngaaaaaaaccactgcagagtgctgggatgaaaaaattacctgcacaaggctctactctggcatcgggcgggtt

SEQ ID NO: 22678 - DNA, 208 bp, Homo sapiens
  misc_feature 3, 10, 35, 68, 84, 85, 154, 167, 171, 196: n = A,T,C or G
ccntatttantttcaccataaatcaccttcacttncaaaagtctcaggttggtgtgggaagttaaggngaccttaaaaagatgnnactttctttccagactaggaaaactatgcatttattcatattgcagatctattttataaaatggtatgnaggctcattgatntttncctatcaatatgaggtcaaacacanatgcctataaga

SEQ ID NO: 22679 - DNA, 284 bp, Homo sapiens
  misc_feature 13, 68, 93, 94: n = A,T,C or G
gaaatttacccangaaactttccttcatgcatttaaaggaaaatgaaaaaaaagttttacttttgttngtaatcatactttttttttagcttnngaattggttgacatctcaaacacatggcaaataatactctagtgtggaaatattttcacagcaatcctctacttttagaggaagtgcaaggaatctgaaatagtagttttcatttgtttgtttgtttgtttgctttttgagacggaatctcactccagcctgggtgacaagagcaagaccctgtccccca

SEQ ID NO: 22680 - DNA, 391 bp, Homo sapiens
  misc_feature 46, 278, 332: n = A,T,C or G
aagctgacagcattcgggccgagatgtctcgctccgtggccttagntgtgctcgcgctactctctctttctggcctggaggctatccagcgtactccaaagattcaggtttactcacgtcatccagcagagaatggaaagtcaaagttcctgaattgctatgtgtctgggtttcatccatccgacattgaagttgacttactgaagaatggagagagaattgaaaaagtggagcattcagacttgtctttcagcaaggactggctttctatctcttgnactacactgaattcacccccactgaaaaagatgagtatgcacaaaatgtagggntataataatggtaacatggcatgacttctttataattctactttgaggctggctccatg

SEQ ID NO: 22681 - DNA, 318 bp, Homo sapiens
  misc_feature 45, 46, 73, 90: n = A,T,C or G
aatatttatcagataactcgctagtccttgttctaagtacttttnntatagtagctcgtttaatcattgaatnagccatgtaatggggcnctattatagtctcaaattttcagataagggagatgctcacagagaataacctactcagctagtgagggacagtgcccagtgagaacccaggccgccagctctggcatgcctggccactataccatattgcctctttatattcttttgcaggattgctttcattttaatatgtagcaagaggactatagtatttaagcaaaattggattagcggtgaaagctatattac

SEQ ID NO: 22682 - DNA, 114 bp, Homo sapiens
  misc_feature 16, 30, 74, 100: n = A,T,C or G
gaagtggacccccgtnttttggaagtggantttcttcttttgatacaggatttacttcatttgggacactaggncacgggggcctcactggattctcttncacgtcatttggtg

SEQ ID NO: 22683 - DNA, 398 bp, Homo sapiens
  misc_feature 1, 56, 57, 322, 323, 327, 374: n = A,T,C or G
nggatttttccgtatgtgctgctgtcttgaaatttacctaccctacattattccannggtgagtatcttctttgctctttatatacatttttaggaaatgtccaaccaccatcattctttgaaatagttttaataactgcatagattttttttgcaaatagacatattgtaagatatttagccgccttattaacagacatttatgttctattttgggggatgaaaacaatgttactagacatttttgtgttaaagctgccagatctccaactatttctttgggattgattcctacataagaaatttggtttaggctaggcgnngggnctcattactataataccagcgctttgggaggctgagcaagaggatgnagggaggccaggagtcaagaccag

SEQ ID NO: 22684 - DNA, 103 bp, Homo sapiens
  misc_feature 4, 11, 54: n = A,T,C or G
atgncacccgnaaaaaacgagcagtggcccctcatcctgtaaggtactgctacntcagagtgacctaaaagtctaacactgtgaggaaaactgtgatttgtag

SEQ ID NO: 22685 - DNA, 383 bp, Homo sapiens
  misc_feature 55, 280: n = A,T,C or G
aatatttccaaaggaaaagttaattctttttttattgttattctaaaaatacttntttgctgaaaggattgttttccttcagatttttacctttgtcacccttggtttgcaatatgaacaacggtttaggcaggggtttaggaaacaaatcatggattagatctcattaaaaaatgtatttcctttggaggttaaaaaaaaaagtgaatgtgaactagaattatcaatgcctataggtacttattgtgttgtttaaaaaaacatgtataataattactgntcttcatatttattctgcagatggggtgaaactctggatctggatgctgacatgcagactgaaataagatacgttgcattattctgaaaacctcctgggcaat

SEQ ID NO: 22686 - DNA, 395 bp, Homo sapiens
  misc_feature 107, 132, 340, 346, 357: n = A,T,C or G
atgctaccttactggtataaatataactgaatattggggtagctttcatttcttccattaattacatgtgtaaaattaaaacactactgtaatgttaatttcctggntttgaaaatcatattatggttatgnacattggtaacattaaggaaagctggcagaagggtgtgcataaattctatactctttttgaaacttttctataattctaaaattattttttaaaggtaaacagtatattaagattaccttcactattcctcactcaagattaagacattttttgaaaagcagtagagttgcttaaaatacaaattaattattcttgactataccttgnaaaggnaaatctaatgnataaatttttgaaaaatttgcccctgggcatagcatct

SEQ ID NO: 22687 - DNA, 308 bp, Homo sapiens
  misc_feature 106, 173, 198: n = A,T,C or G
aagaaatattacaacttaaccattaaattagtacttgaagttgattctttgtggtgggactttttaaaaaaatgcctttttaaagcattaatgggctaattgaagnattttatgactcctcattcctggccagagggttgtctttgaaaccctgtttctaacccttgggttgngtggttctgctgaggcagtgggtgngtactggctccgggagccactgtgaccaggcctttgagctcttgcatctgtggagagaatcatgcaaattttaaaagtcttcaagagacttccatgtcctgggtattaac

SEQ ID NO: 22688 - DNA, 396 bp, Homo sapiens
  misc_feature 45, 46, 362, 383, 389: n = A,T,C or G
gttttgttgtttgattcagcaaaaatctcccagtgacaacatcgnnttagttttttacttctcttaggtggctctgggaatgggagaggggtaggatgtacaggggtagtttgttttagaaccagccgtattttacatgaagctgtataattaattgcattatttttggtagcaaagattaaatgtgcattggaagccatcccttttttttacatttcatacacagaaccagaaaagcaatactggttccatttaaggatatgattaatattattaatataataatgatgatgatgatgatgaaactaaggatttttcaagagatctttctttccaaaacatttctggacagacctgatggnatttttttttaaataaaagcncaagtncttttgg

SEQ ID NO: 22689 - DNA, 205 bp, Homo sapiens
  misc_feature 29, 43, 46, 89, 139, 152: n = A,T,C or G
agattatttattatttctagcaaggcttncttcctttcttatngcntagagactgactgacacatcttttgttatttttacacataaantaaacatagcctttttggacaaattcactaaatattaatgtataaaatgnaattgagtaaatntttatcaagaattttaaaaataaaagagcttagactcagtagaactcagtaag

SEQ ID NO: 22690 - DNA, 333 bp, Homo sapiens
  misc_feature 7, 22, 28, 29, 32, 36, 38, 46, 49, 50, 53, 58, 59, 61, 77: n = A,T,C or G
ctaggtngaacaactatagatnatggtnnctnatgnanaattcacnttnngcntaaanntncttttcttgagcttanaactcagttgatgaagtggggggatagtcactgtggagacttaaattattcaactggagacttcaattattagactggaaaaataagataaatctccaaaacataggagcaaaaatttcaaagagaatcatgaaagaaaaggtaaaagacctaaggaatagatccaggagacgtaacagaactaacatgtgtataatagttatttataggaatttaaaaaggagaaaaacagatggaagatagataatatttatgc

SEQ ID NO: 22691 - DNA, 311 bp, Homo sapiens
  misc_feature 14, 48: n = A,T,C or G
aatgataccatttntgcggtatttgaagagctttttccagattatgtntaaaatttaaaccaagccatgtggtgaagaactcaagggtggggataaagtgctgatgacctgtgttggcattggtttctccaaccttagcaagaccctcaagtgataaccatcacaagataaggcccaatgcctacagacaaagcagaagctgcacggacaccaatgggaccaagtccaaatggattaatccaggacagaatagccacttgcttaattttctgtgaagaaatatcaatatacaaataaaagacatccctgtt

SEQ ID NO: 22692 - DNA, 303 bp, Homo sapiens
  misc_feature 11, 36, 56, 57: n = A,T,C or G
gaaaacagccnaaagagcacacccgtctatgtagcnaaatagtgggaagatttatnntgtaggaggcgacaaacctaccgagcctggtgatagctggttgccaagatagaatcttagttcaactttaaatttgcccacagaaccctctaaatccccttgtaaatttaactgttaagtccaaagaggaacagctctttggacactaggaaaaaaccttgtagagagagtaaaaaatttaacacccatagtaggcctaaaagcagccaccaattaagaaagcgtcaagctcaacacccactacct

SEQ ID NO: 22693 - DNA, 240 bp, Homo sapiens
  misc_feature 10, 32, 48, 181: n = A,T,C or G
cggaaagctntatctttttctgaacccattcnccttagcattagattnatctgacttgatgaaaactattaagtaaaaaccactactgacctttacattaaatagctgttttcctcttctaaataatacccttgattttaactagactacttccttttattttctgcctattgcttaatgntttacaagaaaatacataggtgcatgctagtttctctactttgagctgaaacaaaccgg

SEQ ID NO: 22694 - DNA, 327 bp, Homo sapiens
  misc_feature 5, 10, 30, 54, 275: n = A,T,C or G
tcccnatatncacttgcaggattcttgcanaaagagtgtttcaaaaccgctttntgaaaaggaatgttgaactctgtgagttgaatgcaaacatcacaactcagttgctgagaatgcttctgactagattttatggtaagatatttccttttctaccgtagcttcaatgccctctaaatacacccttgcaaattctacaaagagactgtttcataactgctctataggaaagaaaggtcaactctgtgagttgaatgcagagatcacaacgtggnttctgcgaatgattctttgtagtttttacatgaagatatttcggtgcaactg

SEQ ID NO: 22695 - DNA, 397 bp, Homo sapiens
  misc_feature 2, 11, 57, 59, 100, 164, 393: n = A,T,C or G
gnatgagtccncgcagagagtgtaagagaggataaaacggcaacacagctcacaagntnagactttccagctgctgaagttatgggaaacatcaaaacanagaccaagatatagtcaagaagatcatccaagatattgacctctgtgaaaacagcgtgcagcgncacattggacatgctaacctcaccttcgagcagcttcgtagcttgatggaaagcttaccgggaaagaaagtgggagcagaagacattgaaaaaacaataaaggcatgcaaacccagtgccagatctgaagctgtcagtttgtggcgaataaaaaatggcgaccaagacaccttgaagggcctaatgcacgcactaaagcactcaaagacgtccactttcccaaaactgncact

SEQ ID NO: 22696 - DNA, 272 bp, Homo sapiens
  misc_feature 46, 47, 235, 248: n = A,T,C or G
attgtaatgtatgcagttctgcagaggaccaagagaaaacttattnnggccatcttgaaagtattctagatctgtatgtgggttatttcccctgcctttgtgatgctaatatattttctgtatgtatgcctgcatatttctccctggaagttccctagaggatacctagcctcatactcttgcaccaaagaagaattcccaggataatgatctaaatatttatctattccttagntatttattgaggncacaaggtataaataccatggttg

SEQ ID NO: 22697 - DNA, 192 bp, Homo sapiens
  misc_feature 47, 91, 102, 107: n = A,T,C or G
tggctgacacatcgaagttattcatgaggaagacctgaaagtaaatnttagtctcccaattgttttgttattttgtttgctgtttttgttngttcttaagcnagtgncattcaggcaatagcatgcatccaggctaatgctaacctagaatttgccagctcataattctactaataatttttcaaagtattg

SEQ ID NO: 22698 - DNA, 305 bp, Homo sapiens
  misc_feature 55, 57, 199, 204, 301, 303: n = A,T,C or G
aagacaggcccttgcagtacattgagctccatagagacagcgccggggcaagtgntnccggacgggcactgggcgactctgtgcctcgctgaggaaaaataactaaacatgggcaaaggagatcctaagaagccgagagcaaaatgtcatcatatgcattttttgtgcaaacttgtcgggaggagcataagaagaagcncccanatgcttcagtcaacttctcagagttttctaagaagtgctcagagaggtggaagaccatgtcttgctaaagagaaaggaaaatttgaagatatggcanangc

SEQ ID NO: 22699 - DNA, 125 bp, Homo sapiens
  misc_feature 12, 22, 28, 30, 54, 74, 90, 99, 114: n = A,T,C or G
taggccctaagnagagagaacnttgcgngnagagcgatgagctatggacccccnttaccagacgaggtacctangaacagctaaaagagnacacccgtntatgtgcaaaatagngggaagatcta

SEQ ID NO: 22700 - DNA, 299 bp, Homo sapiens
  misc_feature 7, 12, 55, 61, 80, 99: n = A,T,C or G
aatgaancccanaaataaagtcaagaaaatttacctggatgaaaagaggcttttntttgangaccatcccattgatcttntcttaagggactttaaganaaactaccacatgtatgtgtatcctgtgcactgcagtttaagtgaacttgaccaacaccctatggatagagtcttgacacattctgaacttgctcctctgcgagcatctctgggcccatggaacactgcataacccgtttctttgaggagtgtgaccccaacaaggataagcacatcaccctgagggagtgggggcactg

SEQ ID NO: 22701 - DNA, 397 bp, Homo sapiens
  misc_feature 2, 18, 58, 375: n = A,T,C or G
gnaaactccccggtgggncactgcgcagaccagacttcgctcgtactcgtgcgccttncttcgcttttcctccgcaaccatgtctgacaaacccgatattggctgagatcgagaaattcgataagtcgaaactgaagaagacagagacgcaagagaaaaatccactgcttccaaagaaacgattgaacaggagaagcaagcaggcgaatcgtaatgaggcgtgcgccggcaatatgcactgtacattccacaagcattgccttcttattttacttcttttagctggttaactttgtaagatgcaaagaggttggatcaaggttaaatgactgtgctgccctttcacatcaaagaactactgacaacgaaggccgngcctgcctttccatctgtctat

SEQ ID NO: 22702 - DNA, 283 bp, Homo sapiens
  misc_feature 12, 16, 93, 106, 131, 140, 173, 242: n = A,T,C or G
gaagaaatatgnatanataccatagactttccttctcctgagttttctaaattatgtttggatgggttgacaaaaattataacattttctggngtggtctaagtgnatgtagagaaaatatttaagggaantataagtgnggagggttaaagggacgttcaaaggggtaaggnttctatacttcactttaagtgataaaatgacaaaaccaatagactttgatcattaaacaaatatgatgnaatacctagagcagctactaaaaaagttgacaaacaaaaag

SEQ ID NO: 22703 - DNA, 125 bp, Homo sapiens
  misc_feature 6, 15, 27, 40, 43, 47, 52, 53, 56, 66, 73, 76, 81, 85, 87,90, 95, 99, 104, 116, 124: n = A,T,C or G
cgcttngagagagtnaggatggacgangccgtgagggctngantttnagacnnggntgggcacaangaggagnccnggtgngtangnaantaaanagangcgcnggctatctgatntggggctng

SEQ ID NO: 22704 - DNA, 298 bp, Homo sapiens
  misc_feature 2, 11, 35, 96, 271: n = A,T,C or G
gntctggtggntgtacattgtatgggcttagacanttgtatgatgatatctacaattatagaatcatacagaatagtttcactgccctaaaacttntctatgcttcacctgttcatccctttcttccctaatcccctggcaaccactttaaaaaaaaattaggttcagggggtacatgtgcaggtaaactcgtgacaagggggtttggtatacagattatttaggacccaggtactaagcctagtacccaatagtacttttctggcctgtncttttcccacccttcaccctcaggtag

SEQ ID NO: 22705 - DNA, 246 bp, Homo sapiens
  misc_feature 24: n = A,T,C or G
cagacttgcataacctcagatggncctgtcaagaactcagcgaatttggcaggacagataaagatatgtgactggtcaagatcacacagctggtaataggactcaaatctatactcaaggccaagcgcagtggctgctgctgtaatcccagcattttaagaggcaaggcaaggtggatcacttgaggtcaggagttcgagaccatcctggctaacacaggtgaaatcccatctctactaaaaattc

SEQ ID NO: 22706 - DNA, 171 bp, Homo sapiens
  misc_feature 24, 26, 35, 48, 61, 85: n = A,T,C or G
cctggtcaggagcgtaaccggagngntcgccgccnacgtgagaggaanttcgtgcgcggcntgcgctttcctgtccccaagccgntctagacgcgggaaaaatgctttctgaaagcagctcctttttgaagggtgtgatgcttggaagcattttctgtgctttgatcacta

SEQ ID NO: 22707 - DNA, 273 bp, Homo sapiens
  misc_feature 47, 89: n = A,T,C or G
caattgcaagagtgggagtaaatgacttctgtccaacagtgccattngatgaagaaatctttatacagtgcaataagtttattcaacancccggtgaaatactgggaaatgcaacctgcaacatttcgttgtgttttgagcagaatgagtgttcagcttgggaactttggaatgtaataattagtaattggaaatgtccatttaatataagattcaaaaatccctacatttggaatacttgaactctattaataatggtagtattatatatac

SEQ ID NO: 22708 - DNA, 100 bp, Homo sapiens
  misc_feature 81: n = A,T,C or G
gtctagatatttacctgatactaatcagtgaaatatatgatatccttatttaaaatgtagttagttatatttaatgacctnattcctaagttcctttttc

SEQ ID NO: 22709 - DNA, 239 bp, Homo sapiens
  misc_feature 10: n = A,T,C or G
gagaattctntaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggtcaagattatctaagaagatttgaaagtataccagatatgcttgaattggatcacctcaca

SEQ ID NO: 22710 - DNA, 341 bp, Homo sapiens
  misc_feature 32, 57, 252: n = A,T,C or G
aatttttcccaagagacagagtttctccatgncaatcaggctattcttgaactcctnacctcaggtgatccacctgcctcgacctcccagagtgctgggattacaggcatgagccaccatgcctggcctaggaaatgctttttaagtacttgaggtctggcacaatatttaccattccaaaactcccattacctttggtttttctcctcaggatgataaatcttcattcagaaaggctttgggtacagttgnaggttatctgcatagataatatcaaccaagttagacccaataaagagtaatatatagaatgctatttaaaatactatagggaaaagtgg

SEQ ID NO: 22711 - DNA, 304 bp, Homo sapiens
  misc_feature 41, 75, 195, 198, 222, 251, 266: n = A,T,C or G
atgccacatttttttaactgaggtgatcattctccaccctnttctttccatgtttttccatgtttgttcaaactnttcattaaatatcttgaggctctaactaaattaagggtggcattaaaattgtatgtgggattccctgaccaactggtaatgcactaccagcatataaggggcctcattaaagcagttggngantggtacatgggacctcactcatgnatggttgcatctacttgggagcaaaaagntttcttaaagtatanggggggacatgaaagacatacaattcactggagaaatg

SEQ ID NO: 22712 - DNA, 277 bp, Homo sapiens
  misc_feature 10, 55, 263, 266: n = A,T,C or G
gattctaccncaattgcaagagtgggagtaaatgacttctgtccaacagcgccanagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgccatttaataagatcaaaaatccctacatttggaatacttgactctattaataatggnagnattatatatac

SEQ ID NO: 22713 - DNA, 394 bp, Homo sapiens
  misc_feature 4, 11: n = A,T,C or G
atcnccggttngacaatccagagtggtgaacagccctacaagatggctggtttatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcgccctgaacagagcagctgctgatgtctggaggctgattttcctgttctctgtctccactggaaaggttgttacgacaaaccttcttgtcaaagtgtgtaaaaataaaggattgctccatcct

SEQ ID NO: 22714 - DNA, 389 bp, Homo sapiens
  misc_feature 1, 332, 365, 367, 374: n = A,T,C or G
nagttttcccatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgcccaaaatgtaatttgcaaagagcttcaaacaccaaaaatataccattttaaggcatgtggggacaatgctatttgccttagtcattcggtgttactttgcaaaatttgngacttttaagtactaacacatttgattgaatgngnattgaantggaatattatttct

SEQ ID NO: 22715 - DNA, 130 bp, Homo sapiens
  misc_feature 45: n = A,T,C or G
gaatagagaagatagggaaattagaagataaaaacatacttttantagaaaaaagataaatttaaacctgaaaagtaggaagcagaagaaaaaagacaagctaggaaacaaaaagctaagggcaaaatgt

SEQ ID NO: 22716 - DNA, 358 bp, Homo sapiens
  misc_feature 2, 4, 47, 48, 49: n = A,T,C or G
anantgaaacaattcggagaagatagaagtttgaagtgtgaaaactnnnagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaaatatagaagatagaaaaatataaagccaaaaattggataaaatag

SEQ ID NO: 22717 - DNA, 397 bp, Homo sapiens
  misc_feature 4, 12, 338, 358, 366: n = A,T,C or G
aagnatgccggncagttaacttcagaaaccccttgtttaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttcttagaacttctacagaagccaagctccctggagccctgttggcagctctagctttgcagtcgtgtaattggccaagtcattgtttttctcgctcactttccaccaagtgtctagagcatgtgagcctcgtgtcatcttccggggtggncacaaggctagatccccggngggtttgngctcaaaataaaaagcctcagtgaccaatgc

SEQ ID NO: 22718 - DNA, 151 bp, Homo sapiens
  misc_feature 2: n = A,T,C or G
gngaaaaagtcatttaaggtgacctttgcccaccggctgtgcacttggagagcctgaaattccattcatcaaagcaacacaccacgattttcattcggcaaataaaaatacatgttcataagcgggagaaaaataaacccagagcttttca

SEQ ID NO: 22719 - DNA, 397 bp, Homo sapiens
  misc_feature 55, 57, 303, 375: n = A,T,C or G
gaaatctacccttagaactctatatgtcagcattgacctgggaatgaagtcaggntngagaaattccacttgcctgtgatgggtccttagaagtatcagctaaggagtgaccctgtcctatacacagggctctctattacgttccataccctgggcctacccaaggtgacattcctgctgtttacatggcataggcacctgtgagatcaagtgtcacaatttcatcttagaaagaggtaaggtatggctgctttgcggttgaaagttaaggggagccatgatctaccatatttaggaaaaagntatttaaaaaagagcagatggtggaaaaagaatgtaagacccagaatttatccctttgacaatgaatctggncttttaatagcaggatggaatt

SEQ ID NO: 22720 - DNA, 276 bp, Homo sapiens
  misc_feature 45, 47, 273: n = A,T,C or G
gataacaataaacaggattgaactttgtaaacaaccaaagtcagntnccttcagaactgcaattcttactccctttcacagactgtccggagtctttgggtttgattcacctgctgcggaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggattttntta

SEQ ID NO: 22721 - DNA, 363 bp, Homo sapiens
cgagtaaatgaaaaggctgttaaagtagatgacatcatgtgttattctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatatttgtaaatttttgaaatgctagtaatgtgttttcaccagcaagtatttgttgcaaacttaatgtcattttccttaagatggtacagctatgtaacctgtattattctggcggacttattaaaatcaaacag

SEQ ID NO: 22722 - DNA, 395 bp, Homo sapiens
  misc_feature 1, 10, 55, 237, 311, 343, 344, 349, 380, 384: n = A,T,C or G
natagagccntggaaaatggagttgctcattgctttatttttttaaacctatgcntaaaattgtattaatacttaaagttgtgtaccacagaatctagtgacttttcttagacattattgcagtttaagaatatgcatatgaaagaaaagcttaagatggtaatttttgaattacactttaatacgtattttcttgtgaatttttaagacaatgaacagtaggaataattaggcatngcatgtaaaatgtttattcatcttttgaattagaaacgctaaaagcagcagaagctgagagtaactgaacaagnatatatcccacctagtaaggaattgaaacttnnaaaanattggtttgggcttaatttatcatgcagaanatgnatttggtcagt

SEQ ID NO: 22723 - DNA, 276 bp, Homo sapiens
gatgaaaccccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttat

SEQ ID NO: 22724 - DNA, 393 bp, Homo sapiens
  misc_feature 1, 7, 56: n = A,T,C or G
nataganccctgtaacacccctacaactgattctgattcatctatagcagttaatncactacaaatagatagctttggtttagttacatgctttcaacaagagtctcttgatgtttctcaaatgatacttggaaaatctcagcaacctgagtcaaaaatgcaatctgaatttataaaagaaaaaagtgctacttgttcaaatgaggaaaaagataacttaaacgagtcagtaataactgaagagaaagaaacagatggagatcacctatcttcattactgaacaaaactacggtcacaatatacctggattcgcagcataaaagaaccaatatgcaggatggtagtgtgcaggcattaaagatcatgtgccaattgtgcattcaggttttcag

SEQ ID NO: 22725 - DNA, 316 bp, Homo sapiens
aagatactttaccaggtatgtattgcattatatcattgcaataattattggaagtctagatatcgagccatcccaggtgttgggcggggggagggttgtggcaagattgtcttttcaattttggagagttttcctgtggctacaaggcaagtaacgggttggaaaaagtctgactgtaagcgttggcaccttcatagtgtagtgttttagtgactttttttatacggtcttgaaattagatcgttagtgggtttcagaatgttggttatgcctagtcagacactttccctgtacttgtcttgataagggaaaactg

SEQ ID NO: 22726 - DNA, 138 bp, Homo sapiens
  misc_feature 18, 20, 33: n = A,T,C or G
aggaaaccgcagataagntnttttctctttganagatagagattaatacagctacttaaaaaatatagtcaataggttactaagatattgcttagcgttaagtttttaacgtaattttaatagcttaagattttaaga

SEQ ID NO: 22727 - DNA, 332 bp, Homo sapiens
  misc_feature 46, 292: n = A,T,C or G
ctccagccgagcttcccagaacatcacatatcactgcaaaaatagntttgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtaagatattgcaccctatgacattggtggcctgatcaagaatttggngtggcgttggcctgtttgctttttataaaccaaactctat

SEQ ID NO: 22728 - DNA, 197 bp, Homo sapiens
  misc_feature 3, 4, 65, 97, 101, 107, 178: n = A,T,C or G
tannaacacatgatgcaactatatgttgttttcaggagacataccttagattcaaatatacaaanagattgaaagtcaaaggataaaaaaagataantgangagganaagagagctggagtaccaatactaatatcagacaaaatggactttacgacaaacattggtatgagaggtanagcatgacattttataatg

SEQ ID NO: 22729 - DNA, 251 bp, Homo sapiens
cgacggtggtgggtgactgagcggagcccttttgacaggatgttggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgagaatctgaattatccaga

SEQ ID NO: 22730 - DNA, 253 bp, Homo sapiens
  misc_feature 19, 20, 159: n = A,T,C or G
actacgaggttagtctaannatgatctttgcaatctcttttagttcaaaactgattatttgaagattagtatgtaatcttcctcgttcattgaatggcgttcttcttttatgtgtgttgcaaaacaacctttttagaaaatatctgtgaagcttatctnctgattaatagctatgattgttctttgtaagacaccagcttgaatgtcctgaaaccagaagccctagtccactggatatactcagagtatctta

SEQ ID NO: 22731 - DNA, 331 bp, Homo sapiens
  misc_feature 2, 47, 48, 50, 51, 115, 193, 254, 260: n = A,T,C or G
cntacagaaaacggaagtaaggtaaagaaatagaagcattggtgttnngnnatggtgggctcacgcctgtaatcccagcactttgggaggccaaggagggcagatcacctgaggncaggagttcgagaccagcctggccaacatgatgaaaccccgtttctactaaaaatacaaaaaaatagccaggtgtggnggtgggcacctgtaatcccagccactcgggaggctgaggcaggagaagtgtttgaacccgnaagcgnaggttgcaagtgagctgaaattgtgccactgcactccagccgggcaacaagagcgaaactccatctcaaac

SEQ ID NO: 22732 - DNA, 320 bp, Homo sapiens
  misc_feature 11, 45, 301: n = A,T,C or G
tgagcaccggntaccccatgtgttactgctgcagcttgggaacanttttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctgggtcagcttcaagaaaaagccttgtttgcagnccctaaaaattacaagctg

SEQ ID NO: 22733 - DNA, 314 bp, Homo sapiens
  misc_feature 46, 47, 224, 242, 275: n = A,T,C or G
tccatgtatttaaatgaacagaaacactgcagtggattagtttttnnttttttgtttagatgtttaatttaaaagtaaacccttactagtctaattgtacagttccttgggttgaaataaaggtggtcttttttgataaagaatatttgtattataaatgaatggatcttctaatttctcagtcttgctaacattccttaaaattaaaaacattcttacacctncgtattttcattttttgngtaaaaatagattataaagggctttttctgtgnatgaattttaatgcattttggcatttaatttaaaaattg

SEQ ID NO: 22734 - DNA, 395 bp, Homo sapiens
  misc_feature 56, 353, 390: n = A,T,C or G
aatagtccctcttttgatgctggggaaccaaaatggtgatgatatataagactttntgtatagccacagttcatccccaaccctagtcttcgaaatgttaatatttgataaatctagaaaatgcattcatacaattacagaattcaaatattgcaaaaggatgtatgtctttctccccgagctcccctgttccccttcattgaaaaccaccacggtgccatctcttgtgtatgcagggctatgcacctgcaggcacgtgtgtatgcactccccgcttgtgtttacacaagctgtggggtggtacgcatgcctgctttttttcacttaataatacagcttggagagatttttgnaatcacattataaatcccactcgtctttttggatggncacat

SEQ ID NO: 22735 - DNA, 400 bp, Homo sapiens
  misc_feature 46, 48, 61: n = A,T,C or G
cgagggagagcattaaggacaaatacctaatgcatgtggggcttantncttagatgacggnttgataggtgcagcaaaccaccatggcacatgtatacctatgtaacaaacctgcacatttttttgcacgtgtatcccagaactaaaaagaaaatttcttattttcttggccggcacagtggctcatgcctgtaaccccagcagtttaggaggcccgaggcaggtggattacttgaggtcaggagttcgagaccagactggcaacatggcgaaaccccgtctctactgaaaacacaaaaaattagctgggcatggtggtgcatgccttgtagtcccagctactgggaaagctgagacagaatttcttgaacccacgaggtggaagttgcagtgagctgag

SEQ ID NO: 22736 - DNA, 220 bp, Homo sapiens
  misc_feature 16, 19: n = A,T,C or G
gaccgaggttagcatnttnatcaaggacaggaactaccatggctcccgaagttttgccaaaacctcggatgcgtggcttctggccaggcgtctgcgaaatcatatggctgtagtattcgtgctatccctgggggttgcaagctttgtataagtttcgtgtggctgatcaaagaaagaaggcatacgcagatttctacagaaactacgatgtcatgaaaga

SEQ ID NO: 22737 - DNA, 399 bp, Homo sapiens
  misc_feature 45, 47, 80: n = A,T,C or G
tgagtttatcacctgtgactttacagtgtatgggtttttatagantngatattaaaattttagggagggtattcaaaagncaagtatgatgaggcatcttttctcacctgtatagaaaatgcattctcatttctcccatttaccggtactttcggttcactgcttttaaaaagatatctgaagttaaaaaccatctaatatgtataactcatgaggcagggaaggcttttcttataattggactttacaatattgtttttaaacattcttggctagaattaacataccactgctgggatatatagagtataatgcaaagtaacacaagcaaaggcagtgatacacaattcttcctcatgagagaaacaatttatgggaaattattaagaactccaggat

SEQ ID NO: 22738 - DNA, 372 bp, Homo sapiens
  misc_feature 15, 24, 348: n = A,T,C or G
caaagcgaaggaatntcgcagagntgaagatcaagcgcctgagaattaagtttgcccaaaagatgcttcgaaaggcaaggaggaagcttatctatgaaaaagcaaagcactatcacaaggaatataggcagatgtacagaactgaaattcgaacggcgaggatggcaagaaaagctggcaacttctatgtacctgcagaacccaaattggcgtttgtcatcagaatcagaggtatcaatggagtgagcccaaaggttcgaaaggtgttgcagcttcttcgcttcgtcaaatcttcaatggaacctttgtgaagctcaacaaggcttcgattaacatgctgaggattgnagagccatatattgcatgggggta

SEQ ID NO: 22739 - DNA, 335 bp, Homo sapiens
  misc_feature 45: n = A,T,C or G
cacttagcattgttatttctgtttcaagtttgtttcttatgcttnaccttttggtcatgtattgtgggaaagcttgggcaaatttggccagtgcaatttaattacaaactttaagttatctgcttttagtgtgcactgcactcattatcccttagagatggaagtgtgtaaaattaaaaaatacaggccaggcatggtgctcattcctgtaatcccagcactttggaaaaatcaagacagaaggatcacttgaggccaggagtttgaggctacagtgaaccttgattgcaccactggctacagcctgcctgggtgatggagtgggaccctgcttt

SEQ ID NO: 22740 - DNA, 352 bp, Homo sapiens
  misc_feature 45, 79, 204: n = A,T,C or G
tggtaaaataaagcttacatagttttcttcctttgaaagactgtnctgtcctttaacataggtttttaaagactagganattgaatgtgaaacatccgttttcattgttcacttctaaaccaaaaattatgtgttgccaaaaccaaacccaggttcatgaatatggtgtctattatagtgaaacatgtactttgagcttattgnttttattctgtattaaatattttcagggttttaaacactaatcacaaactgaatgacttgcttcaaaagcaacaaccttaaaggccgcatttcattagtattcctcattctgcatcctggcttggaaaacaagctctgttgaatcaca

SEQ ID NO: 22741 - DNA, 246 bp, Homo sapiens
  misc_feature 27, 28, 32, 34, 35, 40, 41, 42, 43, 62: n = A,T,C or G
ctaaacatgaaacctatagaatatgtnngcanannatagnnnnccattttattgaaggtggnataaaaagtaactctaacacacacctgctgagtgattttttttcttttatgtttaggaagtttcctcttccctcccacataaagagtgtctagtaatatcaaagcttgttgctggtgtggtgctcatgcttgtaatcccaacagtttgagacgagccctgcatcatagtgagaccctgctctac

SEQ ID NO: 22742 - DNA, 177 bp, Homo sapiens
  misc_feature 3, 17, 31, 161, 163, 166: n = A,T,C or G
tantagaagcgactagngccaactgcgtaancttcacttacatggatttgcataagagaggggcctgattatattaatatttcagaagtcagttctctacctctcttactctgtttggttttggcctggttcttccttatcttcatctggctctcccgcgntnttnactgcaaccgg

SEQ ID NO: 22743 - DNA, 309 bp, Homo sapiens
  misc_feature 19, 31, 32, 33, 45, 67, 74, 75, 82, 120, 122, 124, 158, 182,192, 214, 233, 234, 261, 267: n = A,T,C or G
ttctccgactaactctttnttatggtcgggnnngtcttcctgcgntgaccgcccggcttgacccgcnttgccgnngacttgnctattcggcccgacgagctccgtttcgttacagatggngncntacttggagacaggctggactcagctacatccgntactcccagatttgtccaaaagcngtgagagatnccctggaagacagattccaaancaaatgctgagaagaactnntggcagcaacgttaaaatttgtggaangtaaangaagggaataatcctaccctgactaaggccttgaaatgccta

SEQ ID NO: 22744 - DNA, 180 bp, Homo sapiens
  misc_feature 10, 20, 32, 33, 34, 51, 59, 89, 97, 104, 124, 136, 142: n = A,T,C or G
ccaaaacccntagcttaaantttaaagttgcnnncagcaaccctctaaatncccttgtnaatttaactgttagcccaaagaggaacagntttttggnccctagnaaaaacccttgtcgggggantccaaaatttancacccntagtaggcctaaaagcggcccccctttaagaaagcgtt

SEQ ID NO: 22745 - DNA, 368 bp, Homo sapiens
  misc_feature 17, 38, 39, 58, 69, 76, 84, 103, 108, 110, 176, 206, 235,237, 267, 310, 321, 335, 347, 352: n = A,T,C or G
atccaaggtgcgccaantgaaactgcgaattgccggcnngcctgccataagatttgcnctggagctctngcagcanaactggcnccgaggccgcgaaacatgncgtgntnttggtttgactcaaaccctgccccgcctgagtctcaggagaagaagccgctgaagccctgctgccncttgcccggagaccaagaaggcgcgcgatncgtgtttcatcgagaaagggagaagaacncngggggcatctaatttgaggcccccagggantgcatgaagagccctagggatttaaaatatgaaaggggggggnctgcctggtgnggattaaataattncctggaggaatngaagnaggattaaatttttgg

SEQ ID NO: 22746 - DNA, 160 bp, Homo sapiens
  misc_feature 31, 32, 33, 34, 37, 44, 52, 58, 64, 65, 68, 70, 73, 78, 84,100, 127, 141, 156, 159: n = A,T,C or G
cattgatggtgcggcaattgtaaatattgtnnnngcngcgttgncgtatatntatatntatatnngancngantggtncgagangccaaagatgtttgtncctttttatttttgtttttaacgctgngatatctcaatgtnagcctcaatttctgnacnc

SEQ ID NO: 22747 - DNA, 378 bp, Homo sapiens
  misc_feature 9, 15, 29, 48, 52, 55, 58, 68, 69, 70, 80, 81, 132, 353,368, 372: n = A,T,C or G
tcggccggngaccangatgtactcactgnaggctccaactcgctgggngtcnaancgngtttgcaccnnngactcccaanntttttaagtttttttgtaaagacagggccttgctatgttgcccaggctggnctcaaacttttgggctctagcagtcctctcacctaggcctcccaaagtgcttggattacaggtgtgaaccaccatgcccggctaatatataactttaaaaaatttaaacttccagtttctaaatattcacttgtattgctagaatagattatggaattattcatttacgtataaaagactgaaaacaactcaagcttttagtattttctatactattttgnaacctttactctgtngggntcctag

SEQ ID NO: 22748 - DNA, 194 bp, Homo sapiens
  misc_feature 6, 30, 66, 67, 74, 75, 80, 94, 95, 102, 151, 153, 167: n = A,T,C or G
attatnttcggcagagtaatctcagaatcngcgctgcaccggcatgaaggcaaaccctgagtctannaagattnnaacangagttggccagaanngggttgnttgcattccttgtggtcccagctgcttgggaggctgaggcaggagaatntnttgaacccgggagnctgaggttgccttgagctgagatcacg

SEQ ID NO: 22749 - DNA, 296 bp, Homo sapiens
  misc_feature 10, 15, 27, 47, 85, 270, 272, 274: n = A,T,C or G
cccttgagtnctgantggaggcaacgntaggcagtcaacctaatganggaaatgaataataaatgtttgacactgaaaaacattntattaataaagaatattgacatgagtataccagtttatatataaaaatgtttttaaacttgacgatcattacactaaaacagatttgataatcttattcacagttgttattgtttacagaccatttaattaatatttcctctgtttattcctcctctccctcccattgcatgggtcacacctgcntngnataaaaaaaaaaaaaaaaaaaa

SEQ ID NO: 22750 - DNA, 281 bp, Homo sapiens
  misc_feature 3, 7, 10, 13, 14, 15, 28, 33, 137, 267, 268: n = A,T,C or G
gantgantgnttnnngtatacacaccanatttnaaggctctcaatagcctcatgtgactatcatatgggatagcccagatataagacatttctatcactgcagaaagctctactggacagtgctgatctgggctatncttatatccagcatacccatcttcaactacacatccagctggacatgaaaaaatttaagtaaaaaatacaatgacaagtatgacaagatagctagtgccataatacttgagaaatacctttaaaaaaggnnaaaaaaaaaaaaa

SEQ ID NO: 22751 - DNA, 400 bp, Homo sapiens
  misc_feature 2, 8, 38, 46, 50, 61, 72, 105, 113, 123, 179, 189, 201, 203,336, 360, 362: n = A,T,C or G
gntcctgntacagcatactaatgtcaagaagttaaacnctgcctcnggtncaacctggganaaaagactagngcttcccagtacttgcattggggttcactattnatagtttncttgggagtntcacaggaaaatcacaattacaccactttagaccctatgtgtagcaggtcacaacnttacccttgngggtttagatgngnatgaaatacctgtatacgttaggaaagctgtttactgtaacggggaaaaccagattctttgcatctgggccctctactgattgttaaaggagttcctgtcacctgctccccccacccccgcatgcgtcttgtnccacttggctaacttttaatatgngnatttttacattatgtatatttcttaactggactgtctc

SEQ ID NO: 22752 - DNA, 348 bp, Homo sapiens
  misc_feature 11, 27, 32, 40, 57, 58, 60, 64, 67, 73, 74, 95, 183, 202,307: n = A,T,C or G
ttatggcgggngagaaaaccctgtttntactnaagtaaantaaaaattagccaggtnngnggcnacnggcctnnaatgcctagcctgggtgacanagcgaggcaagactccgtctcaaaaaaaagaaatctgatagacttcacttgtaatggatatttaattctatatttcatgttatctttngtaagaatttaagattagncaacaccaatcctatactcctctagaaaagtatctttgtagctctactcattatttcttatctctaacctaagttactttattacatattaatctgttcatttgntcaccttgctcattgatgcaataaattagtaatctcaattg

SEQ ID NO: 22753 - DNA, 400 bp, Homo sapiens
  misc_feature 14, 16, 49, 50, 62, 72, 370: n = A,T,C or G
atatgcactatatnangtacaaacaggtagtgttacctgcttatagtannggctaacaaagnctcccttgcngcttcagactgttatctataggcttatcgctcaaatacagcacttgaatatcccgagtagttcttctacgcatagctcacctttctaaacccagttaagcatggaagagaggtagtaggtaggtgcagtgtgtggaagctgcaaacaagtaggccttttattcattgatatcttttcccaagtactggattttaaatctgtatgtatctgtttgatttttttttctaatatttcagttgagctgctgttttcttccatgcaatatttgtatactcaattgtgtatagaagaagctggngagagtgccctcctacataaataagcaatt

SEQ ID NO: 22754 - DNA, 362 bp, Homo sapiens
  misc_feature 17, 18, 46, 88, 100, 105, 155, 191, 195, 201, 204, 233, 317,350: n = A,T,C or G
acccatcaacgaagaanngaatccacacagtaaaccccatctgganggccaccaacttcaaagcaccaaaggaggataaatccatgangatgaggaaaanccagngcaaaaaggctgaaaattccaaaaaccagaacacctcttctcctccaaangatcacactccttgcaggcaggggaacaaaactggntggngaatgnggngggggaattgacagaactaggcttcaganggggggtaataacaaactcctctgagctaaaggagcatgttctaacccaatgcaaggaagctaagaaccttgaaaaaaggttangaggaattgctaacttagcaaaaccagtttggngaagaatataaa

SEQ ID NO: 22755 - DNA, 328 bp, Homo sapiens
  misc_feature 10, 12, 28, 30, 31, 32, 35, 37, 39, 46, 47, 52, 55, 59, 63,65, 66, 77, 78, 84, 87, 88, 93, 94, 327: n = A,T,C or G
ttggccaagnangctcgaattgcggccnannncanananttgcatnnagtantancagnggantnngctagagttgnngcacanggnngtccnnttgttagcagaaacatggaatgccagacgctggggatgctggtacaagttgtgggactgcatgctacttgtctagagcttgtctcaatggatctagaacttcatcgccctctgatcgccgatcacctctgagacccaccttgctcataaacaaaatgcccatgttggtcctctgccctggacctgtgacattctggactattttctgtgtttatttgtggccgagggtaacanc

SEQ ID NO: 22756 - DNA, 234 bp, Homo sapiens
  misc_feature 9, 19, 46, 82, 93, 95, 162: n = A,T,C or G
atctgatgngtgggccaancacaagcacgtactttgcgcgtcatgngcctgtccccacattaggcttaaaaacagaatgcanttcccggacgncnaaaccaaaccattttcaccgctacacgaccgggggtatactacggtcaatgctctgaaatctgtggngcaaaccacagtttcatacccatcgtcctagaattaattcccctaaaaatctttgaaatagggcccgtattt

SEQ ID NO: 22757 - DNA, 158 bp, Homo sapiens
  misc_feature 13, 20, 28, 47, 83, 84, 95, 138: n = A,T,C or G
tgtgacacgggtnaatgcgnccatttanggcgggggagaattgtggngcgttctgagccgtctgtcctgcgccaagaatgctnnaaagtattatnaaaaacatatggatccccatgaagccctactacaccaaagttnaccaggaagatttggatagg

SEQ ID NO: 22758 - DNA, 359 bp, Homo sapiens
  misc_feature 9, 38, 40, 44, 114, 137, 193, 195, 196, 249, 274, 287: n = A,T,C or G
tttgtgaanactctcctacaaatggagccattgaaggntnatgngtatggaaatttttacaaaattcctttctgtacctattctgtagatgcctgtataatcggcctggatgtncagctataaatgtgttgggagancaagagagagagaatgggtagagcctgctgaaccttttttcttttaaattcttcgngnnggtaaatgagtaagatattggaaaccttaatgaaaagctgctgttcatgattngggtgtatagggagctgactgtagnattttactattgnctgttaaaaaaagaaaaactgtaatttatatcccctttgaactttattgggtttaattggacacattttctg

SEQ ID NO: 22759 - DNA, 140 bp, Homo sapiens
  misc_feature 4, 12, 41, 72, 86, 102: n = A,T,C or G
ccanttaaggangggggagagcttttttgcttatcatgttnccatttcgtgccgctttcccccttcaagaangccatttggagggnaggggatctgcttccnactgtgactgggctatgggattctgactaccttgctta

SEQ ID NO: 22760 - DNA, 100 bp, Homo sapiens
  misc_feature 5, 12, 40, 66, 81: n = A,T,C or G
taagnatctgcntgtattttgattactaaaataatgattnaaataatggatatatttattttatcnggcctaatctagaanttttttccaaaagcacata

SEQ ID NO: 22761 - DNA, 284 bp, Homo sapiens
  misc_feature 3, 20, 201, 203, 204, 234: n = A,T,C or G
ctnttccctaccttggctgnctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtnanntttgtatttggattcagaactcattttggnggtggcaagacaactggctttggcatgatttatgattccctggattatgc

SEQ ID NO: 22762 - DNA, 400 bp, Homo sapiens
  misc_feature 8, 69, 122, 141, 216, 217, 381: n = A,T,C or G
ttatggcnggcaagtgtagaaaataccctgcttagtcatggtatgtaatcatccttatacctttttgtnttctttttttaaatatttctgagaatttctgtgtctaaatttaaataggatgntgtttcgtaatcatcttgngattcttttgtctcctttgggtattattggctaatagatgaattaagaaatgttacctcttctactgcttgaagnnggggggagaaattgatgtttttcattaagtgttgatgaaatgtacaacttaagcagtttataacagctattctatctaaaaagatataatttttttgggtctatggatataagtatattctattatatatataatgaaacaattcataggatgttttttcaggnttacttttgtaatccatct

SEQ ID NO: 22763 - DNA, 399 bp, Homo sapiens
  misc_feature 12, 64: n = A,T,C or G
acaagcgtgtcntctctgccaagcatccatctaaactggagtgatgtgagcagacccagcttanagttctcctttctttcttaagccctttgctctggaggaagttctccagcttcagctcaactcacagcttctccaagcatcaccctgggagcttcctgagggttttctcataaatgagggctgcacattgcctgttctgcttcgaagtattcaataccgctcagtattttaaatgaggtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagc

SEQ ID NO: 22764 - DNA, 400 bp, Homo sapiens
  misc_feature 13, 15, 28, 29, 43, 69: n = A,T,C or G
attatggtgcggngnctttcggcgcgtnnccgccctcttccantaattcgccaaaatgacgaacacaangggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaa

SEQ ID NO: 22765 - DNA, 247 bp, Homo sapiens
  misc_feature 1, 18, 32, 36, 52, 63, 106, 133: n = A,T,C or G
ncacgcctgctaaatccncagcgatgagaaangganaagcatgaagcgcgcnagcaatgcagntcaaagcgcttagcctagccacacccccacgggaaacagcagngattaacctttagcaataaacgaaagnttaactaagctatactaaccccagggttggtcaatttcgtgccagccaccgcggtcacacgattaacccaagtcaatagaagccggcgtaaagagtgttttagatcaccccctc

SEQ ID NO: 22766 - DNA, 400 bp, Homo sapiens
  misc_feature 15, 17, 50, 71, 104, 134, 157, 395: n = A,T,C or G
cttatggcggggganangaatttaactatataacaagacctgcgcgtgtnccctgaacctaaaataaaagntaaaaaaacaagaaacaaaaccttaacactgtntcctagcatttagaaaaataaaagccatgngtatctatctgtgaaaaaaaagngtcagactgtttcaggttctgtaagtttatccttccccagtatgtttgtttacttatactcaagaatatatcagatatgtgtgtgtgtgtgtgtatatcagactttgatcattgtcaatgtgattacaaaatatatcttactgttgctaaagtttttatttgaatttctcgttagagaaactgagaaattcaaatgaaattgaaaagacacaacttttttctgttgtttaagaattgntcctg

SEQ ID NO: 22767 - DNA, 400 bp, Homo sapiens
  misc_feature 6, 13, 31, 40, 41, 42, 47, 55, 72, 74: n = A,T,C or G
tatagnattatgntcgcggcgaggagaaaancataattannngtcgnccgtacantctccacagtaccagtntngaagtttgatgtgactaggaacttaaagtaacaggagtaaaaattgggaagttagactgtgaatgtcaggttgagatgattacactttgtcctgtattgtcatttaagggaaaataatgaaggtgtttcatttgggcagtgacatgatcagatctttctctttgggaatatctctgctgtggattagcagttcaagacactagactcaagaaaaccacataggggttcctgcaatagttcacaccagaaatgtggaaagtctggaccaggggtgtccaatcttttggcttccctggggcacacctggaagaagaaaaattgtcttg

SEQ ID NO: 22768 - DNA, 253 bp, Homo sapiens
  misc_feature 6, 18, 28, 34, 37, 38, 40, 42, 47, 48, 64, 70, 77, 81, 82,85, 87, 89, 95, 102, 103, 235, 236, 242: n = A,T,C or G
tggccnggctactatagnttatggtggncgaganaanncnantagcnngcgcctccttttcttnccctanccctttngtcnnctntnangagagngaaactnngaagttaatgggatggtcggatctcacaggctgagaactcgttcacctccaagcatttcatgaaaaagctgcttcttattaatcatacaaactctcaccatgatgtgaagagtttcacaaatccttcaaaannaaaagnaatgacctaaa

SEQ ID NO: 22769 - DNA, 398 bp, Homo sapiens
  misc_feature 10, 13, 32, 34, 71, 75, 80, 130, 154, 186, 191, 192, 259,279, 306, 334, 343, 384, 388, 391: n = A,T,C or G
aggctgaagngantagcaaattctcctacacngntgtggcagagatggttgcacagaaacacactggggantggngcaanaacagtctttgaatatcgaacacgcaaggctggggagactacctattgtngatattgcaccctatgacattggnggtccttgatcaagaatttggtgtggacgttnggccnngggttgctttttataaaccaaactctattctgaaatcccaacaaaaaaaatttaactccatatgtgntcctcttgttctaatcttgncaaccaggggcaagtgacccgacaaanttccagttatttatttccaaaatgtttnggaacagtntaattttgacaaagaaaaatgatacttctcttttttttgcngggnccnccaaata

SEQ ID NO: 22770 - DNA, 400 bp, Homo sapiens
  misc_feature 17, 18, 27, 34, 38, 40, 44, 63, 83, 132: n = A,T,C or G
tctccgaggtagcctcnntctttatgntggggcnaggngnaatnttgactaaaacttcagtanaaagccctagtatgcagtcnctttaggaagagttcctttaggaaaataatcttagacaaattaataggngaaaggacatgcgtgtatttgtagttcagctaccatctagacttaatcataagtacttacttggttaagggaccaagtgattttctattaaaaagcaattcgtatttttatttctttagttgtagttgctaagtagagctgttgctgatgatgagatgtttcatgctgagataatgaaaaatttactgtattggatcatctcagcagtcctattgagggttatttcactttatttccatgatgtttcaattaagctttttgtagtaaa

SEQ ID NO: 22771 - DNA, 400 bp, Homo sapiens
  misc_feature 12, 19, 30, 87, 175, 191: n = A,T,C or G
ttatggtcgggnaaggtcntttgcatttgntgaggagtgttttaccttccaaatacgtgggcggttttagaataaatgccatgtggnactgagaagaatgtatattctattgatttggggtagagagttctatagatgtctactagatccacttgatccagagctgagttcaagncctgaatatccttgtnaattttctgtctcattgatctaatactgacagtggggtgttaaagtctcccactattatttcataggagtctaagtctctttgtaggtctctaagaggcacaccccctccaccaagagagaaagtgcttcatcaaactggtcctattaccccgtgccacccaattgggtgagaccctctaacagggggttgtcaagacaccctatgcag

SEQ ID NO: 22772 - DNA, 310 bp, Homo sapiens
  misc_feature 17, 25: n = A,T,C or G
ctagcctttgctattanctcctagnaaggattacacatgcaagcatccccattccagtgagttcaccctctaaatcaccacgatcaaaagggacaagcatcaagcacgcaacaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaaa

SEQ ID NO: 22773 - DNA, 400 bp, Homo sapiens
  misc_feature 7, 12, 38, 46, 50, 55, 61, 62, 63, 67, 82, 91, 92, 397: n = A,T,C or G
attatgntcggncgaaggagctttagttgtcgaagcanggcagctntcanctgcncgagtnnntagncgactgggccgaggnatcaatcanncgtttgcttttgttgagaagaaattccttggactgcggcgtccgagtcagcctgaaagaacactttgcacagttcggccatgtcaagaaggtgcattttaccttttgacaaggagactggcttccacagaggtttgggttgggttcagttttcttcagaagaaggacttcggaatgcactacaacaggaaaatcatattatagatggagtaaaggtcccaggttcacacttagaaggccaaaactttccgcaaacatctgatgatgaaaagaaagatttttgagactgcagcctattaataaagntaa

SEQ ID NO: 22774 - DNA, 226 bp, Homo sapiens
  misc_feature 20, 220: n = A,T,C or G
gggaggccaggagtttgagnaccagcctagccaacatggtgaaaccccatctctattaaaaatacaaaaattagccagacatggtggctcacacctgtagttccagctactcgggaggctgaggcaggaaaattgctgaacccaggaggcggaggtttcagtgagctgaaatcttgccactgcactccagcctgggggacagagtgagactccgtctcanaaaaac

SEQ ID NO: 22775 - DNA, 400 bp, Homo sapiens
  misc_feature 6, 11, 29, 49, 70, 94, 95, 97, 147: n = A,T,C or G
cccgantaatntataccattatggtcggncaagtttagagtctaatttncacattcatcagtcttttganaatatttacaggagtggcttgctnngnggcctgactgatgaaggatgggaaagtatttagtgctccttataggctgngtggaaattttcttctggagagagtttggttgggataatgattgagctctaaactgggaataaagtcatctgggttttcctttcacctgttttgtgatcataggcgtagaattaccttattaattagtgttgattattgtgtaatatttgagttatagggtattttttagcacatcatcacagcagaattttccacctggagtgcgttcaccgaggacttcggggtattatgaagcgctctaataggcgcctc

SEQ ID NO: 22776 - DNA, 398 bp, Homo sapiens
  misc_feature 54, 55, 58, 66, 117, 126, 135, 195, 203, 279, 308: n = A,T,C or G
gcattttctcaggccatggaagtatatgctggttgcagaccccaaaagtaaggnngangataaacncctgaaatttcgtatttctcatgaattggatagggcatcttctgaggtcanttaaaaggngaaaaaatncaatttctcactttgcatttagtcaaaagaaaaaatgctttatagcaaaatgaaagagancatgaaangcttctttctcagtttattggttgaatgtgtatctatttgagtctggaaataactaatgtgtttgataattagttnaggtttggggcttcatggaaactccctgnaaactaaaagcttcagggttatgtctatgttcattctatagaagaaatgcaaactatcactggattttaataatttggtattcctctcat

SEQ ID NO: 22777 - DNA, 400 bp, Homo sapiens
  misc_feature 5, 14, 51, 64, 381: n = A,T,C or G
cattntggcgcggngagtctttaaggattctcagtactggcgttttaccantgatataaaagangcaggggccccgaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggngtccttcataatgaagtta

SEQ ID NO: 22778 - DNA, 254 bp, Homo sapiens
  misc_feature 2, 4, 6, 10, 14, 18, 21, 22, 104: n = A,T,C or G
gnananacantatnttgngtnncgaccttgctctcttcaaaaagcaagttgctgctgagctgtaacatcaaaaagaataaataattgtttttcttttttgttgntatgatatggatcatctgagcggttagtggtaagcaagccgctttgattccactctggctccccagcgctccagcctctctttatgtcagcaggctcctgtttccaccccaggatagcagaatcccttgattaaattcatatttgtttta

SEQ ID NO: 22779 - DNA, 400 bp, Homo sapiens
  misc_feature 7, 15, 32, 38, 39, 41, 44, 45, 48, 51, 55, 72, 79, 80, 98,103, 109, 120, 189, 244: n = A,T,C or G
gtctccnggctaatntatagcattatggtggncagctnnantgnngangcnctgnattcttcaacagtactntaccccnnactagttctctgtgccantgccnctcctnagaaagctaanttaggagacacaaaagagctagaagccttcattgctgatcttgacaaaactttagcaagtatgtgaaanaagaagttctgggtcctttcatcataagggagaagcttcagaaagttccggaggncctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgca

SEQ ID NO: 22780 - DNA, 260 bp, Homo sapiens
  misc_feature 2, 5, 36, 88: n = A,T,C or G
anagncccacttaccggttcattctttcactgtganggtctgcgcccagaattctcagtgacgtgggggtgagggtgggtggcgattnccttagagggaacccctaaattggttttggataagtttgagcccttgaccttaatttcattgctaccactctgatctcttagcacatttcttaggattaagggtccaaaaatgctgatctaaggggttgccatggtgttgaacaatgcaactttttatttaaaaaagctctg

SEQ ID NO: 22781 - DNA, 235 bp, Homo sapiens
  misc_feature 2, 13, 44, 46, 76, 207, 234: n = A,T,C or G
cnatctctactanaaatccaaaaattagttgttgcgtcggaggntnggaggccgtgtgatcccagctactggagangctgaggcaggaggattgcttgacctcaggaggcagaggttgcagtaagctgagatcacaccactgcattccagcctgggtgacagagtgagactctgtctcagaaaaaaagaaaagaaaagaaatgatantaaaaaaaaaaaaaaaaaaaaaaaaant

SEQ ID NO: 22782 - DNA, 400 bp, Homo sapiens
  misc_feature 11, 19, 48, 57, 61, 64, 82, 220, 231, 250, 314, 332, 362: n = A,T,C or G
ttatggtgggngagtgaangtgtacacgactcacatccttcatattgnaggggactnattnttntgcgcacttttttgatgngatgcttgacgtgaggcccgacactaggattctcaatgcaagaatccagtaccttgcacatagaagtagcaaccccatcccttgcctattttcatcttgctgttttcttttttttaaaaaatggatgtgacttgtttngaatgttttgnattatacttgtttttgggngggcataaattcattctgtaggatcttaagaaaaagagtcccagaatgttgcttctattattgngcacaaccattgagaggngttacaagaatgcaggtaattttaacatgnggggatgggccatgggggaaaagtactatcggaataac

SEQ ID NO: 22783 - DNA, 290 bp, Homo sapiens
  misc_feature 4, 16, 31, 37, 57, 68: n = A,T,C or G
ccanctcgaaaaagtncgtacaaaataatangcgaangcgccccaggagccgaactntgacagctgtnaacgatgccatccttgaggacttggtcttcccaagcgaaattgtgggcaagagaatccgcgtcaaactagatggcagccggctcataaaggttcatttggacaaagcacagcagaacaatgtggaacaaaaggttgaaactttttctggtgtctataagaagctcacgggcaaggatgttaattttgaattcccagagtttcaattgtaaacaaaattgcct

SEQ ID NO: 22784 - DNA, 336 bp, Homo sapiens
  misc_feature 8, 13, 251: n = A,T,C or G
agagggtngactngtaaaacaaggatcatcgatgttgtctacaatgcatctaataacgagctggttcgtaccaagaccctggggaagaattgcatcgtgctcatcgacagcacaccgtaccgacagtggtacgagtcccactatgcgctgcccccgggccgcaagaagggagccaagctgactcctgaggaagaagagattttaaacaaaaaacgatctaaaaaaattcagaagaaatatgattgaaaggnaaaaagaatgccaaaatcaagcagtctcctggaggagcaagttcccagcaggggcaaagccttctttgggggcatcgtttcaagg

SEQ ID NO: 22785 - DNA, 397 bp, Homo sapiens
  misc_feature 13, 35, 38, 61, 67, 68, 103, 210, 295: n = A,T,C or G
ccatttaatatangcattcaaaaatccctacattnggnatacttgaactgctattaataanggcagnnttatatatacaagcaaatatctattctcaaggggnaagtccactgacttattttatgacaagaaatttcaacggaattttgccaaactattgatacataagggttgagagaaacaagcatctattgcagtttctttttgcgnacaaatgatcttacataaatctcatgcttgaccattcctttcttcataacaaaaaagtaagatattcggtatttaacactttgtnatcaagcacattttaaaaagaactgtactgtaaatggaatgcttgacttagcaaaaatttgtgctctttcattttgctggtaggaaaaaacagaattaacaa

SEQ ID NO: 22786 - DNA, 251 bp, Homo sapiens
  misc_feature 14: n = A,T,C or G
actacatgtaaccnaaacaaaaatagcttcatgataattcaatagagaaaaataaataaatttgcactgaaacatggcacattgccaaatggctaaacataataatatcttgcatttagctactttttgacagcttaaaatatattttatatatatttacctaattttatctccttggagtaaggagaaaatgtcttattattactattttaaaaatgaggtagagagagattaacaagttgaaccataat

SEQ ID NO: 22787 - DNA, 176 bp, Homo sapiens
  misc_feature 62, 92, 111, 125, 151: n = A,T,C or G
attatggcgggggaaataccagtttccgagcggcaagaagccgatgccaatttttagtgcgnatgtggggaacaaagctggcggcttgattnaccagttggacagctaccncgcccacggcttgnaggcttgagaaaactttcagtaatcngctggatctgctgctcaagctacac

SEQ ID NO: 22788 - DNA, 382 bp, Homo sapiens
  misc_feature 7, 15, 28, 30, 34, 68, 82, 85, 92, 117, 122, 216, 326, 364: n = A,T,C or G
tttatgntgggcaangaagcagtttgtncnaatnatgacagcaaagtgaagaccttgtacagaatgangtgaaactttgctngtncaaaatngtttatttgccttttctttgtttgnaactnatctgtaaaaggtttctccctactgtcaaaaaaatatgcatgtataggtaattaggacttcattcctccatgttttcttcccttatcttactgncattggcctaaaaccttattttagaaaattgatcaagtaacatgttgcatgtggcttactctggatatatctaagcccttctgcacatctaaacttagatggagttgggncaaatgagggaacatctgggttatgccttttttaaagnagttttctttaggaactg

SEQ ID NO: 22789 - DNA, 400 bp, Homo sapiens
  misc_feature 8, 27, 28, 31, 35, 36, 74, 82, 85, 104, 114, 364, 367: n = A,T,C or G
cttcttgnctcagaacccccctttttnntgntggnnaagtccttttgacactgctctgacagccctgctctgcnctagccanctnacacaccgggcgctagatncaaggaatgncttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcaggagttacagttctgnggnttcatgttaagttaccttatagttactgtgtaa

SEQ ID NO: 22790 - DNA, 359 bp, Homo sapiens
  misc_feature 21, 25, 29, 49, 53, 84, 221: n = A,T,C or G
gagcgactattttatcctgancacnagcnattagtatgcctggtaaagngctnaaacttaaaagggctggccgggtgccggtgnttcaccgcctgtaatcccagcactttgggaggtcaaggtgggaggattgctttgagccagaagttcgagaccagcctgagcaacatggtgaaaccctgtctctaccaaaaatacaaaaattagccgggcgtggtggngcacacctatggtcctagttactcggaagactgaggcaggaggatcgtttgagctcaggaggttgggtcctgcaggtgagctatctatgatggcaccacttgcactttcagcctgggtgacagagtgagaccctttct

SEQ ID NO: 22791 - DNA, 400 bp, Homo sapiens
  misc_feature 10, 14, 29, 30, 31, 34, 43, 47, 48, 57, 60, 65, 68, 69, 72,73, 76, 77, 93, 217, 399: n = A,T,C or G
ttatggcggncaantatagcaagaattgnnngcntacttttgnaatnnagggagagntancaggngannggnncgnnaaaaccatcttatggntagctcaagtctctgccatttgtaatttttggctctaagctccgattggagacgcttctccttgtgcatgtgagttgactgatgttgtgagtgtaaatgcatttggttatttctggtatcgggnggccaccttggatggatttttttacattctgttccccagttacaggaaggagtccctttggtgtgtgaatatgtgtgcctgtagagggtggggcagggtggggtggggatggaaatgtgtggcatgcaccgtgagttgaaattcttttatgcattttttttgaagaaaaaaaaaaaaaaaana

SEQ ID NO: 22792 - DNA, 400 bp, Homo sapiens
  misc_feature 3, 7, 46, 66, 68: n = A,T,C or G
aanactnatgttagttgcccaattgagtgcttgatgagtttagatngacacgcgctgacagagaanantcccgagtagtaaatcatctttccaatccagaggaacaagcatgtctctctgccaagatccatctaaactggagtgatgttagcagaccccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgc

SEQ ID NO: 22793 - DNA, 400 bp, Homo sapiens
  misc_feature 2, 9, 32, 60, 130, 134, 158, 184, 186, 355, 357, 373: n = A,T,C or G
tncatagcnagttttctgaccagcctttgcgnggattttgaacagaactgctatttcctntaatgaagaattctgtttagctgtgggtgtcccgggggggggtgtgtgtgatcaaaggccaaagacagtntttngacaaaatacgaaggggagatttncactacattgtacaaggaatgaaagngncacgggtaaaaactctaaaaggttaatttctgtcaaatgcagtaagatgatgaaagaaaggttggtattatcaggaaatgttttcttaagcttttcctttctcttacacctgccatgccttcccccaaattgggcatttaattcatctttaaactggttgttctgttangncgctaacttagtaagngcttttcttatagaacccccttctgac

SEQ ID NO: 22794 - DNA, 400 bp, Homo sapiens
  misc_feature 7, 14, 82, 303, 380: n = A,T,C or G
tggactntactatntaataatatttgtgtcactaccttcttcagatagtaaggattataattagtacctctaatatttatgnttttaatcttttagtttgcctccatacagttaatctagaaggcttcacatgaagtcttatgttaggattgtgggccaggcatagtggctcatgcctgtaatcccagcactttgggaggcctaggcaggaggatcagttgaggtcaggagcttgagaccagcctgggcaaccgtggtgaaaccccatctctacaaaacatacaaaaattagccggagatggnggcatacacctgtagtctcagctacttgggaggtgaagtgggaggatcacttgagccctggaggcaagaggttgcangtgagcttgagattacgcca

SEQ ID NO: 22795 - DNA, 175 bp, Homo sapiens
  misc_feature 15, 16, 39, 55, 146, 150, 170: n = A,T,C or G
aaggcctcacgcctnnccttccttgatattgcacctttngacatcggtggggctnaccaggaattctttgtggacattggcccagtctgcttcaaataaatgaactcaatctaaaaaaaaaaaaaaaaaaaaaaaaaaaaattttngggncccccccgccccccaggggnttttt

SEQ ID NO: 22796 - DNA, 225 bp, Homo sapiens
  misc_feature 2, 6, 8, 16, 17, 44: n = A,T,C or G
tntgtntntaagtctnnagcctgattgcattgcctctagcactnagaaggccatctattaagagctttccagagaacattccccaaaaggccgatgggaatatctgtttggtgggtgtctccttattgtagaatggatacaacaggttatcaaacttgacaccattatacattcagattgtatttatcattgtttaagaaatatgtgtcttgtttcctcagttac

SEQ ID NO: 22797 - DNA, 399 bp, Homo sapiens
  misc_feature 2, 367: n = A,T,C or G
angttttagaaatgtgagaaaaacatccttttggaccatttgaaataagaaagacaaacactaaacaatacaaccatgaaattgatcaccgggattgcaaatctaattgggaaaagagttgagcaaacagcttggactgtttggagttgttgccttactttttaatatgtatttataaagtattccagcaaaagaggatgtagcctctgggaaaaaacaaacatgttacagtgttttttgtagattctcgttctatatctcatcacagcgccagccctgtttttagccggaaaggattcaggataaacattattatgcattctgaattggatgcatattcctaactactgtatttgttaccaaaagnggttctacaaatgctactgaaaaaaatctgga

SEQ ID NO: 22798 - DNA, 400 bp, Homo sapiens
  misc_feature 6, 19, 69, 249, 307, 350, 397: n = A,T,C or G
ctggcnacggatttgtgtntgtgacttttgtgaaagggtggaagcgacattgcctcaaagcatcttgcnttatgcaatttttatattaaccagatatatattcatcggtattcatccaagttaaatgtagagtttttaaacatcaatctttaaaccaattgctgctacttatataattgccaaaaagtgaaataatgtgtagttcatgtaaataatacattatatttctatttttattatgaagaaggngaatagccatatttgtaaaatgacaatcatgtgtgttaacccagtgctttccattcgngaaaacacatttgctttttgtgatatgcacaatgtagataagngttctgtctgactttcttttttgatatagaagataaagaattggggntat

SEQ ID NO: 22799 - DNA, 371 bp, Homo sapiens
gagtccgagtggagagagcgagctgagtggttgtgtggtcgcgtctcggaaaccggtagcgcttgcagcatggctgaccaactgactgaagagcagattgcatgaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctata

SEQ ID NO: 22800 - DNA, 400 bp, Homo sapiens
  misc_feature 5, 15, 59, 63, 301, 353: n = A,T,C or G
caagngattttgagnggggggccaatatggagcttacattatataattcctgctggggncganaagcacgctttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagnggactattaaatgtgcctaaatgaattttgcaggaactgggattcttggggntttcctacttaatacacagtaattcagaacttgtattctattatgag

SEQ ID NO: 22801 - DNA, 400 bp, Homo sapiens
  misc_feature 2, 15, 37: n = A,T,C or G
cnctctcggcctctnaatgcccttacctgagaatgangggatttaaaacactgatttaacattgaaaggccttattcaagtgcttgtaaatgctttcatttctggctgctttttgtttttcattttctttcagaagatttttctaacttagggtctgtcttgcatgtattacaaccagaatacagtgtttggaacctaaatctgtttgtgcgtctgcatcaaaggaacatttgcttcactgggtgataacctttgatgaaatgagatatgtccaagtaacgttaactgtgaagttacacacagtagctgacttcaaagtgcctgttctgtaaattttattttaaactgttaccatagtcttaagttgtttatgctttatcagactggctaatgtgaaagc

SEQ ID NO: 22802 - DNA, 378 bp, Homo sapiens
  misc_feature 41, 55: n = A,T,C or G
gcttggcctgaaactaaccctgagtgaattgcactgcaggntttacttaacgggnattccttatttgggatgtcaagagggcagctgcaaactgaaaaacaatccagtaaatgtactttgttttatgtattgtagcaggcaattagctactaaataatagctttgacatttgcaattgttgcatagagactatttttgctagaagatgattagctcttgcctttattttacagtgcttagtgcgataaacttctagtcatgtttcctatccaagagaccagttaatatatgtacataaaccacagaaatagtataacacactatttttaaattatcgttttcctacttaaattttgtttagcttaagacttcttagga

SEQ ID NO: 22803 - DNA, 400 bp, Homo sapiens
  misc_feature 10, 19, 28, 33, 36, 37, 127: n = A,T,C or G
cacccctgcncattttctncaagtagcntttgngtnntctagcatatctgagcaagtcttttcttttttcttcacatgacactgtaagcttaggcctgaaataactgggaagagagatgcgtatcangaatttctccgcaagagctaaacaaaacatacatcttccttagcatgaattggactgggggcggagtgggagggcttggaggaaaggggaaagaagggactatatttgaataaatatgaataaatgtattagatacttttcacaatcagataacttttaaaaaggtcattttttatctttctaataatgtaagccttaataaaagcaaatcttagtcacaaatttgaggagactgcccaataataagtttacatgtatttgaactgaaaaatt

SEQ ID NO: 22804 - DNA, 400 bp, Homo sapiens
  misc_feature 7, 18, 47, 65, 66, 69: n = A,T,C or G
ctagagnttgtggtgggnggagctttaatttattaatgcgaacagtncctaacagaacccacagnngcntaaactaccaaacctgcgttaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcccacgtgatctgagttcagacccggagtaatccaggtcggtttctatctacttca

SEQ ID NO: 22805 - DNA, 400 bp, Homo sapiens
  misc_feature 13, 14, 34, 48: n = A,T,C or G
aaggctgaaggtnntagcagattcacctacacangtctggaggatggntgcacgaaacacactggggaatggagcaaaacagtctttgaatatcgaacacgcaaggctgtgagactacctattgtagatattgcaccctatgacattggtggtcctgatcaagaatttggtgtggaccgttggcccttgtttgctttttataaaccaaactctatctgaaatcccaacaaaaaaaatttaactccatatgtgttcctcttgttccaatcttgtcaaccagtgcaagtgaccgacaaaattccagttatttatttccaaaatgtttggaaacagtataatttgacaaagaaaaatgatacttctctttttttgctgttccaccaaatacaattcaaatgct

SEQ ID NO: 22806 - DNA, 229 bp, Homo sapiens
  misc_feature 2, 6, 18, 76: n = A,T,C or G
gnactncatcatggaagnttcatttgttgcggaatatggaagcacctcccaatggtacggtgcaccctgtggtggncttggacagtatgtggaaacagaagctccatgacggtagaagacttctcattggggagcaacctttttgacgcacaacttttggtgcgtttttctagttttaataccttaaagctttttcaagacctaactgcagccgctttgggaaaaaaaa

SEQ ID NO: 22807 - DNA, 400 bp, Homo sapiens
  misc_feature 4, 13, 27, 29, 322, 353: n = A,T,C or G
cttntggcgcggncagtgaatagtgcngnattattttcaaattatgtaggaaagaaaaataactgttgagctatctttatgatcctcataaaactatctttccagaacaaagtaaaaataaagacttgttcgcacaaagagagtctgaaagagcattttaccaacagactttcgctagtagaatttctgaaggacacacttcaggaagataaataaacatgattctagaagggcggctggagagtagagggcatgtaaatgcagatggctctaacaagcgttagctttataaactaatgcaccactgttgactgtgtccagngtcttaggttaagaaaaaacagacacagcgngctgaaaacaatagcttacaattcagaatgaggtgagtggatgtaaa

SEQ ID NO: 22808 - DNA, 400 bp, Homo sapiens
  misc_feature 7, 21, 49, 55, 220, 345: n = A,T,C or G
gagtgancacaaatggctgtntcctttgaaagtgctattacctgtgggntgaagngaatttttaagaagtaccctaccaaaataatggtagaattttgaaaattgtttaaaatacaaagatcaagtcaaaacattgtttcaaaaagaaggatctagaaatagagacatcagtcaaaatcaagaatttctctcattctggcctggggtagtggcttatgcntgtaatcccaacactttggcaggctgaggcgggctgatcacttgagatcaggaattcaagaccagcctggtccacatggtcaaaccctgactctactggaattacacaaattagccaggcatggnggcacacacctgtggtcctagctatttgggaggccaaggatgagaattgcttgaa

SEQ ID NO: 22809 - DNA, 284 bp, Homo sapiens
  misc_feature 2, 6, 125, 145, 253: n = A,T,C or G
tntttnacaaacccgatatggctgagatcgagaaattcgataagtcgaaactgaagaagacagagacgcaagagaaaaatccactgccttccaaagaaacgattgaacaggagaagcaagcaggngaatcgtaatgaggcgtgcncccccaatatgcactgtacattccacaagcattgccttcttattttacttcttttagctggttaactttgtaagatgcaaagaggttggatcaagtttaaatgactgngctgcccctttcacatcaaagaactactgac

SEQ ID NO: 22810 - DNA, 343 bp, Homo sapiens
  misc_feature 9, 16, 27, 33, 47, 50, 58, 59: n = A,T,C or G
tgagcctgnatgtgcncacgaagttgnggagantgatggacattccngangaatgaanngaggcattccgaacttctggaaatgggagttgctcagtctgtgcaagtcaagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggct

SEQ ID NO: 22811 - DNA, 281 bp, Homo sapiens
  misc_feature 9, 10, 30, 37, 50, 51, 53, 60, 151: n = A,T,C or G
ctctaaggnntatctgtttgagtatatccntttggangaccttgctgggnngngcctggncactaacaattctacaccaaattgtctcttcaaatacgtatggactggataactctgagaaacacatctagtataactgaataagcagagntcaaattaaacagacagaaaccgaaagctctatataaatgctcagagttctttatgtatttcttattggcattcaacatatgtaaaatcagaaaacggggaaattttcattaaaaatattggtttgaaat

SEQ ID NO: 22812 - DNA, 227 bp, Homo sapiens
  misc_feature 6, 21, 26, 28, 29, 33, 219: n = A,T,C or G
tagagnaatatggtaagggcnccatngnnggcnacaatttaacatatacaaacctgacctggtttatttttaaacttctatatatttaagcacttaagctgacattaaacttttgtcttgcttcaaaaataattttgaaaattatagcaaatgcaaaacaaactgcaatctaagcatcatgcttaatttcagaattctcaaattacttgcccttaagtngaaattta

SEQ ID NO: 22813 - DNA, 161 bp, Homo sapiens
  misc_feature 2, 5, 11, 12, 13, 14, 15, 18, 19, 29, 52, 54, 55, 56, 57,93, 104, 141, 146: n = A,T,C or G
anaanaaaaannnnnggnncgaggggggncagacacctgtagttccagctantnnnntggctgagacacaagaatggcttgaacccaggaggnggaggatgagngagccaagatagcaccatcacactccagcttgggcancaaancaagactccgaaaaa

SEQ ID NO: 22814 - DNA, 400 bp, Homo sapiens
  misc_feature 9, 17, 28, 31, 39, 61, 78: n = A,T,C or G
gtagaaacncagtattnattgccgcagnaancactagtnatcaaatgattagccttttgtntcagagatgaatctttnctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcagg

SEQ ID NO: 22815 - DNA, 109 bp, Homo sapiens
  misc_feature 2, 7, 28, 30, 36, 56, 66, 71, 91, 106: n = A,T,C or G
tnttttntttttgaaagttagagtttantncacctncttaaaaaatatagccaatnggttactaanatatngcttagcgttaagtttttanccgtaattttaatanctt

SEQ ID NO: 22816 - DNA, 211 bp, Homo sapiens
  misc_feature 12: n = A,T,C or G
ttatggccggcnaaagtattgtacaaataagtgtgcggtatctgtgaactgaattcaccacagcactttagctttctgagcaagaggattttgcgtcagagaaatgtctgtccatttttattcaggggaaacttgatttgagatttttatgcctgtgacttccttggaaatcaaatgtaaaagtttaattggaaaggatgtaaagcaccca

SEQ ID NO: 22817 - DNA, 372 bp, Homo sapiens
gagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattc

SEQ ID NO: 22818 - DNA, 365 bp, Homo sapiens
  misc_feature 60, 326: n = A,T,C or G
gttttattattgactataataattagtttaattagctttgcaaactgatggcatcaaggnaaatatatttttgccaaagttctggccttccaaaactcacccccttatttaaatgtgtgctatgacccactatgacacagcatctgcattttctaaaaaattccatgcaggtgttttggggagaggtattttttaagcaatgaaaattcaactgagtacaaagccccctcttggggggttggggaagtctcttttttgaaacacttcagaactgctgctataaagaaattctctaattggttgaattttttttttaagtaaatagnactttaggccaaaatttatatgaatatttgatcttcttg

SEQ ID NO: 22819 - DNA, 287 bp, Homo sapiens
gaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaagg

SEQ ID NO: 22820 - DNA, 103 bp, Homo sapiens
  misc_feature 60, 87, 90, 101: n = A,T,C or G
ttaccccgggtaattcgttcttatggcggggggaacataatctagtttacaggaaaaatnttgtgctagaatactttttaaaaggtnttntgaataccatnaa

SEQ ID NO: 22821 - DNA, 387 bp, Homo sapiens
gtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataa

SEQ ID NO: 22822 - DNA, 365 bp, Homo sapiens
  misc_feature 10, 318, 327, 350: n = A,T,C or G
gaaagaaaanaagaggcctgtggacagaacaatcatgtctgactccctggtggtgtgcgaggtagacccagagctaaaagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggttcgtggtttacagctacaagtacgtgcatgacgatggccgagtgtcctaccctttgtgtttcatcttctccagccctgtggnctgcaagcngggaacaacagatgatgtatgcngggagtaaaaacagg

SEQ ID NO: 22823 - DNA, 389 bp, Homo sapiens
tgcaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggag

SEQ ID NO: 22824 - DNA, 318 bp, Homo sapiens
  misc_feature 1, 4, 8, 23, 304, 309, 316: n = A,T,C or G
nttncagnagtgattcatctagnaggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcaggaaggaatatctcggtgccatttgctcctgcacatgctttggaggccagcggggctggcgctgtgacaactgccgcagacctgggggtgaacccagtcccngaagnccctacntg

SEQ ID NO: 22825 - DNA, 123 bp, Homo sapiens
gaggaaaatggggagcaggaaggctgacaatgaggtagacgaagtaagaggaagaaggtggggaggaagaggaggaggaagaagaaggtgatggtgaggaaaaaaaaaaaaaaaaaaaaaaaa

SEQ ID NO: 22826 - DNA, 309 bp, Homo sapiens
  misc_feature 159: n = A,T,C or G
cttatggcgcggggagtaaagttactgttcaacttagttacaatgagttttaatagcgtcccagtgctacattttatttttcaagcttgtactcacggtttagttttttctagttgttagtgattgcaattatcaggatgagcctccttttagcagagngaacccctttttaaaggccactttaacaacaaccaccaatatattgtttagagacggtttctgtctagtgtaaaacttgagtggtctgactctaataaatggttttgaaatgtgtgactggtattataaaatttgtgaataaaacatatt

SEQ ID NO: 22827 - DNA, 267 bp, Homo sapiens
  misc_feature 3, 20, 35, 90: n = A,T,C or G
ttntccccgggtattcgttnttatggcgggcgatngtaatgttctcaatagttaaaatctacaacctcccataatccctctattcccagntatcaaaaaggatctcaccttccttcacgaaggtaaacataaggcagagggtttccatctttgcttgaagaagcacagaataaatgccatgtgatttccttttcctcctctgtcaatttcaggaaatgactcaaaagtagacgggctggtcaattttgagaagctaaggatgattgc

SEQ ID NO: 22828 - DNA, 375 bp, Homo sapiens
  misc_feature 353: n = A,T,C or G
gctctttttccggctggaaccatggagggtgtagaagagaagaagaaggaggttcctgctgtgccagaaacccttaagaaaaggcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcnttcttcgccttcgtcaaatctt

SEQ ID NO: 22829 - DNA, 367 bp, Homo sapiens
gcaggtagctgggacctaggctatcttaccatgaaggttgttttgcttattgtatatttgtgtatgtaggtgtaacctattttgtacaatagaggactgtaactactatttgggttgtacagattgaaatttagttgtttcattggctgtctgaggaggtgtggacttttatatataggatctacataaaaactgctacatgacaaaaaccacacctaaagaaattttaagaatttggcacagttactcactttgtgtaatctgaaatctagctgctgaatacgctgaagtaaatccttgttcactgaagtcattcaattgagctggttgaatactttgaaaaatgctcagttctaactaatgaaat

SEQ ID NO: 22830 - DNA, 368 bp, Homo sapiens
  misc_feature 35, 207, 208, 210, 228, 259: n = A,T,C or G
atcaaaagcgagcaggagtagctgttcttatatcngacaaaacggactttaagacaacagcagttttaaaaagacaaagagggacattatataatgataaaaggactagttcaacaggaaaatatcacagtcctaaatatatatgcacctaatactggagatcccaaatttataaaacaattactactagacataaagaaatgaggnngntggcaacacaataatagngggggatgttaatactccgctggcagcccgnggcagatcaccaagacagaaagtcaacaaaggaaacaatggacttaaactataccctgggacatatggacttaacagatgccttacagaacattctacccaacaagcat

SEQ ID NO: 22831 - DNA, 369 bp, Homo sapiens
aagtgagtgtggaagaaaacagcagttcttttataattgcttgaaattaggaaagcgcttatttcctagaagcaaataaatgtttaagtaaataaaggctacattttgctgagtactgtttcagtcaattttagaattgcctattctaattgctgtctacaactttttgcttaataaaagaattaacttataggaagtaaaatactttgatagttacagaactggggctaattttgactggagaaaagactaattatgaaatgtgggttgaaacagaccataaaaaggttatattatctatttacctgagggtttcctaaacctggggtaaaattaaaatactggagttttcctctttttcatgtttac

SEQ ID NO: 22832 - DNA, 285 bp, Homo sapiens
  misc_feature 242, 257, 267: n = A,T,C or G
catcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcacccacacaacaagcccagctggcggcagcagctgaattcgatgaaaaaccagtcagtaaagcaaaacggagtcggngtgaaaaagaaggcncggaaggttntgtcccaaaactgggtct

SEQ ID NO: 22833 - DNA, 389 bp, Homo sapiens
  misc_feature 1, 384: n = A,T,C or G
naatgacttcagctctgtttttagctagaaactctaaaaacaaaaataataataaagaaaaataaataaaaaggagaggcagacaatgtctggattcctgttttttggttacctgatttcatgatcatgatgctgcttgtcaacaccctcttaagcagcaccagaaacagtgagtttgtctgtaccattaggagttaggtactaattagttggctaatgctcaagtattttatacccacaagagaggtatgtcactcatcttacttcccaggacatccaccctgagaataatttgacaagcttaaaaatggccttcatgtgagtgccaaattttgttttcttcatttaaatatttttctttgcctaaatacatgtgagaggagntaaat

SEQ ID NO: 22834 - DNA, 372 bp, Homo sapiens
gagcatcaggtatattctggaccatttcaagtgctggtgagaagaaaggaactctttgcctgaactgggcttggttttccaagtgctgctttggaaatgaagacccagagatgcagagcttatggtagttcataaatcttcatgttctattatctttcatctgccaataaagttcattttcaataatgtccaccattgctgtgcccagaataaccacaggcaaacatcaaaacaatacgcataagttagacaagattaaatcttgtctgatatctgcacaaacagatatgcaccatgttggaaacatgtgttttcctagtcccatccaggcttcccacaagaaagccatgatgtgggtctaaaccatatgtt

SEQ ID NO: 22835 - DNA, 380 bp, Homo sapiens
  misc_feature 67: n = A,T,C or G
tatgaagagcatagactgcatccgagccttccgggaagaagccattaagttttcagaagagcagcgntttaacaacttcctgaaagcccttcaagagaaagtggaaattaaacaattaaatcatttctgggaaattgttgtccaggatggaattactctgatcaccaaagaggaagcctcttggaagttctgtcacagctgaggaagccaaaaagtttctggcccccaaagacaaaccaagtggagacacagcagctgtatttgaagaaggtggtgatgtgggacgatttattggacatgatataggtcgtggatgtatggggaatctaagagagctgccatcgctgtgatgctggggagttctaacaaaacaagttgga

SEQ ID NO: 22836 - DNA, 388 bp, Homo sapiens
  misc_feature 144, 177, 179, 206, 208, 329, 373: n = A,T,C or G
gttcttccggggacgttgtctgcaggcactcagaaatggtccagcgtttgacataccgacgtaggctttcctacaatacagcctctaacaaaactaggctgtcccgaacccctggtaatagaattgtttacctttataccaagnaaggttgggaaagcaccaaaatctgcatgtggngngtgcccaggcagacttcgaggggttcngngctgtaagacctaaagttcttatgagattgtccaaaacaaagaaacatgtcagcagggcctattggtggttccatgtgtgctaaatgtgttccgtgacaggatcaagcgtgctttcctttntcgaggagcagaaaatcgttgtgaaagtgttgaaggcacaagcncagagtcagaaagct

SEQ ID NO: 22837 - DNA, 368 bp, Homo sapiens
  misc_feature 168, 277, 340: n = A,T,C or G
gctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggnggcaattcaccgaattcgaatcaccctaacaagccgcaacgtaaaaatccttggaaaaggtgtgtgcttgacttgataagaggcgcaaaagaaaagaatctcaaagtgnaaaggaccagttcgaatgcctaccaagactttgagaatcactacaagaaaaactccttgtggnggaaggttctaagacgtgggatcgtttc

SEQ ID NO: 22838 - DNA, 371 bp, Homo sapiens
ggggcattcctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgcccgtgtgaaccatgtgactttgtcacagcccaagat

SEQ ID NO: 22839 - DNA, 400 bp, Homo sapiens
  misc_feature 21, 22, 31, 120: n = A,T,C or G
tttggtcccgggtaattcggnnattatggcngaggagtattgttttgtttattttgttttgtgggagttagtccaggtcttgatcagttcatgcccctaatttgctttcaccatgctatnccttcaagatgctgaaataccagaattaaaagtagaaagttcctgttgatttttagatgccttaaatattaaacatttaaattaactaatggaaggtgaagtacgataaaccaaatcatcaagtaaactgagattcatttctgtttcgttctgcagtaagtcatgtgatattttcctgggaaaattcatatccttaattatctttggtttgcaataatattaaaataactgcatttcctgagtacaatttcaattgtgccattaagggatgtgggggttc

SEQ ID NO: 22840 - DNA, 225 bp, Homo sapiens
  misc_feature 17, 19, 32, 34, 46, 53, 70, 88, 104, 105, 222: n = A,T,C or G
tttccccgggtattcgntnttatggcgggcgnanagcagagccggnaaaactngtgccagcaaccgcggntaaacgagaggctctagntgatatactacggcgnnaagggtgggtaaggaacaatgtaaaataaagccaaacggccctttaactgttatacgcttttagatgctagaggcccaaacacgaaagaggctttaaattaattacctgaacccccngaa

SEQ ID NO: 22841 - DNA, 370 bp, Homo sapiens
  misc_feature 19: n = A,T,C or G
tattgtgcttcacctcagnaaggtggaagaagaagaggacgagtcagcattaaagaggagcgagcttgttaactggtacttgaaggaaatcgaatcagagatagactctgaagaagaacttataaataaaaaaagaatcatagagaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctaga

SEQ ID NO: 22842 - DNA, 270 bp, Homo sapiens
  misc_feature 18: n = A,T,C or G
attttgtgaacttaaagnagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaagtgaaaatataaaataaagaagaaaatctcggggagtttaaaaaaaatgcctcaatttggcaatctacctcctctccccaccccaaaaaa

SEQ ID NO: 22843 - DNA, 371 bp, Homo sapiens
atatggaatcaaaaagagcctgcattgccaagtcaatcctaagcaaaaagaacaaagctggaggcatcacactacctgacttcaaactatcctacagtgctacagtaaccaaaacagcatggtactggtaccaaaacagagatatagaccaacggaacagaacagagccctcagaaataatgccccatatctacaagaatctgatcttttgcaaacctgacaaaaacaagaaatgggggaaatgattccctatttaataactggtgctgggaaaactgtctagccatatgcagaaagctgaaactggatcccttccttacaccttatataaaaattaattcaatatggatttaaagacttaaatgttagac

SEQ ID NO: 22844 - DNA, 375 bp, Homo sapiens
  misc_feature 32, 67, 84, 87, 112, 278, 308, 323, 358: n = A,T,C or G
tggagggatcctgtgaagtattgttaggaggngaacttcactacatgttaagttacactgaaagggntcatgtgcttttaatgnagnctaaaagccaaagtatacgcgactnagaatcctcaatccacaaaactcaagattgggagctctttgtgatcaagccaaagaattctcatgtactctaccttcaagaagcatttcaaggctaatacctacttgtacgtacatgtaaaacaaatcctgccgcaactgttttctgttctgttggttgtggattnctcatatgtatacttgggggaattgtaagnggatttgcaggccangggagaaaatgtccaagtaacaggtgaaggtttantttgcctgacgtttact

SEQ ID NO: 22845 - DNA, 376 bp, Homo sapiens
  misc_feature 11, 24, 88, 245, 318, 331, 335: n = A,T,C or G
ggcgcaatagnatatagtaccgcnagggaaagatgaaaaattataaccaagcataatatagcaaggactaacccctataccttctgcntaatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggngatagctggttgtccaagatagaatcttagttcaactttaaatttgcccacagaaccctctaaatccccttgnaaaatttaactgntagnccaaagaggaacagctctttggacactaggaaaaaaccttg

SEQ ID NO: 22846 - DNA, 382 bp, Homo sapiens
  misc_feature 374: n = A,T,C or G
atatttatgtagatatacttccatgaaagggctaatacgatgcctatactgaagggcaaggactttgaccctgtcaattttcagccgagaatggtcagaaagatcagtacaaccccatggattaggctgaaacatatgaaattgctgcatttgtaagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctggttttcaatatcatacatttggggtatgtcaaagaataaattagtaaattaggnaaatgaaa

SEQ ID NO: 22847 - DNA, 313 bp, Homo sapiens
agtcaaaagcctgggtgagaatcctgcctctccccaaacattaatcaccaaagtattaatgtacagagtggcccctcacctgggcctttcctgtgccaacctgatgccccttccccaagaaggtgagtgcttgtcattggaaaatgtcctgtggtgacaggcccagtggaacaagtcacccttctgggcaagggggaacaaatcacacctctgggcttcagggtatcccagacccctctcaacacccgccccccccatgtttaaactttgtgcctttgaccatctcttaggtctaatgatattttatgcaaat

SEQ ID NO: 22848 - DNA, 230 bp, Homo sapiens
  misc_feature 19, 32: n = A,T,C or G
gtctcccgggtaattcggncattatggcctgnctaattaaaatgtgccgtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgttt

SEQ ID NO: 22849 - DNA, 372 bp, Homo sapiens
atgtggtaggtggatcaaatggccctcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaat

SEQ ID NO: 22850 - DNA, 343 bp, Homo sapiens
  misc_feature 9, 11: n = A,T,C or G
taattcggntnttatggcggggataggtttggtcctagcctttctattagctcctagtaagattacacatgcaagcatccccattccagtgagttcaccctctaaatcaccacgatcaaaagggacaagcatcaagcacgcaacaatgcatgctcaaaacgcttagcctagccacacccccacgggaaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccta

SEQ ID NO: 22851 - DNA, 372 bp, Homo sapiens
  misc_feature 326: n = A,T,C or G
atagcagacaacacagtagcgatggaggtgacgtagcttcctccgagtggaactgcagcctggggacttgattaggtgctatgcttcagtagcattttgaatgcaagggatgatggaaagcagcacatgcgtttctgtggcagctgtggggacttgacagcaatgctcatctctcatgcttcaatttttcttttcttactgttaataggaaaaaaatcaacatctgtaaattaagaatacagcaattatctgtacagtactgcatatttgtaatacccttgtatatatgttacttgaatacagaaatgttcatttgtgatgctttnacttgggggtggggggtgggagggaaatcaattgcaacaaagagtg

SEQ ID NO: 22852 - DNA, 376 bp, Homo sapiens
aactcacagcttctccaagctcaccctgggagtttcctgagggttttctcataaatgagggctgcacattgcctgttctgcttcgaagtattcaataccgctcagtattttaaatgaagtgattctaagattttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatt

SEQ ID NO: 22853 - DNA, 376 bp, Homo sapiens
  misc_feature 11, 13, 15, 23: n = A,T,C or G
ctgcccccagnangnacaaaagnaacagatattgtggatgaagccatctattacttcaaggccaatgtcttcttcaaaaactatgaaattaagaatgaagctgataggaccttgatatatataactctctacatttctgaatgtctgaagaaactgcaaaagtgcaattccaaaagccaaggtgagaaagaaatgtatacgctgggaatcactaattttcccattcctggagagcctggttttccacttaacgcaatttatgccaaacctgcaaacaaacaggaagatgaagtgatgagagcctatttacaacagctaaggcaagagactggactgagactttgtgagaaagttttcgaccctcagaatgataaac

SEQ ID NO: 22854 - DNA, 385 bp, Homo sapiens
  misc_feature 81: n = A,T,C or G
gtatgggggaactgcccccatgattcaattatctccacctggccctgcccttgacacgtgggggttattacaattcaaggngagatttgggtggggacacagccaaaatatatctggcatatgcaatctgatcaccccttccaaacttctctcttaaaaatgcaacattctgacagcatgtggaggcttggatggaaacacggtaaaaattacaacattgtttctcacacttttgcaccaaagtgatacaaatcgcagagctgaggcaactggtgtttctgcgagaatggaatggaatgtggttgaaattttgtgttgttttttaaatatttgcaacctatttgtcattcttccataaaaatcagaattcatgggtgtgtacata

SEQ ID NO: 22855 - DNA, 372 bp, Homo sapiens
gaaaatggagggataacattcttccctgtccaagtcaatgttggggggcaggcacaagctgtgacaggctccatccagcccctcagtgctcaggccctggctggaagtctgagctctcaacaggtgccaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaatctggacctgctttgaattctccataa

SEQ ID NO: 22856 - DNA, 367 bp, Homo sapiens
atccctttcttccctaatcccctggcaaccattttaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttct

SEQ ID NO: 22857 - DNA, 370 bp, Homo sapiens
  misc_feature 95, 177, 207, 208, 229, 282, 305, 337, 361: n = A,T,C or G
cagaaaggtgattccaggaggagttagccaaacaacaacaaaaacaaaaaatgtgctgttcaagttttcagctttaagatatctttggataatgntatttctattttttatttttttcattagaagttaccaaattaagatggtaagacctctgagaccaaaattttgtcccatctntaccccctcacaactgcttacagaatgggnnatgtcccccttatgttgaggngaccacttaattgctttcctgcctccttgaaagaaagaaagaaagaagactgngtttttgccaccggatttagccntgtgaaactcatctcattacccttttctgggnttgaagctgctgtctcttagaagngccatctca

SEQ ID NO: 22858 - DNA, 368 bp, Homo sapiens
gagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcac

SEQ ID NO: 22859 - DNA, 365 bp, Homo sapiens
ggaccaagcctttaaatatataacagaattgaaaaggcaaaatgatgaactcctgcttaatggaggaaacaatgaacaaggtaaagatttaaaagttcttactttttgttgtattttaaaatgtttaggtgtttgtgtcacagtgaaatttatattatgacatagaaagctttttggccccaaaacattattaagaccctgcattcagtgggtcttggaagaataatgttaccaataaattcattttagtctaactctttctcctctgtgagcacctcttatcttgtaggcatacataagttttgactttgaactcttctgtgtatttcatgtttgcctaactcatgatactagtaatgctaaat

SEQ ID NO: 22860 - DNA, 367 bp, Homo sapiens
  misc_feature 255: n = A,T,C or G
gatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggntaaaaaataaatttgttataaaaattctgtttgcaaattaaactggaaagtatccagagtctcaaaaggcaatgatttgggagataatatggcatgccccggagccctgctc

SEQ ID NO: 22861 - DNA, 365 bp, Homo sapiens
  misc_feature 102: n = A,T,C or G
caggaggctggctcctcaagctacccatgcccagcgccctaaagcaggaccagatgctttggaattggggtgaaacacccacatggcagcctgctagcagcngtgactttgacttctggtcttaaagagtccctcacttcagccccaggagctattggtgggttttagcagttttgtctttaccgtttttagttctccttgattctttgttttcttcctttatcgtttttaggtttggtatgtgttgttttatttccatggttcctcaagtttcctttttaaacatttgcatttgctggacaattgcaattttttttaaaaaattcccctacccctgtttaaagctgaaaaatacatttggttca

SEQ ID NO: 22862 - DNA, 371 bp, Homo sapiens
gggctttccagggtaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataggtacatccaggttgtctaccttcataacaacaatatctctgtagttggatcaagtgaccttctgcccacctggac

SEQ ID NO: 22863 - DNA, 230 bp, Homo sapiens
  misc_feature 193: n = A,T,C or G
gaggcgggtggatcacgaggtcaggagttcgagaccagcctggccaatatggtgaaaccctgtctctactaaaaatacaaaacttagctgggcgtggtggtgtgcatctgtagctgtgtgggaggctgaggcaaggagaatcgctggaacctgggaggtggaggtttcagtgagctgagatcgtgccactgcnctcccgcctgggcaacagagcaagactctgtctgaaa

SEQ ID NO: 22864 - DNA, 372 bp, Homo sapiens
  misc_feature 18: n = A,T,C or G
aacgtaaagcagtttgcnaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgcttgttctttggtccacccggtacaggcaagacactctgtgcgccgggcagttgctaatcggactgatgcgtgct

SEQ ID NO: 22865 - DNA, 158 bp, Homo sapiens
  misc_feature 3, 4, 31, 65, 84, 86, 95, 119, 143: n = A,T,C or G
ggnnaggaaaaagttaaggtggtaaaatgcntgtcatgtgcattttaccacaaaaaaaaaatggngtaaaaattcaaccagatntntcggagatntgatattatgggatttttaaaagnctctttttaatacattcatttttngaaaaagaggggaaa

SEQ ID NO: 22866 - DNA, 400 bp, Homo sapiens
  misc_feature 5, 17, 45, 57: n = A,T,C or G
acccngggaattcggcnttatggccggatccaaaatatttaggcntctgacattttnaaccagaatttcaattatatactgtgatttttatttgttgcaatacattacaatttcagaggtactttggggctcaaaagctaggatttctaagtcagtatgtgcatttcacacgataaagctgttaatggtgagcaaagtattatatactaactagatttttccacatctgtatagtatattatatgtattttgtggtattgagagtatagaaagtttagagtgtcaaacatgcgtttaatgtgtatttttaaacaaatttatggcaattaaaatatttggagacaagggtatcacatttcaatttgtaaagatctttttaactctactgtgtcattaagat

SEQ ID NO: 22867 - DNA, 365 bp, Homo sapiens
ataggtgagctggtaaagcaggcccttcatctgaatcttgcttaaagccttgatatctaaaaacataaggaaagagcagctttaggttgagactgatgatgcttcaaaccacttgcctaactacaaacctaaaaatatttaccctaaaatgcagtgtaagggccgggaagggtggttcacacctgtaatcccagtactttgaggcgccgaggtgggagggttgcttgagctcgggagttcaaggccagtctgggtaacatagcgagacccctgtctctacaaaaaataaaacaattagccaggcatggtggcacatgcctgtggtccccataactcgggagactgagacaggagaatcgtttgaa

SEQ ID NO: 22868 - DNA, 377 bp, Homo sapiens
  misc_feature 4, 55, 110: n = A,T,C or G
gganacaacaccaaaaggcttcttattcgggtgtgagtcttttcagcaacccggnccagtactgggagatacagccatccaccttcagatgtgtctacgtgcgctctgcnattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagat

SEQ ID NO: 22869 - DNA, 376 bp, Homo sapiens
cagtgcaagcctcagaagtgacttgtctcaattcacaacttgtcttgatcttttgcagaacctaaaatttttccaaatgtgagtctggatggaacatgaggtagtgcagaatgattgaggaaagtctaacttataagtcaaatctataataaaaatggttacaaacacgtactaaaataaatatcttactttattccagagactttgccaagcactttacatgtgtaactcaattagatttactgcagtctaggtggtaggtactattgttatcctggttttatacataccaaggcgtcaggagattaagtaacttagaaagtaagaggaaaatctggggttttgtaccatgctcgtcccaaagggcaacatgact

SEQ ID NO: 22870 - DNA, 316 bp, Homo sapiens
  misc_feature 217: n = A,T,C or G
caggtgcccagtgaatatgagcttctctgaactgactgaagaccacaagatgaaaactggaaactcgcagccttcatacaacaaggcatctggtatggaagcgttcagtgcgggcttctctggctgatacactcgccatggaccttgctatccctgagctgggaccctaatggatgtgcatgagtttgtctccaacttgtaaaaaatgtgcttttgnaagaatgagtgaatcacagactgaaagaatatatttacaatgcatacacctgacaaaggtttcacatccagaatatataaagatttcctagaaatgcgc

SEQ ID NO: 22871 - DNA, 245 bp, Homo sapiens
  misc_feature 31: n = A,T,C or G
gatctatcctttacggcagggtacctacggnacctgaaaacaacgatggcatggaaaacacttcccatttacctgttgttgctgctgtctgttttcgtgattcagcaagtttcatctcaaggtagcttaaccatcgaacatacttttatttaacaactattgctaatcattcagtcttgatttttataacaaaggaaatatatttctaaaaatttatatttgcctgagtttaatatactgtacaa

SEQ ID NO: 22872 - DNA, 372 bp, Homo sapiens
attgacacggaggaagatctggagagacagctacaggacaagctaaatgaatcagatgaacagcaccaggaaaatgaaggaaccaatcagctggttatgggaattcagaagcagattgacaacatgaaaggcaagctccaagagacccaggacagggcaaaacgacaagaggatctcatcatgaaagtggaaaatctggctctcaagaacagatttcaggctgtacctggatgagctcaaacaaaaggaagaccgagaaaaggagcaactcagctctttgcaagaggagctagaatcactcctagagaagtaaaaagaactgatatttaatttttcagtcttcagactggtcagcattagaaaattcttggc

SEQ ID NO: 22873 - DNA, 363 bp, Homo sapiens
  misc_feature 24: n = A,T,C or G
gagttttggcctgggtaaccgagnagtgaccgccatcttgcgtacggagatgtcttatggtgaaattgaagaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtgggaagtggccataggaaaaggatacagagtaggagtttcatgaacctgaaacttggtggaaatttgatcctgaagaattagaaa

SEQ ID NO: 22874 - DNA, 376 bp, Homo sapiens
  misc_feature 367: n = A,T,C or G
gtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtatttgaaaacacttagtatgcagttgataagaggaatttnggataatta

SEQ ID NO: 22875 - DNA, 135 bp, Homo sapiens
  misc_feature 7, 18, 32, 33, 78, 103, 121, 123: n = A,T,C or G
ttcggtnttatggcgggngtttacccttttcnngaagttgtaccaaaacatccacttaagttctttgatttgtaccanttccttcaaataaagaaatttggtncccaagaaaaaaaaaatnanaagaagtttctt

SEQ ID NO: 22876 - DNA, 377 bp, Homo sapiens
  misc_feature 68, 208: n = A,T,C or G
ataccagctcatgaatggatcattacagtctctccagaggcttagaatgattcagaatgttcaatgcntagttctcaataaacaggaggcagaatttttaatgggtatttcttttcagatatatgattggcctctaggtttttgataataatatggtcttaaattcataattactagcagagattgataatttggaaacaatggtagngaatgaaactgaagttgaaaaacggctgctacttatgtcactaatcagaccatatgaatagcagaagttgagcaatttcaaagtaaaactgatatttttatttccaaaggaatttagacatttgaaaataattgacatacattaagttttaattcgataatttcttata

SEQ ID NO: 22877 - DNA, 400 bp, Homo sapiens
  misc_feature 2, 3: n = A,T,C or G
gnnttatggcggggggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaaattttgacactgaaaaacattttattaataaaggaatattgacatgag

SEQ ID NO: 22878 - DNA, 113 bp, Homo sapiens
  misc_feature 4, 7, 31, 32, 34, 38, 42, 43, 47, 48, 57, 68, 73, 78, 87,97, 98, 100: n = A,T,C or G
gccnggntttgtccgtctgttgagccaaatnngngttnctgnngggnncctgcattnttgcttctgtntgagncatgnatattaacncagctcctannanagtttgggcatta

SEQ ID NO: 22879 - DNA, 183 bp, Homo sapiens
  misc_feature 6, 17, 153: n = A,T,C or G
aaaganaaaccttgaantctggttaggctggtgttagggttctttgtttttggggtttggcagagatgtgtttaagtgctgtagccagaagcggggggagggggggtttggtggaaattttttgttatgatgtctgtgtggaaagcggctgtncagacattcaattgttattattgtgaaaaa

SEQ ID NO: 22880 - DNA, 277 bp, Homo sapiens
  misc_feature 7, 18, 27, 34, 38, 45, 54, 62, 72: n = A,T,C or G
gaagacngcaatctagcntggcaaganaggcccntgcnccagctnaacctcacntgaaggangaagtaagantgataaaatgggaaataggatagaagaaggaaaacagcatgagtagaaacagatatggcacacgaatgtactccatttgtgtatatgtaccatattttctttatccattcatattttgatggacatttttttgctttctcatcagttgcggtgagccgagatcacaccactgcactccagcttgcgtgacagagcagactctgtc

SEQ ID NO: 22881 - DNA, 372 bp, Homo sapiens
gcttcctttctgggctcggaacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgccttggacgtacaataccacttccgctgtcacggtaaagtccgccatcagaagactgaaggagttgaaagaccagtagacgctcctctactctttgagacatcactggcctataataaatgggttaattttat

SEQ ID NO: 22882 - DNA, 359 bp, Homo sapiens
  misc_feature 349, 352: n = A,T,C or G
tattgttcttccctgttatctgctttatagagagaagtttgtgtggtgggacagattttttaaacacactcatacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttatttttatttttggctgctcgggtaacctttagcccttaaccaagcatatgggggtttttttgggntgnttttttg

SEQ ID NO: 22883 - DNA, 376 bp, Homo sapiens
  misc_feature 11: n = A,T,C or G
atagataagantgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctc

SEQ ID NO: 22884 - DNA, 238 bp, Homo sapiens
agggaacgtgagctggttttttgaaaggatcaacaaaattgatagaccgctagcaagactaataaagaaaaaaaagagagaagaatcaaatagacacaataaaaaatgataaaggggatatcaccaccgatcccacagaaatacaaactagaactcaggattaagaatctcactcaaaaccgctcaactacatggaaactgaacaacctgctcctgaatgactactggatacataacg

SEQ ID NO: 22885 - DNA, 366 bp, Homo sapiens
ggttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggccca

SEQ ID NO: 22886 - DNA, 371 bp, Homo sapiens
  misc_feature 192, 294: n = A,T,C or G
gatttaagaagctcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggngtagcttgacctgacacagattgatgtcaatgtccaggatcatttctgggatgggaagggatgtgagatgatctgttactgcaacttcagcgaattgctctnctgcccaaaagacgttttctttggaccaaagatctctttcgtgattccttgcaacaatcaatgagaatcttcatgta

SEQ ID NO: 22887 - DNA, 317 bp, Homo sapiens
ataggtttggtcctagcctttctattagctcctagtaagattacacatgcaagcatccccattccagtgagttcaccctctaaatcaccacgatcaaaagggacaagcatcaagcacgcaacaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccac

SEQ ID NO: 22888 - DNA, 372 bp, Homo sapiens
gggaattagtccgggtggagagagcgagctgagtggttgtgtggtcgcgtctcggaaaccggtagcgcttgcagcatggctgaccaactgactgaagagcagattgcagaattcaaagaagctttttcactatttgacaaaggatggtgatggaactataacaacaaaggaattgggaactgtaatgagatctcttgggcagaatcccacagaagcagagttacaggacatgattaatggaagtagatgctgatggtaatggcacaattgacttccctgaatttctgacaatgatggcaagaaaaatgaaagacacagacagtggaagaaagaaattagagaagcattcccgtgtgtttgataaaggatggc

SEQ ID NO: 22889 - DNA, 348 bp, Homo sapiens
aaatgaatgagatgaaatgaaataatgaaaggaaattgaatggagatatgagatgaaatgagataaaatgagatgaaataaatgatgagatgaaatgatgaaatgctgaggtgagatgagatgaaatgagatgaaacgatgagatgaaatgaaagaatgagatgaaatgatgagatgaaatgatgaaatgagatgagatgagaagaaatgacttgatgagatgagataaaatgatgaaatgaaatgaagtgaaatgaaattgaaatgagatgagatgaaataaatgatgagatgaaatgatgaaatgctgaggtgagatgagatgaaatgagatgaaacgatgagatg

SEQ ID NO: 22890 - DNA, 377 bp, Homo sapiens
gtcaatgagtaaagcccaacttgatctgcagccgtgtctggcgttttgggcatttgtcatggccaggctgtgcttttacgtacttccaaagataaggtcttcacactagtaatgcatgccctccgtaggccacactgttctttttcattctattcaggagtgcccctcaagtaaggattacagtagtgcaaagtctgcacttaatttgttgcatcttgccctatagatgccccccttggaaattttattttgtttcaaatttggatggagattttagggacttctttttctgattagctgactgttgcagaatacagttagaaatacaaaactctgatttgattttcctttttcatatgaactatgctgtagatgat

SEQ ID NO: 22891 - DNA, 372 bp, Homo sapiens
  misc_feature 177: n = A,T,C or G
attgtaaactttatttatgaaggaaaggaagaaaataatatgcttcagttgggatataagtgtttatcacctgcgaatacatgtggtagaggaaaatgtctaactctctttcttgggggtcacaaatatgattaaatttactatcaccttataaagccaaaagacaagtacgttagngaaatgatggcaggtataccctgcactgggatttatgttctatgatacaatcttcacatgaaaaacatactgaaaagcaatagataaaagcagcaatcagagcacagtgcatgcttggagaacaagcaagcaaacaaaacagcagccttagaggagtggggttttgtttcagcctccatgggcatcccatgccat

SEQ ID NO: 22892 - DNA, 376 bp, Homo sapiens
  misc_feature 217, 220, 337: n = A,T,C or G
cagaggagaactagggaaggaatgatgttttgcaccttattgaaaagaaaattttaagtgcctacatattagttaagagcttttattgtgacaggagaacttttttccatatgcgtgcatacctctctgtaattccagtgtaaaatattgtacttgcactagcttttttaaacaaatattaaaaaatggaagaattcatattctattttctaatcgnggngtgtctatttgtaggatacactcgagtctgtttattgaattttatggtccctttctttgatggtgcttgcaggttttctaggtagaaattatttcattattataataaaacaatggnttgattcaaaatttgaacaaaaattgttttaaataaatt

SEQ ID NO: 22893 - DNA, 400 bp, Homo sapiens
  misc_feature 5, 17, 272, 280, 317, 326, 339: n = A,T,C or G
tcccngggaattcggcnttatggccgagtagctggcaacagcttaatatacattgttgttctccttcctgcatctgggaacactttcctcccagagcttagaggaattatttcagctgcccatgaattatggccgtttctcctgtggcttgtggcagccacagccgatcaggtggtagattcttgaagagtataggaatgatgtctctagctgagcccacaagagggctcaacagtttgcctcagtctaaaaaaaaaaaacccaatcatttnttaagttntttcacaaccctgttttctccataggatttacttttnaacttcagnattttatattttnggccttaatcccaaatatactacatgttcattggagaaaacgtaggccgggcaggggcatt

SEQ ID NO: 22894 - DNA, 387 bp, Homo sapiens
  misc_feature 21, 24, 37, 349, 386: n = A,T,C or G
attttggtcccgggtatttcngcnttatggcgggggnatttggagacatgaaagatattttactggttaagtttccgctaagtgcttagattttctttattgcgtttctcttacactgttaaacaaaatattgtgtggctaaatgatttcagcctatctaatttgcttgacaattagacagtcgttctagccttaggaacaaaatatgttcatcataaaaaaattaagaatgtgatctaaagttcaaagctgaaatattaaaacattaataaatagaaagctttaagaactattcactcagtatgcaaagaaacagtcatttctcgctgctctaaattctattcctgcncataaaagggaaatatatcaagtttaacaattcaatnc

SEQ ID NO: 22895 - DNA, 326 bp, Homo sapiens
  misc_feature 123: n = A,T,C or G
agccaagttttataatccttaaatcttaatgttcctcaaagcttggattaaatacatatggatgttactctcttgcaccaaattatcttgatacattcaaatttgtctggttaaaaaataggnggtagatattgaggccaagaatattgcaaaatacatgaagcttcatgcacttaaagaagtatttttaggaataagaatttgcatacttacctagtgaaacttttctagaattatttttcactctaagtcatgtatgtttctctttgattatttgcatgttatgtttaataagctactagcaaaataaaacatagcaaatggct

SEQ ID NO: 22896 - DNA, 320 bp, Homo sapiens
  misc_feature 142: n = A,T,C or G
gggctgaaagaagaccaagctgactcctgaggaagaagagattttaaacaaaaaacgatctaaaaaaattcagaagaaatatgatgaaaggaaaaagaatgccaaaatcagcagtctcctggaggagcagttccagcagggnaagcttcttgcgtgcatccgtttcaaggccgggacagtgtggcccgagcagatggctatgtgctagagggcaaagagttggagttctatcttaggaaaatcaaggcccgcaaaggcaaataaatccttgttttgtcttcacccatgtaataaaggtgtttattgttttgttcccacaa

SEQ ID NO: 22897 - DNA, 400 bp, Homo sapiens
  misc_feature 13, 17, 38, 77, 113, 225, 264: n = A,T,C or G
ttcttttatccgngtanttctttcttatggcgcggggnagcgaggaggagttgagagaacggagcggacgccatggngaccaacatcgagcagatttttaggtctttcgtggncagtaaattccgggaaattcaacaggagctttccagtggaaggaatgaaggccagcttgaatggtgaaacaaatacacccattgaaggaaaccaggcgggtgatgcagcttncctctgccaggagtctaccaaatgaagaaatagtgcagnaagatagaggaagtactttctggggtcttagatacagaactacgatataagccagacttgaaagagggctccagaaaaagtagatgcgtatctgtacaaacagatcctactgatgaaattcccactaaaaagtcaa

SEQ ID NO: 22898 - DNA, 232 bp, Homo sapiens
  misc_feature 1, 2, 45: n = A,T,C or G
nncttaggtaaggagtttgagactagcctgaccaatatggtgaanccctgtctctactaaaaatacaaaaactagctgggtgtggtggtgtgcacctgtagtcccagctactcaggaggctgagacaagagaatttcttggacccaggaggcggaggttgcagtgagcccgagatggcaccactgcactccagcctgggcaacaaagtgagactccatctctaaaaaaaaaa

SEQ ID NO: 22899 - DNA, 268 bp, Homo sapiens
agtggatttcagcagaaaccttacagatcaggagaaaatgagataatatgttgacagggctgaaggggaaaaaaagtaagccaaggatactatgtctagcaaaattatccttcataaatgaaggagaaataaagtatttccaagacaggcaaaagctgagagaattgatcaccactagactggccctacaagaaatgctcacaagagtcctaaacatggaagtgaaaacatgacatttaacactatgtaaaacacacaaaaaaaaaaa

SEQ ID NO: 22900 - DNA, 371 bp, Homo sapiens
  misc_feature 12, 39, 153: n = A,T,C or G
ggatctgcccgntgtattttaatgtcaatcctaattcanacaaatccgcaacttcatgatactggtaatttataataattcgtgatcattgctgttttgaaggaaaagagatgataaattctcttacggtttcaatcaggtaatggattttgntttacatctagttaggagaagaaaagtaagtgaaggaatcctctgatcatattgatcactatagaagcaaaagccaaatcagttcccttcattatcagtatttctcatgctgtacacaataaatttgttagactgagtacttggtttttgtttaatagaacaaataatccagggggttcactttatattactaaatgtgaaaaacataatgtgaaaag

SEQ ID NO: 22901 - DNA, 271 bp, Homo sapiens
  misc_feature 2, 60, 92, 200, 206: n = A,T,C or G
gnggctcatgcctgcaatcccagcactttgggaggccaaggcgggcagatcacccgaggncagtagttcaagactaccctggccaacatggngaaaccccatctctactaaaaatatcaaaattagccaggtgtggtggcagacgcccatagttccagctactcaggaggctgaggcaggagaatcgcttgaacccaggngggggnggttgcagtgaccccaagatggcaccattgcactccagcctgggtgacaagagcgaaactgtcat

SEQ ID NO: 22902 - DNA, 388 bp, Homo sapiens
  misc_feature 51, 58, 206, 207, 208, 383: n = A,T,C or G
gagcattgagacagccagcgcaggggcttctgctgagggggcaggcggagnttgaggnaaccgcaaataagtttttttctctttgaaagatagagattaatacaactacttaaaaaatatagtcaataggttactaagatattgcttagcgttaagtttttaacgtaattttaatagcttaagattttaagagaaaatatgagggnnngagaagagtacgcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggntgact

SEQ ID NO: 22903 - DNA, 388 bp, Homo sapiens
  misc_feature 46, 53, 54, 55, 57, 58, 224, 270: n = A,T,C or G
gaacacaactgtgaagcagctgctgtcacgcctgccaaagcaaagnatacctnnnannagggtgtgatgaaatttataacatcaaagtagaaaaaaaggtgtctgtgctatttctgtacagctatagagatgactactacagaatcttattttaaccctaaagaactgtcattaacctcattcaaacagacagaggcttatactgggggtaatggaatgttgtncattcatcataatttaaaattaaattctaagaagaggctgggtgcngtggctcacacctttaatcccagcactttgggaagccaaggcaggaagactgcttgaaaccaggagtttgagaccagcctgagcaacaaagcaagaccccatctctataaaaactaaa

SEQ ID NO: 22904 - DNA, 200 bp, Homo sapiens
  misc_feature 6, 147: n = A,T,C or G
aacagnaacattaataaatatgctcttgtgtagcaccttttactgtagattagtgcttaatttcttggcttgcctttgttgattgctaaggcaattttttctaatcttagggaatcattcagtagatgcgattaaaaaactaatgtngggtcaatttttttcttcattttcagcacaagaagtcctcttatatcctacta

SEQ ID NO: 22905 - DNA, 369 bp, Homo sapiens
  misc_feature 14, 60, 61, 95, 205, 209: n = A,T,C or G
ggcgcctgcagggnatcggaagccggttggggtgtgagaggttttctcgctctagggagnntcttcaagcaatcactatgtcaacagacacaggngtttcccttccttcatatgaggaagatcagggatcaaaactcattcgaaaagctaaagaggcaccattcgtacccgttggaatagcgggttttgcagcaattgttgcgtntggnttatataaactgaagagcaggggaaatactaaaatgtccattcatctgatccacatgcgtgtggcagcccaaggctttgttgtaggagcaatgactgttggatgggctattccatgtatcgggaattctgggcaaaacctaagccttagaagaagagatg

SEQ ID NO: 22906 - DNA, 377 bp, Homo sapiens
  misc_feature 59, 60, 204: n = A,T,C or G
gacatatgtataacattccattcaacagcagcagaacgcatgatatttttgaatgcgcnngggacattacccaggatagatcatatgttaggtcacaaaacaagtcctaacaaatccaagaagattgacataatattaagtatcttcttttacctcaatgctatgaaactataataacaggaaaattggaaaattcacaaaggngggggggattaaacaaaatactcctgaataaccaatgggtcaaagaagaaatcaaaaaggaaatccaaaagtatcttgagacaaaagaaaacagaagcacaacacagacaaaacttatgggatatagcaaaagcagttctaagaggaaagtttatagcaataaatgtctacat

SEQ ID NO: 22907 - DNA, 368 bp, Homo sapiens
  misc_feature 30, 59, 60, 86, 113, 200, 201, 207, 228: n = A,T,C or G
caatgcttttagtattaaaatgaaggtganttaaacagcttaaagtttagtttaaaagnngggggtgattaaaataatttgaaggngatcttttaaaaagagattaaaccganggtgattaaaagaccttgaaatccatgacgcagggagaattgcgtcatttaaagcctagttaacgcatttactaaacgcagacgaanntggggnggattaattgggagtggtccngatgaaacaatttggagaagatagaagtttgaagtgggaaactggaagacagaagtacgggaaggcgaagaaaagaatagagaagatagggaaattagaagataaaaacatacttttagaagaaaaaagataaatttaaa

SEQ ID NO: 22908 - DNA, 293 bp, Homo sapiens
  misc_feature 141, 143, 232, 250: n = A,T,C or G
gctgcccatggagcggaccctcctctttgggcctcgtgagcttttttgcttatcatgttccatttcgtgccgctttcccccttcaagatgccatttggagggtaggggatctgcttcccactgtgactgggctatgggatngngactaccttgcttacagattcatggtttgataaatttgttgtattcaaaaacttgaaatgcaggacgccattaagtgtctgtttatatnttttggaatatttgtatnacttacaattaattaataaaagtgggtttaaaaaacctttcca

SEQ ID NO: 22909 - DNA, 388 bp, Homo sapiens
  misc_feature 56, 202, 204, 325, 330: n = A,T,C or G
gtatatgcctaaaatgtatgcacttaggaatgctaaaaatttaaatatgggctaangcgggtaaaagcaaagaggaaaaactttggacagcgtaaagactagaatagtcttttaaaaggaaagccagtatattggtttgaaatatagagatgtgtcccaatttcaagtattttaattgcaccttaatgaaatcatctatttncngtggggtttagtactattgaatgtattactttactgttacctgaatttattataaagtgtttttgaataaataattctaaaagcatatactaagactcattcactttattcaaatatttgngtgtnctgtgtgccaggcattgggactcgttctaaggagaaagcagtgagcaaggcaggcata

SEQ ID NO: 22910 - DNA, 161 bp, Homo sapiens
  misc_feature 40, 61: n = A,T,C or G
atcatcaagtaggtaggaaattttcttcaaatgcactgcnaagacaaataataatgtgctnaggagagttatggattggcaaactagaaaatgcctggtccagccacaatgagatatattgaaagctttcataggcacagatgtttgccaaaaaaacacaa

SEQ ID NO: 22911 - DNA, 253 bp, Homo sapiens
  misc_feature 204, 206, 209, 211: n = A,T,C or G
atttgttactagattgttcagaagttttaatttatgatgggtgtggtggctcatgcggggagtcccagcactgtgggaggctgaggcaggaggatcatctgaggccaagagttcaagatcagcctgggcaacatagtgataccctatctcttaaaaaagaagaagtttttaaatttgaaataataataggtactggatttatgngnggngncttttctgcgtcttttgagatgagtatcaggttttttttttc

SEQ ID NO: 22912 - DNA, 388 bp, Homo sapiens
  misc_feature 12, 51, 52, 58, 59: n = A,T,C or G
ggatatataagncagttgacaacaaaatgatgggaaaatatatattatgtnngacatnnggtgcggaggaaagtcagagtggttatattcatatcatgtaaagcagacttcaaagcacagaaatttaccagagttgaggaagaacgtatataatgataaaatgggtaatccttcaagaggacatagtaatactgtgtatgccccagaggggggggctgaaacatgtgaagcaaaaagtaataaaattgaaaggagaagtagactaatccacaattttagttggggaccttaccactcctttctcaataattgatagtacaattagacagaagttcagcaaggatttagaagaactcaacaataccatcaaccaaaggatctgatagag

SEQ ID NO: 22913 - DNA, 159 bp, Homo sapiens
  misc_feature 57, 58, 61, 81: n = A,T,C or G
atacggaaaaaattgtattgaaaacacttagtatgccgttgataagaggaatttggnntanttatggtgggtgattatttnttatactgtatgtgccaaagctttactactgtggaaagacaactgttttaataaaagatttacattccaaaaaaaaaa

SEQ ID NO: 22914 - DNA, 388 bp, Homo sapiens
  misc_feature 51, 57, 58, 65, 87, 200, 207, 209, 214, 284, 332, 364: n = A,T,C or G
ggaacagccttgcagtacattgagctccatagagacagcgccggggcgggngagagnnggacggncactgggcgactctgtgcctcnctgaggaaaaataactaaacatgggcaaaggagatcctaagaagccgagaggcaaaatgtcatcatatgcattttttgtgcaaacttgtcgggaggagcataagaagaagcancgggggngnttcantcaacttctcaggagttttctaagaagtgctcagagaggtgggaagaccatgtctgctaaagagaaaggnaaatttgaagatatggcaaaaagcggacaaggcccgttatgaaagagnaaatgaaaacctatatcccctcccaaaggggngacaaaaaaagaagttcaaggatc

SEQ ID NO: 22915 - DNA, 388 bp, Homo sapiens
  misc_feature 19, 49, 50, 85, 211, 382: n = A,T,C or G
ctcctgacatcctataagnctattttctctgaaagctctcggccttagnnggtgagggggggggtaaaataaatgactgtacatnaagcttgtccgactcatggcctacgctccatgtggcccaatatggctttcagtgcagccctaaacaaatcagaaactttctaaaagcattatgagttttttgtgattttttaaatcgggggggggnattttatgtatggctcaagacaactcttctagtgtgtcccagggaagccaaaagattggacaccccagctctacatctttatttttcatctatttacagtgcactaaggtgataagtgggttatttattactctactcctttgggaaaaaaagatggtcagtggtttaagntttttt

SEQ ID NO: 22916 - DNA, 308 bp, Homo sapiens
  misc_feature 49, 50, 51, 52, 59, 60, 62, 63, 149, 226: n = A,T,C or G
atgttttaaaaacaatacaactgtaatttaaaaaaattatataatattnnnnggcgccnngnncggagccttacacatggaagccctcaaatgttaagcacattaggaggctttgattgtactttctcctcttattttgcagtcctggnatgttagagtagaatactggaatgcagaaaatgtttctcttggtcaggtgcgggggggggcacctgtagtcccagcnctttgggaggctgaggtgggaggatcacttgagccaggagttaaagaccagtctgggcaagatggcaaaaccccatctctac

SEQ ID NO: 22917 - DNA, 114 bp, Homo sapiens
  misc_feature 41, 47, 66, 67, 68: n = A,T,C or G
attatggcctgggggaggcattgaggcagccagcgcagggncttctnctgagggggcaggcggagnnngaggaaaccgcagaataagtttttttctctttgaaagatagagatt

SEQ ID NO: 22918 - DNA, 354 bp, Homo sapiens
  misc_feature 1, 2, 48, 55, 58, 59, 149, 204, 208, 252, 294, 313: n = A,T,C or G
nntcggactgcgacacagcccatcccctcgaccgctcgcgtcgcattngggcgcntgnntaccgctccaagcccagccctcagccatggcatgccccctggatcaggccattggcctcctcgtggccatcttccacaagtactccggcngggagggtgacaagcacaccctgagcaagaaggagctgaaggagctgatccaggngggngctcaccattggctcgaagctgcaggatgctgaaattgcaaggnctgattggaagacttggacccggaacaaggaccaggaggggnaccttccaggagtatgtcncccttcctggggggccttggcttttgatcctacaatgaagc

SEQ ID NO: 22919 - DNA, 382 bp, Homo sapiens
  misc_feature 201, 208: n = A,T,C or G
catttgacacctccctcattaggaagacaaggactatccttgaggcaaaacaaggcgaagaacccagcaagtccctataaccttgcgtataagtataattttgaatattccgtggttttcaacatggtactttggataatgatcgccttggccttggctgtgattatcacctcttacaatatttggaacatggatcctggnggggggnggcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctatg

SEQ ID NO: 22920 - DNA, 171 bp, Homo sapiens
  misc_feature 49, 50, 54, 58, 61, 146, 153: n = A,T,C or G
ggtttcatgttagttaccttatagttactgtgaaattagtgccacttannggangggnccnaaaataaatatatctaccccaggactagatgtagtattttttgtataattggatttcctaatactgtcatcctcaaagaaagtgnattgggntttttaaaaaagaaagtg

SEQ ID NO: 22921 - DNA, 384 bp, Homo sapiens
  misc_feature 51, 52, 157, 207, 212: n = A,T,C or G
gagacaaaggttatttgtaaagaagctccttccagcacctcctctcttgtnnttttgcgcaaactcacccagtgagtgtgagcatttaagaagcatcctctgccaagaccaaaaggaaagaagaaaaagggccaaaagccaaaatgaaactgatggnacttgttttcaccattgggctaactttgctgctaggagttcaagcggtgnctgcnaatcgcctctcttgctacagaaagatactaaaagatcacaactgtcacaaccttccggaaggagtagctgacctgacacagattgatgtcaatgtccaggatcatttctgggatgggaagggatgtgaagatgatctgttactgcaacttcagcgaattgctctgctgccca

SEQ ID NO: 22922 - DNA, 171 bp, Homo sapiens
  misc_feature 13, 62, 63: n = A,T,C or G
aaatgatgaaccnataaaaaataataactactacaacttttcaaacatagtttaataagganncaaatacaataaaacttaaaaaacagggggatgaagttaaagtgtagagtttttattagttttctttctttttacatgtttgttatacaatcattgttatcaccagtt

SEQ ID NO: 22923 - DNA, 388 bp, Homo sapiens
  misc_feature 50, 55, 58, 59, 60, 63, 197, 204, 209, 344: n = A,T,C or G
attcaacaaatagttcttgagttgcaactagcttccccatactgcactanctacngannnggnaacttccagattcaccttagcttcctgtccggggccactttccaaactaccacacagagaagtggagcccaaacagagccatagtcttatggggaagaagaaacggtgactggagtttgcggctgccaaggcanctggganggggnggggtactgagcaggagggagctgtgcacagaaggagctcagatatctgcacatacttccccttgagtgactgatcagctcgaatctatggggaatctgtgagctgactagagatgctgaagggtatacagtggnggggaattttgggaggtctgaccagccttactaaacaacaccat

SEQ ID NO: 22924 - DNA, 315 bp, Homo sapiens
  misc_feature 60, 210, 278: n = A,T,C or G
ggtggctcacgcctgtaattttagcagtttgggaggccgaggcaggcagattgcctgagntcaggagttcaagaccagcgtgggcaacaaagtaaaaccccatctctattaaaatacaaaaattagccaggcgtggcgggcggggtgccttgtaatcctagctactcaggaggctgaggcagggagaatcacttgaacctgggaggcggngggtacagtgagccgcgatcgcgccactgcactcccaaggccccttggggccgaagaaaaaccgaagnacctcttgtccttcccaaaaaaaaaaccccccccccc

SEQ ID NO: 22925 - DNA, 327 bp, Homo sapiens
  misc_feature 62, 202, 205, 206: n = A,T,C or G
gggagattgagtcatttattcatgaaatatttactgagccctcactgtgtatcaggcgctgntgctggagatttgattccaaaacaaaatcccaatgcttctacgttatttagtcaccacgtaaattgttcaaatttttaataggttggttctctcttcatttgcctgattatattcttgtttcaagactaattcataggantgnngactttttagggctcatttcacatacaaattgtgtgctttctggtataaactgtggttcaaagatgaagtattatttcgagtccaggactttgagaccacaacatagtgagactctctaca

SEQ ID NO: 22926 - DNA, 380 bp, Homo sapiens
  misc_feature 51, 52, 59, 60, 61, 62, 203, 342: n = A,T,C or G
ggaagattttaaaactttttattgtcttataaatagcattcacttattatnntgggggnnnnagggttccattaagttaacactgtatttggacaaagtgtgaccaaattagccagtctgttttcttccatgtttaattaagaagtgagaggtagaagtacttcaaattcaacaggccagcgagcaatcggcttaaaattccnggggtaaatgttgtgctcttatgttctcggctttttaatgactttatttttacagtacttgttcagtcacttgagatgaaatgcttggggtagcttttccatcctcaaacttaatgtttttactaagttcataggggtntggaacagtatatgccaatcactgagactgcatcagag

SEQ ID NO: 22927 - DNA, 370 bp, Homo sapiens
  misc_feature 49, 60, 203, 205, 206, 209: n = A,T,C or G
tacaaagttctgtttggttagtattggcatagtttttctatatagcctnaatgcgggggnatacccatagggctagatctgtatcttagtgtagcgatgtatacatatacacatccacctacatgttgaagggcctaaccagccttgggagtattgactggtcccttacctcttatggctaagtctttgactgtgttcattgncnnagntgacccagtttgtcttttaggttaagtaagactcgagagtaaaggcaaggaggggggccagcctctgaatgcggccacggatgccttgctgctgaaccctttccccagctgtccactgaaacgtgaagtcctgttttgaatgccaaacccaccattcactg

SEQ ID NO: 22928 - DNA, 378 bp, Homo sapiens
  misc_feature 55, 56, 57, 61, 115, 208, 290, 358: n = A,T,C or G
gatcctgtattttctcaatcctccaaatccgaccaacttctctaaattgtactgnnngggnttggcagccagagctcccactccttgccaccatcccaccgccaccactggaggngctgaaggccaagtacaagccatccgggtggaaacctgtattttgaaggtctgcaccgcggggcaaagggccagcttgttccctctgcggggnggatgagctgaattggcagcagacaaccagcgtttctcaggaagctgtaccaacaagatgcaaaagggagaaggtggagcanaaggaggggcagttcatgagctgattgtgctaagccctgtcaaataatcctttagaaaccccgatggnaatcaatgccacccaagggc

SEQ ID NO: 22929 - DNA, 209 bp, Homo sapiens
  misc_feature 60, 61, 203, 205, 208: n = A,T,C or G
aagaacaacttggtctacttagtgaaacctcgtctctactaaaaatataaaaaaattagnngggtgggcatggtggcaggtgcctgtaattccggccacttgggaggctgaggtgggagagttgcttgaacctaggaggcagaggatgcagtgagctgagatcgtagcactggactttagcctgagcgacagagtgagactcngnggng

SEQ ID NO: 22930 - DNA, 369 bp, Homo sapiens
  misc_feature 55, 56, 63, 203: n = A,T,C or G
ggaatagatgaggaagcccaacatcaattaaaatacatactacaaagtactttgnnaagcggnacaaagtgcctatgtggctgaaatgaaatacctaattcacatcatcaagaaaggcctccagcaggaaatgtctaatctatgttaagaagaatgacaggaaacagtcaaatgaaggtatcagtaaggatcaagaaagacanggggggggatgagagaaaggatggtggatttagggaatcaaagaatcttggtagatggtaatggtaagagtgtgaagtatagagtgccttaaaataggctgggcgcagtggctcacgcctgtggttctagcattttgggaggtcaaggcgggtggatcatttgagg

SEQ ID NO: 22931 - DNA, 388 bp, Homo sapiens
  misc_feature 16, 23, 62, 66, 214, 215, 217: n = A,T,C or G
gtaggaagcagtaagnaaaaagnacaagctaggaaacaaaaagctaagggcaaaatgtagcnaggnttagaagaaaattggaagatagaaacaagatagaaaatgaaaatattgtcaagagtttcagatagaaaatgaaaaacaagctaagacaagtattggagaaatatagaagatagaaaaatataaagccaaaaattggataaaatggggnngnaaaaatgaggaaattattggtaaccaatttattttaaaagcccatcaatttaatttctggtggtgcagaagttagaaggtaaagcttgagaagatgagggtgtttaccgtagaccagaaccaatttagaagaatacttgaagctagaaggggaagttggttaaaaatcaca

SEQ ID NO: 22932 - DNA, 213 bp, Homo sapiens
gagaccagtctggctaatgtgatgaaaccccgtctctactaaaaatacaaaaattagccaggctctaattgccatgcgcctataatcccagctacttgggaggctgaggcaagagaatcgcttgagcccaggaggcggaggttatagtgagtcgagattgcgccactgcattccagcctgggtgacagagcaagactctgtctcgggggaaaa

SEQ ID NO: 22933 - DNA, 256 bp, Homo sapiens
  misc_feature 18, 51, 54, 62, 211, 213, 256: n = A,T,C or G
gatggaaaagtattcagnagtattggagtaactgcactaaaatatcatagnggnctaggggngatttaaacatctctatattagtgtatacttagtaagaagagaaaactcctcaaacagtttcttaaagggcagtgaatttttcaaattaccagaatatgtttgagttatttaatatttaatgtagtcatgtagaaaggaaagagggggngnaggaaaggaaagctcttctaagttttatccatcaggacatgcn

SEQ ID NO: 22934 - DNA, 274 bp, Homo sapiens
  misc_feature 142, 205, 208: n = A,T,C or G
cgtggtggctcatgcctataatcccagcactttgggaggccgaagtgggaagatcacgaggccaggagtttgagatcagtctggccaacatagtttgaaaccccgtctctactaaaaatacaaaaaattagccagatgtggnggtttgcgcctgtaatcccagctactcgggaggctgaggcaggagaatcacttgaactcaggnggnggaggttacaatgaaccaagatcatgccactgccccctccagcctgggtgacagagggagactcca

SEQ ID NO: 22935 - DNA, 370 bp, Homo sapiens
  misc_feature 1, 86, 203, 204: n = A,T,C or G
nactaagttttgtggtacttcaccctcttctgccctcacttcatgtgacagccattgggagactgatgcacaaactgtcacttggntaatttaagcacttctgttttcgtgaatttgcttgtttgtttcttcatgcctttacttactttgtcccatgctactgattggcacgtggcccccacaatggcacaataaagcccctnngggaaactgttctttaaatgaaacacaagaaattggccactggtaaaactctgcagcttcaactgtacttcatttaatgccattaatgcaaatatacttcctcttctttttgcatggggtttgcccacctctgcaatagtgataatctgatgctgaagatcaaata

SEQ ID NO: 22936 - DNA, 165 bp, Homo sapiens
  misc_feature 51, 56, 57, 58, 77, 156: n = A,T,C or G
ggcagtacattgagctccatagagacagtgccggggcaagtgagagccggncgggnnntgggcgactctgtgcctcnctgaggaaaaataactaaacatgggcaaaggagatcctaagaagccgagaggcaaaatggcatcatatgcattttttgngcaaacttg

SEQ ID NO: 22937 - DNA, 367 bp, Homo sapiens
  misc_feature 57, 80, 204, 206, 245, 335: n = A,T,C or G
tataagagaaaactctataaaacatctataattttcgaacccaagtacactcttgcnttctatgctttaagttaaatgcnaactcctttttccttcttcctgctgcaagtactatctcatcctgatgctcaagagtgtcagggcctgggtttccaaacagagactaccctaaaattatttgggggagtagtactttacacaatngnggggtcccccacaaatcataattgtttcagtaaaatggntactttggtttttccaagaaaaaactcgtttttactcatttttggcctgtttgtttatttagaaactaatctggattcactccctctggntgatacccactcaaaaaggacacttctgatta

SEQ ID NO: 22938 - DNA, 368 bp, Homo sapiens
  misc_feature 8, 58, 59, 204, 205, 210, 211, 344, 367: n = A,T,C or G
attccagnactttgatgactagcacccaccccatagctgaggaggagccacagtgganntggcccagctttaagatatctagcagaaactatagctgaggactaaggaattctgcagcttgcggatgtttaagaaaataatggccagattttttgggtccttcccaaagatgttaagtgaacctacagttagctaattaggacnnggggnntttttcatccctgggccctgacaagtttttccacaggaatatgtatcatggaagaatagagggtattctgtaatgggaaaaagtgttgcctgccaccacccctctgtagagctgagcatttcttttaaatagncttcattgccaatttgttcttgna

SEQ ID NO: 22939 - DNA, 372 bp, Homo sapiens
  misc_feature 59, 60, 205, 206, 209, 212, 281: n = A,T,C or G
tgatcttaatttatctgttgtattcaatatcattggaagccaggaaaaggccaaatacnngacctctggtccagggctgtgatatgccacccactccaagcttcctttgatccttgctttgcccagccaagcagggaaactccttagctttccttggtctccagaggtccatctgactgttgatttgcgatatttagtcttcctnnggnagnttgatttgattatgtgttggggaagaagaaagctttgacagcccctggaaggtagctatttagaatggngctcttccaagtgtccatgtgaagattagtgtttctcccatgaccacctggctgtcatgtgacaaatcttgagggatagaaccttggcttt

SEQ ID NO: 22940 - DNA, 176 bp, Homo sapiens
  misc_feature 53, 63, 70, 115, 163: n = A,T,C or G
gggcttatctgggaggtgttgggcgcggacagtcgagtatgtcacaagaaaangccgccgggngacttangtctgttagaggaagacgacgagtttgaagagttccctgccgaanactgggctggcttagatgaagatgaagatgcacatgtctgggaggatnattgggctgatga

SEQ ID NO: 22941 - DNA, 371 bp, Homo sapiens
  misc_feature 55, 56, 61, 63, 103, 127, 209, 211: n = A,T,C or G
gggagcagagaagtagggagtaaagcagcatcttgcctggatgagccagggggcnnagggngngaagcccactatctcatttaatctttacaactctcttgcnagggtccctgggtgtgaaaatacntgagataaatcatgaaggccactatcatcctccttctgcttgacaagtttcctgggctggaccgtttcaacagagagggggngnggactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggat

SEQ ID NO: 22942 - DNA, 365 bp, Homo sapiens
  misc_feature 53, 60, 113, 136, 169, 206, 210, 269, 270: n = A,T,C or G
gtaaaagaaaaaagaatcaaattgaatatatcttttaagaattcaaaactagngtattcncttaccctagttcattataaaaaatatctaggccttgtggatataaaactgtngggtattctacaacttcaatggnaattattacaagcagattaatccctctttttgngacacaagtacaatctaaaagttatattggaaaacangggnatattaaaattttacacttttactagctaaaacataatcacaaagctttatcggattgnntaaaaaaattaacaatataatggcaataggtagagatacaacaaatgaatataacactataacacttcatattttccaaatcttaatttggattt

SEQ ID NO: 22943 - DNA, 369 bp, Homo sapiens
  misc_feature 205, 209, 356: n = A,T,C or G
catttctaactgaagtgagccaaaaggaaaattatgctggggcaaagtttagtgatccaccttctcctagtgttcttccaaggcctcctagtcactggatgggaagcactgttgaaaattccaaccaaaacagggagctgatggcagtacacttaaaaacgctcctcaaagttcaaacttagatttcagatttcagtatgtgtgngggncataatttttcccatatccctggactcttgagaaaattggtacagaaatggaaatttgccttgttgcaacatacaattgcaaaagatgagtttaaaaaattacatacaaacagcttgattatattttataatttttggaaatactgnataccatgtatta

SEQ ID NO: 22944 - DNA, 369 bp, Homo sapiens
  misc_feature 22, 52, 207, 209, 212, 268, 271, 317: n = A,T,C or G
gaggcattgaggcagccagcgnaggggcttctgctgagggggcaggcggagnttgaggaaaccgcagaataagtttttttctctttgaaagatagagattaatacaactacttaaaaaatatagtcaataggttactaagatattgcttagcgttaagtttttaacgtaattttaatagcttaagattttaagagaaaatatgaggncnggnggaagagtaccatgaggaaggaaaagataaaaggtttctaaaacatgacggaggtnganatgaagcttcttcatggagtaaaaaatgtatttaaaagaaaattgngagaaaggactacagagccccgaattaataccaatagaagggcaatgctttt

SEQ ID NO: 22945 - DNA, 187 bp, Homo sapiens
  misc_feature 24, 36, 48, 51, 55, 57, 58, 59, 60, 170: n = A,T,C or G
gattgctaaaaaataaataaaagnctagatactggnaacctaactgcntgngggngnnnnacccacatgacttattatgcctaaagccaaatttccagtttaagtaattgcctacaataaaaagaaattttgcctgccattttcagaatcatcttttgaagctttctgtngatgttaactgagctac

SEQ ID NO: 22946 - DNA, 236 bp, Homo sapiens
  misc_feature 38, 45, 51, 52, 129, 159, 202, 205, 207, 209: n = A,T,C or G
gaactcttctgaaaaaaaaacattgaattttattaggngtacacncggagnnaacaaatatattcccaaacagtttagtatgaaacattttgaacccctttagatccaatattgaacattttgcatggnatcttcattgtgtagtcaactgttcctggnctttcttgggagttgtcttccctaagctcaaacaaacagtgtnaancngnaaaggaaattaagaatcccaaaaaaaa

SEQ ID NO: 22947 - DNA, 377 bp, Homo sapiens
  misc_feature 49, 142, 202, 206, 208: n = A,T,C or G
cattgactggggggaaaagcgcaatactattgcttccattgctgctggngtactattttttacaggctggtggattatcatagatgcagctgttatttatcccaccatgaaagatttcaaccactcataccatgcctgtggngttatagcaaccatagccttcctaatgattaatgcagtatcgaatggacaagtccgaggngagngntacagtgaaggttgtctgggtcaaacaggtgctcgcatttggcttttcgttggtttcatgttggcctttggatctctgattgcatctatgtggattctttttggaggttatgttgctaaagaaaaagacatagtataccctggaattgctgtatttttccagaatgcct

SEQ ID NO: 22948 - DNA, 358 bp, Homo sapiens
  misc_feature 9, 57, 59, 185, 201, 204, 208, 283, 300, 310: n = A,T,C or G
ctctaaagnaatctgcagtgttccaaagactttggtatggattaagcgctgtccagngncaaaatgaaatctcaaaacagagctcagctgcaaaaaaagcatattttctgtgtttctggactgcactgttgtccttgccctcacatagacactcagacaccctcacaaacacagtagtctatagntaggattaaaataggnggngggncattcaaaagaaagctttgggaaaaaagagctggctgggctaaaaacctaaatatatgatgaagattgtgggggntgtcttcccaagccccntgttcatggnggggcaatgggtattttgggtattttactcaattgggtactctcattt

SEQ ID NO: 22949 - DNA, 192 bp, Homo sapiens
  misc_feature 10, 16, 83, 86: n = A,T,C or G
gttcattatnaaaatnttctactgcagactttcccataaagtgtttctgtctggccctggtttcatatctaaaagcttctagnggnttcagcaagaaatgatggaaacattttgacagaatatatatttctttttttaaaactaagatcttaaaattaaagagaaacaaaaacttacaaaaaaaaaaaaaaa

SEQ ID NO: 22950 - DNA, 220 bp, Homo sapiens
  misc_feature 2, 208, 215: n = A,T,C or G
gnctgcatgtggtgtgtgcccaggcagaacttcgaggggttcgtgctgtaagacctaaagttcttatgagattgtccaaaacaaagaaacgtgtcagcagggcctatggtggttccatgtgtgctaaatgtgttcgtgacaggatcaagcgtgctttccttatcgaggagcagaaaatcgttgtgaaagtgttgaaggcacaagcgcngagtcangaaag

SEQ ID NO: 22951 - DNA, 371 bp, Homo sapiens
  misc_feature 50, 55, 154, 185, 206, 262: n = A,T,C or G
caaatgaattgcttttaggctctgataaatgtaaagctgtctttctaagngtagngacccttccgtgcaatctcaacctgtgtttcttaccctaatgatcagttagtagaccatgaagaggattcagctcttcctaactgataaggaagttgtntctcggtcaagcacagtggctcatacctgtnatcccagcagtttgggaggcngaggtaggcagatggcttgtggctcaggagtttgagaccagcctgggcaacatggngaaaccctgtctctacaaaaaaatacaaaaattagccgggcgtggtggtgcatgcctgtaatcccagctacacaggaggctgaggtggaaggattggttgagcccggga

SEQ ID NO: 22952 - DNA, 164 bp, Homo sapiens
  misc_feature 5, 27, 30, 55, 93, 110, 164: n = A,T,C or G
caagnccgtggggggccccaccctttnacntgcaggagccccttggtccggaccnttggccccaaggtggaaccttgtgggcagggtcccagnaacccagtccaggaggnctttgccccctaagaaggggatgtacctgtaaattaaacagtttttttagatcn

SEQ ID NO: 22953 - DNA, 372 bp, Homo sapiens
  misc_feature 59, 61, 140, 204, 205, 207, 208: n = A,T,C or G
aatagaacttagacgtatgtctgagtccctgagatcacatgctaaagtcgatgaaaagnanccactgccactgtcttgtgtcagaacttttacagtacagaaaataacagaatagccttctgtaatgaggcgtttgttangagttttgcatgagattctaatacttcagtaggaccctacctacgtggttcatctacaatggtnncnntaaaaaatctggcaggattttaaaactcaatcagtctttcctttgagctagtgacttgaaaagaaagagagaaggaaaagagaccatattaagtccatgccagttgcttggctagaatatgatcaacgacttgtagtagactcaagtttttaaaaaacactatt

SEQ ID NO: 22954 - DNA, 368 bp, Homo sapiens
  misc_feature 13, 338, 365: n = A,T,C or G
ggaactggcaagnagcaagtggcccattacagaagacctctttgtctctgtgggttcaaagcttgcctttttcactccagtgatactggggaagctaggagtaacctaggactaccacaccctcttccaccaagagacaactggcagcctggctcagggaacttctttaccctctcaggcagtgccagcagagaccaatgggagctcaacggcactagataaacaaagcaggctaaataacactgcaaaggctctgtaaattagtctgctattggaacgatagcctagaaaagtagaccaagatactcgtgctaaaactaaacagggtggctaactgntaaaagatttaattagaagcctatgtnagg

SEQ ID NO: 22955 - DNA, 307 bp, Homo sapiens
  misc_feature 16, 46, 72, 224: n = A,T,C or G
tctatggtccggggancggagtcctcttcttgtgcgctttttgtcntataaggaatcccattaaaggaaggnaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgggcntttccagggaccagtgcagggacagggggagaaggggaggggttaagttaaataaagaagattatttttgtttcctgacttta

SEQ ID NO: 22956 - DNA, 196 bp, Homo sapiens
  misc_feature 70: n = A,T,C or G
gtggcggcgacgacccattcgaacgtctgccctatcaactttcgatggtagtcgccgtgcctaccatggngaccacgggtgacggggaatcagggttcgattccggagagggagcctgagaaacggctaccacatccaaggaaggcagcaggcgcgcaaattacccactcccgacccggggaggtagtgacgaaaa

SEQ ID NO: 22957 - DNA, 369 bp, Homo sapiens
  misc_feature 57, 108, 127, 153, 206, 262: n = A,T,C or G
ggacatttgcttctgacacaactgtgttcactagcaacctcaaacagacaccatggngcacctgactcctgaggagaagtctgccgttactgccctgtggggcaaggngaacgtggatgaggttggnggtgaggccctgggcaggctgctggnggtctacccttggacccagaggttctttgagtcctttggggatctgtgcactnctgatgctgttatgggcaaccctaaggtgaaggctcatggcaagaaagtgctcggngcctttagtgatggcctggctcacctggacaacctcaagggcacctttgccacactgagtgagctgcactgtgacaagctgcacgtggatcctgagaacttcaggct

SEQ ID NO: 22958 - DNA, 144 bp, Homo sapiens
  misc_feature 75: n = A,T,C or G
ctttagcaataaacgaaagtttaactaagctatactaaccccagggttgggcaatttcgtgccagccaccgcggncacacgattaacccaagtcaatagaagccggcgtaaagagtgttttagatcaccccctccccaaaaaaa

SEQ ID NO: 22959 - DNA, 367 bp, Homo sapiens
  misc_feature 115, 155, 205, 207, 295, 321: n = A,T,C or G
acggaacggaaaactggcggcttggtttgttcagcgcgtcgcggtcatggctctcgtttcaggcctccacggtgtgcacctggagtcaggagcgcgcttgtgcgtacagttcggntcagttactaaaagatgtaactgaactgcagatccttggngaaatatctttcaacaaatccctatatgagggactgaatgcagagaaccncngaactaagatcactgtcgtcttcctgaaagatgagaagtaccattctttgcctatcatcattaaaggcagcgttggtggacttctggngttgatcgtgattctggtcatcctgntcaagtgtggcttttttaaaagaaaatatcaacaactgaacttgga

SEQ ID NO: 22960 - DNA, 371 bp, Homo sapiens
  misc_feature 201, 210: n = A,T,C or G
ataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgangaggggggntaccaagattaaaaagtgagataaatggtcaatgagaaagaatggaagatggtaaacaatcactttttaaaacctgttaagtcaaaaccatcttggctaatatgtactggggaaataatccataagagatatcaccagactagaattaatatatttataaa

SEQ ID NO: 22961 - DNA, 366 bp, Homo sapiens
  misc_feature 55, 203, 206, 207: n = A,T,C or G
gggttgttaaggcagactgccctgttccccagagttgtccctgtagtgtctaggnttattctaatggtaaaagtaacttacttaaaaaacatatgtacacctatgtatgcaagtatgtatatatgtgtatgctcagattaacttccataggtacataagtgaaagaagtctcagttcagtgaacacaaaacttatttaaagangcnntatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgtta

SEQ ID NO: 22962 - DNA, 287 bp, Homo sapiens
  misc_feature 7, 15: n = A,T,C or G
atcaacntcttggtnagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttattttttgttccacaagttaaataaatcataaaacttgaaa

SEQ ID NO: 22963 - DNA, 244 bp, Homo sapiens
  misc_feature 2, 16, 124: n = A,T,C or G
gnactctgaacgtgcnaaaatgggaaggaggcggtgttttgatgatctgttaaattcttagtgaagtttccttgatttccagtggctgctgttgtttgagtttggtttggagcaaaactgaggnagtcctaacatttctgggactgaatccaggcaagagaaagaagaaaaagaagaagaaaaagaggaggaaaaaggtagggagaaataaagggaggagagaagcacagtttaaaaaaaaaaa

SEQ ID NO: 22964 - DNA, 388 bp, Homo sapiens
  misc_feature 4, 57, 130, 229, 386: n = A,T,C or G
atantattgtaattgggaaacctgaatagttttaagagtccagtggagcctcagtgntttgaatagagatgactcattacacataatgggaggagttttctaccatatcatattgaagatatgaagaggnattttccagcttcccaagtttgagagttgggcatttacctcttacacttcagtcaacaaacaaactagtaattcctaatgcataattaatttggatgcnagataaggattaagtttctggagttttgttttgacttctgaggtgctaaaaaataccatgtaaattctccctaccagctagaagggtagcaagacgttgtagagtgcttatcagagagtaccacttacttcaattgatcaatataaatatatccctngt

SEQ ID NO: 22965 - DNA, 399 bp, Homo sapiens
  misc_feature 11, 30, 35, 38, 43, 52, 57, 65, 69, 70, 77, 79, 83, 84, 87,103, 105, 127, 139, 147, 161, 198: n = A,T,C or G
ccccgggaccncggcccctccggccggggncgacnccncgccncgacgcgcnttccngacgcccntccnngacgaancntccnntcnaaaaagagaaaccacncnacctctaagacgttagagtggnagaactactacnttgtagtnaaccttcctttgtngatttaaaaaatatatttggatttattttggcagggngggggaatcatctaataaaaaaatttaaagcaaacttcattttttctaaccagagtgaagagacagggagagaatcaaatatgtgtgagctccctctgttgctctgtaacagcattttattcatgatttgtgatgtgataaggaaatttttgctaatgtgtcaaaacaaattcaattttcctttaaggcaatttataactt

SEQ ID NO: 22966 - DNA, 399 bp, Homo sapiens
  misc_feature 11, 15, 39, 44, 45, 69, 111, 144, 234, 235, 247, 285, 294,312, 358: n = A,T,C or G
ccccgggaccncggnccctccggccggggttgacaaagnctgcnnttgactgctggtggttcacttccnttgacactacgcacttttacaactacctgttaatgctactantgacaaaatgctctgattcctagtgccaaaggntcaattcagtgtatataactgaacacactcatccctttgtgcttttgttttttttttatggggcttaaagtaaagagcccatcctttgcnngggatccatgtngttacttaggcattttatcttggctcaaattgttgaanaatgggggnttgtttcatgggttttgnatttggggctaatgcacgttttaacatgatagacgcaatgcattgngtagctaagttttctgggaaaagtcaatcttttaggaattg

SEQ ID NO: 22967 - DNA, 364 bp, Homo sapiens
  misc_feature 24, 25, 29, 30, 85, 87, 161, 167, 204, 206, 208, 210, 267,292, 309, 324, 343: n = A,T,C or G
gaaaaaaaaagcccctaatttttnntgtnngcaactgctcttgataacaacaacagtaataatagtagtagctatcttttataanangccaactacatgtcagtcactatattgggggtttttggctgcccggattcctttctggaataagagctctgtanactgtntttaatatagtaagtgacagagaaaggaggcaaaccngntngnctacttcttaaactatgccttcagtatttattaggaacctcgatatgcttgaagtanatgatacattttccccagcattcanactcttgaacaacttgngaaatctacccaagngaattataattaactgcgncacatttatcattatactgac

SEQ ID NO: 22968 - DNA, 254 bp, Homo sapiens
  misc_feature 10, 20, 40, 42, 141, 157, 192, 228, 243, 247, 251: n = A,T,C or G
tttcccgggnttcggtcttnggccgggggactactgaaananagtggcttttctacagtactcttccttattgcaccatttttgtattaacgtagaaactaagcatcagaatttatgaacaaaagaatatggtaatttttnccttttgctctaaaanactggagatttggggggaagcaattcctttttttnaaaaaaattttggaaaaacctttcttttgggaaacncaaatccggggggtnccgngggnggg

SEQ ID NO: 22969 - DNA, 274 bp, Homo sapiens
  misc_feature 208, 272: n = A,T,C or G
aaagttgttgcagcaaaataatagcctcggttctatgcctatatggattagctataaaaaatgtcaataagattgtacaaggaaaattagagaaaggcacatttagggtttattttttacacttggccagtaaaatagggtaaatcctattagaattttttaaagaactttttttaagtttcctaaatctgtgtgtgtattgtgaagnggtataagaaatgactttgaaccactttgcaattgtagattcccaacaataaaattgaagatangc

SEQ ID NO: 22970 - DNA, 369 bp, Homo sapiens
  misc_feature 12, 54, 89: n = A,T,C or G
gggcgcaatagnatatagtaccgcaagggaaagatgaaaaattataaccaagcntaatatagcaaggactaacccctataccttctgcntaatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaa

SEQ ID NO: 22971 - DNA, 388 bp, Homo sapiens
  misc_feature 11, 12, 78, 89, 214, 353: n = A,T,C or G
ttggccgggannagttaaccttcaaaacgcagctccccaatcacactagcaacatttcaagtgcttgagagccatgcntgattagtggntaccctattgaataggtcagaagtagaatcttttcatcatcacagaaagttctattggacagtgctcttctagatcatcataagactacagagcacttttcaaagctcatgcatgttcatgatgngaggtgtcgtattttgagctggggttttgagactccccttagagatagagaaacagacccaagaaatgtgctcaattgcaatgggccacatacctagatctccagatgtcatttcccctctctttttttaagggatgtnaagattactaaaacaataaaagctcctaaaaaatc

SEQ ID NO: 22972 - DNA, 379 bp, Homo sapiens
  misc_feature 108, 207: n = A,T,C or G
ggtaggagcctctctccctactgctgctacacaagaccctgagactgacctgcaggacgaaaccatgaagagcctgatccttcttgccatcctggccgccttagcggnagtaactttgtgttatgaatcacatgaaagcatggaatcttatgaacttaatcccttcattaacaggagaaatgcaaataccttcatatcccctcagcngagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagac

SEQ ID NO: 22973 - DNA, 194 bp, Homo sapiens
  misc_feature 60, 61, 114: n = A,T,C or G
ataccacgtgtgagagaaatacatttggaaaacaataaactaaaaaaaatcccttcaggnntaccagagttgaaatacctccagataatcttccttcattctaattcaattgcnagagtgggagtaaatgacttctgtccaacagtgccaaagatgaagaaatctttatacagtgcaataagtttattcaacaa

SEQ ID NO: 22974 - DNA, 366 bp, Homo sapiens
  misc_feature 41, 58, 61, 99, 147, 150, 206, 207: n = A,T,C or G
ggatgcgaactggggccacgggagccatcgcgctttgcagntcggtctcctggggtgnggncaacgccaagtaggggattgcgttccctccagtcgcanaccctatcagatttggatatgtccttcatatttgattggatttacagnggnttcagcagtgtgctacagtttttaggattatataagaaaactggtaaactgggggnncttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcga

SEQ ID NO: 22975 - DNA, 366 bp, Homo sapiens
  misc_feature 206: n = A,T,C or G
ataagaaggtgagcgaaggaccccctctgagctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctggtngagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatc

SEQ ID NO: 22976 - DNA, 208 bp, Homo sapiens
  misc_feature 57, 61, 123, 162, 180, 181: n = A,T,C or G
gaacgtaattttattttttaataaccacactcatagatggttttgattgttccagtngagngattgtgtatgtacgcataggaatgttttgttcagttgtactttgtatttccaataatcagnaaatcttacctttatgtataaaaacccattatgtaatgnaaaaagggtaaaattggnntaaatcaaaaacaatatttggggagta

SEQ ID NO: 22977 - DNA, 373 bp, Homo sapiens
  misc_feature 132, 203, 206, 207, 285: n = A,T,C or G
gggaaacaaaggaatatcctcatggctcgaaataagaacaacgcctgtggcattgccaacctggccagcttccccaagatgtgactccagccagccaaatccatcctgctcttccatttcttccacgatggngcagtgtaacgatgcactttggaagggagttggtgtgctatttttgaagcagatgtggtgatactgagatnggnngttcagtttccccatttgtttgtgcttcaaatgatccttcctactttgcttctctccatccatgacctttttcactgnggccatcaggactttccctgacagctgtgtactcttaggctaagagatgtgactaccgcctgcccctgactgtgttgtcccagggctg

SEQ ID NO: 22978 - DNA, 366 bp, Homo sapiens
  misc_feature 206, 208, 219: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaggncntagaagagtancatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgctttt

SEQ ID NO: 22979 - DNA, 288 bp, Homo sapiens
  misc_feature 106, 124, 274: n = A,T,C or G
gaggcattgaggcagccagcgcaggggcttctgctgagggggcaggcggagcttgaggaaaccgcagataagtttttttctctttgaaagatagagattaatacanctacttaaaaaatatagncaataggttactaagatattgcttagcgttaagtttttaacgtaattttaatagcttaagattttaagagaaaatatgaggacttagaagagtaccatgaggaaggaaaagataaaaggtttctaaaacatgacggaggttgagatgaancttcttcatggggc

SEQ ID NO: 22980 - DNA, 399 bp, Homo sapiens
  misc_feature 5, 39, 61, 198, 306, 396: n = A,T,C or G
tgccnaaagccaaatttccgtttaagtaattgcctacantaagaagaaattttgcctgccnttttcagaatcctcttttgaagctttctgttgatgttaactgagctactagagatattcttatttcactaaatgtaaaatttggagtaaatatatatgtcaatatttagtaaggcttttcttttttaatttccaggnaaaaataaaaagagtatgagtcttctgtaattcattgagcagttagctcatttgagataaagtcaaatgccaaacactagctctgtattaatccccatcattactggnaaagcctcatttgaatgtgtgaattcaatacaggctatgtaaaatttttactaatggcattatttttgaaaaaataaatttaaaaatacnttc

SEQ ID NO: 22981 - DNA, 382 bp, Homo sapiens
  misc_feature 183, 201, 204, 379: n = A,T,C or G
gacagattctagtgctgagagaaacacgtttggtttggagagtccatggatggggggtttcagtttagctacggcaatcctgaacttcctgaagatgtccttgatgtgcagctggcattccttcgacttctctccagccgagcttcccagaacatcacatatcactgcaaaaatagcattgcntacatggatcaggccagnggnaatgtaaagaaggccctgaagctgatggggtcaaatgaaggtgaattcaaggctgaaggaaatagcaaattcacctacacagttctggaggatggttgcaccgaaacacactggggaatggagcaaaacagtctttgaatatcgaacacgcaaggctgtgagactacctattgtngat

SEQ ID NO: 22982 - DNA, 228 bp, Homo sapiens
  misc_feature 35: n = A,T,C or G
gttgagcagttgtttagaatgactctccaatttantcctcttccccaagaagtttgagttatcaaggctggaagaatttatgttaaagagaaagaatttctttgtaagaaattcttccgtttttacaattattagggtaatgggtttcttgacagtggcattgcaatgaagcccagaattatatttgattaattcaagtcatcttaaatctgtagatgtctaaaaaaa

SEQ ID NO: 22983 - DNA, 371 bp, Homo sapiens
  misc_feature 88, 202, 206, 328, 362: n = A,T,C or G
attttaagaattcttaaaaatgtcgtcaagcaaaccctcagactattttaacccatttatatgatcacttagaacatataagaatgtngattactccacataaccaaaactagagatagagtgctttcaaaatcttaaccaatacaagaagtggaaagctgcatcccataactgtttgatttttttggatgtgagagatgtngagnaatttttctagatccaaggactactttttattactatacaatttcagaagataccaaagcaggtcaaagtaatgaagatttgaactgggctttaaaaaatggtgccagaggccaggtgcagnggctcatgcctgtaatcacagcactttgggaggncaaggcagg

SEQ ID NO: 22984 - DNA, 187 bp, Homo sapiens
  misc_feature 50, 56, 57, 62, 67, 131: n = A,T,C or G
atagtgttgatggaagcaaatcatttttaatgtgtactgtaaaacttganatactnnggggntgagngaatatgtttgttgctacttacaatcccgacctgttagtcccagtagttttgttttaatatggnctttttcaactttgtttcctgtttaactacagatgacttctgttgtagactcacaa

SEQ ID NO: 22985 - DNA, 400 bp, Homo sapiens
  misc_feature 13, 15, 121, 232: n = A,T,C or G
tcccgggattcgntnttatggccgagaactgttaagatggaaaacagtgccaaacctccacagctcatttctttgtaatataatcggaatgaaaaataatttaagaggacagaagactggnacttttttgttttattttttctctagcttatccctgcacaattattaggagtgaatgaaaaaccactttcctgctttccattgttataaattctaagcttaagataaaagngggtctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctgga

SEQ ID NO: 22986 - DNA, 365 bp, Homo sapiens
  misc_feature 233, 262, 264, 273, 361: n = A,T,C or G
atagctgcaagaaatgtggtatgtggagaagttctgtatgtgaggaaggaaaaaaagaaaataaaagtgtgtttgaaaaatattaccttgggttctttgtaaaatttattttttacatgctgaattagcctcgatctttttgattaagagcacaaacttttttttgtaaaacatgtaaaaaaaaaactgggattaatttttagggggggaactgcctcttattttaggctgtngataaaatagcatttttaggttagccagngngactatgcncctaattttttatgagattaaattcataagacttaatttgacaatagtttgggaaatatcttgttactgcttttatttagcagactgnggac

SEQ ID NO: 22987 - DNA, 372 bp, Homo sapiens
  misc_feature 204, 207: n = A,T,C or G
ggggcacacgcctgtagacccagttacttgagggggctgaggtgggagaatcactggagcccaggagattgaagctccagtgagtcgagattgccccactgcactccagcctgggtgacaaagcgagatcctgtctcaaaaacaaatagaaagttgtctttagttctttaatttgtgcctgtttttgttacattactgtttttnatnctttaaaggaattaatactttttcattttatatcttgtattatacttttaaaatgtgatcaaaagcctaatttttggactctaagagaactagaatgtttatttactcaaatccttacattgtggttatattttccagcagacattgaagtaatagaactctgac

SEQ ID NO: 22988 - DNA, 318 bp, Homo sapiens
  misc_feature 75, 204, 205: n = A,T,C or G
gcaagtacaggggtgatggaatgtcgaaaaacctttggagaaccttatctttaagatgtatttgtatgtgtaaancattcaatgtatattgtatagtcagtgtataaaataacacttttagactctaaatattttttcttcaatttttgaaaatacaatttgtaaatggttcaaaagactcagacagcttatgtacagaatgtnngaagaagagaatagtgacaagtggggagaaagccactttgtttctcatttcttttttcttcttctttaactcccctgtaataggaaataaagtatttttgtgatgaggaaatc

SEQ ID NO: 22989 - DNA, 127 bp, Homo sapiens
  misc_feature 12, 28, 103: n = A,T,C or G
atgcttcaaaanttttgtaaattgtttnttttaaacttatctgtttgtaaattgtaactgattaagaattgtgatagtccagcttgaatgtctcttagagggngggcttttgttgatgagggagggg

SEQ ID NO: 22990 - DNA, 364 bp, Homo sapiens
  misc_feature 50, 53, 57, 59, 87, 101, 110: n = A,T,C or G
gagggatcggaaagccggttggggtgtgagaggttttctcgctctagggngantctngnggccatcactatgtcaacagacacaggngtttcccttccttnatatgaggnagatcagggatcaaaactcattcgaaaagctaaaggaggcaccattcgtacccgttggaatagcgggttttgcagcaattgttgcatatggattatgtaaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgc

SEQ ID NO: 22991 - DNA, 400 bp, Homo sapiens
  misc_feature 45, 79, 100, 284, 322, 363: n = A,T,C or G
ctaactttagcaggaggaccaatgattagcatttatgatgcttanacagaacaacttcgtataggaccgtactcctggncaccatttccacatgtggatntctggttgcaccaagatgacaagcaaatactagagaatctttccacttcgcctctggctgagccaccccactttgttgaacatattagatctaccttgatgtttttaaaaaaacacccatctccagctcacacactgttttctggaaataaagccctactctacaaaaaaaatgaagatggctngtgggaaaagatctcttctccaggaagttaaaaaacangaattaccaaagaaagcaccttcttggcctgacagaccatnggtggggctggcaccgaatccagatctggatcctaca

SEQ ID NO: 22992 - DNA, 346 bp, Homo sapiens
  misc_feature 38, 43, 45, 61, 77, 111, 293, 319, 327: n = A,T,C or G
ccgatgttgagtgatacagcaacttgcattaaagatgngtgtncngacatggattctgagntaatatctcatctgtngaagtatatatttgtcccttgctttgggattggnttctggacaccactcccccacccttgctggcatttgccaaggacaccaaaacccaaggatgttgaattcccttttataaaatggcgctgtatctgcatacaacttacacacatcctcccatatactttaaatcatttccagatttcttatacttcatacaatgtgaatgctatgtaaatagnttgttacattgtgtacttatatttgnactattgnattaaatattctcaaatat

SEQ ID NO: 22993 - DNA, 329 bp, Homo sapiens
  misc_feature 44, 45: n = A,T,C or G
gttcacttgcaaaagagatcctattctaccaggaggtgcctaanngcagataatacttaatggagtattggcgcaaaagagcagaaaacttgaggtttttgattgctatttcttgtttgtactttagttaaccataggcaagtactcagaagctaattaccaacctttcaaaatggaaaagcaaaaaaaaaagtaattgcacggttgtccaactccatcaatacgcttgaaaggagccatagttggaaactgggagggaaggaattatttagaatctagaagggagccttgaaactgtttcatgaaaggtgccaaaccttttatgaaac

SEQ ID NO: 22994 - DNA, 400 bp, Homo sapiens
  misc_feature 7, 43, 103, 104, 141, 344, 356, 399: n = A,T,C or G
gaaaganatatgtgagatataataaattattagcaacacattnttgactacctgccttgaataaggataggcattgagaataagaaagagcataagaaatggnnacttgccttattcacacattttcttttctgaatattncttctctatgctatatgtaaaatatgttagaacccttctttctattccaaatggtcatataaaaattataagctactaactatagctgctacttcctaaaatagaacaaactgttcagcctaaattgggaaggagaaatgcactggggttaagaagggtgattgagtataacagatccttctatctaattatgtatacagggnggcaaatgcagnagtaaaacagtgcttagtgtcttatgtttgaagtgaaaattgna

SEQ ID NO: 22995 - DNA, 397 bp, Homo sapiens
  misc_feature 9, 344: n = A,T,C or G
ggaaatganccctgccccccattgaccacaggactgagtccagaatgtcctgcgtgtttcccagagtgtctgtcctaacaccgcttaaagattagccactgctagacagtgatcctcaggtatatggtctcaggattggccccaagcacacggtgtgtgtgtgtgtataaatatatcttcacaaagcataggtacccattaaagccatattgctttgctgaatggttctaatagctacagatgatttctagcctgaaagaaaagcaccacgaattgtttgaagttgacttgcaagatgtggcatgcttggctaagttttgacaggaagggtatgtggtaggggngtacggagcatctcatgagaccagtctcctcctgagaggccgtgatgttggaa

SEQ ID NO: 22996 - DNA, 105 bp, Homo sapiens
  misc_feature 26, 34, 38, 40, 41, 46, 57, 75, 78, 82, 83, 89, 95: n = A,T,C or G
aagatgattatagagttccccaaaanggccttcntacnanntctanattaggtatantatttcagaaaagaaatnaancacnngggaanggcggngagtgcaggg

SEQ ID NO: 22997 - DNA, 394 bp, Homo sapiens
  misc_feature 8, 300: n = A,T,C or G
gaaagacncccaaagctaaatatgcctaaaactactatttactctgatcctagccatctctctagaagtaattactggaatagtttgttggtatcttttacccacttcaatacgtgtatgtacaaaagtctgtgcttttttttatgtaaacagatcacattaagtgccttctgcatcttacattcttttttatctttgcagtaagtacatcctagagatgttttaagtacacgtagatttactgcagttttcttactgctccatgataatcccgtggtacaagatgcactattcccctgntggtggacatttaggtctttctttctatttttgccattatctgcccctgagttttttaagacagctctagactttaggaaatttgcaccttcat

SEQ ID NO: 22998 - DNA, 298 bp, Homo sapiens
  misc_feature 5, 10, 56: n = A,T,C or G
ggaanaacancccctattgaagaagaagatgagagccatggtaaaaagaggagatntcaaggacggtgtcttgtatttcgggcttatacaactggctgtggatagtgctactcactccagaatgcttagggagtttaacatattctgtttcgtgcatgaacaaggaggctagtagtagggtaagaattcttgagaaaagtggaaatggtttgaagttgctaccagggagtattgaagagacatggattaagaaaatgtagaaagtttactatgaaattttgaagattggggattggag

SEQ ID NO: 22999 - DNA, 316 bp, Homo sapiens
  misc_feature 2, 4, 55: n = A,T,C or G
gnanattaccccaatggatggggccaagtaatgtaacatgcattaatagcagatnttcaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggcggaccacctcaatgcaaagattctacaggaaaatgtggccccctccacctattgcaatggggacattacttcattcccggtg

SEQ ID NO: 23000 - DNA, 400 bp, Homo sapiens
  misc_feature 4, 20, 29, 46, 47, 85, 94, 116, 140: n = A,T,C or G
acangtgacaagccaattgngagactgangcacaaactgtcacttnnttaatttaagcacttctgttaatcgagaatttgcttgnttgttactnacatgcctgtacttactttgtnccatgctactgattggcacgtggnccccacaatggcacaataaagcccctttgtgaaactgttctttaaatgaaacacaagaaattggcactggtaaaactctgcagcttcaactgtacttcatttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcataggtcatac

SEQ ID NO: 23001 - DNA, 397 bp, Homo sapiens
  misc_feature 4, 40, 89, 227, 233, 288, 301, 346, 368, 376, 387: n = A,T,C or G
gganaaatcccctgtccttaatttttagaaagattttggnaactaggtgtctcatggctgggttggggtccaaagtgtaaggacccccngcccttagtggagagctggagcttggagacattaccccttcatcagaaggaattttcggatgttttcttgggaagctgttttggtccttggaagcagtgagagctgggaagcttcttttggctctaggtgagttgcangcgggnaagttgaggttatcttgggataaagggcttctagggcacaaaactcactctaggnttatattggatgnagcttatatttttactaaggggcaccttataagcatctataaatngagtcttttcttagtggatggncaggcagnccccattttangaagtggctc

SEQ ID NO: 23002 - DNA, 347 bp, Homo sapiens
  misc_feature 7, 12, 28: n = A,T,C or G
gtgaccnggctnttgtgatacttaattnttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttctttggaaacttttttttggtttgttaaaaaatggctttataaaagggcttttataaccca

SEQ ID NO: 23003 - DNA, 399 bp, Homo sapiens
  misc_feature 5: n = A,T,C or G
gaganccgagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgcattcttggaaagtacgtagactgaaataagtcactattgaaatggcatcaacatgatgctgcccattccactgaagtctga

SEQ ID NO: 23004 - DNA, 400 bp, Homo sapiens
  misc_feature 41, 69, 253, 293, 369: n = A,T,C or G
aaagaaatgttattcagtgggtttgaggtttggactacttncttcaaacttagagaattataacagganggtgtttactttgttcacctggatgtccccaagactctagcttcttctatcagtggttggtctgatagaagaggtaaaaattgctcttgaaaatgtcctacaatttatgcagtttctttggtaatatttttctgtttaaatccctgcttctgtttttggctgttacctaaatatagttcaagtntaattctgtaagagcaaagaaatgaatttgatgaggaaantaagcatccaatggaggattggtcttgaagaccttaaaggtgctttccaacctgcactgctccagtgaaatgtggnaccttttttcttttaaaagcaaccaagagag

SEQ ID NO: 23005 - DNA, 398 bp, Homo sapiens
  misc_feature 4, 321: n = A,T,C or G
cggnacgaacctcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgnaccctgcagtgttgatttttaaaataagagttttctgcagtatgcttttagtctaagaaaagcacagatggagcaat

SEQ ID NO: 23006 - DNA, 400 bp, Homo sapiens
  misc_feature 42: n = A,T,C or G
aaattggatgctatcaaggtattctgtaatatggaaactggntaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcggcttctctccagccgagcttcccagaacatcacatatcactgcaaaaatagcattgcatacatggatcaaggccagtggaaatgtaaagaaggccctggaagctgatggggcaaatgaaggtgaattcaaggctgaaggaaatagcaaattcacctacacagttctggaggatggttgcacg

SEQ ID NO: 23007 - DNA, 400 bp, Homo sapiens
  misc_feature 21, 43: n = A,T,C or G
cgaagatagtaagttgaagtntatttgttggctcatgtcagtnttggagaagaagagaaagaaagacttaaggaatggcataatggatggagcaaggcctaggacagtctatcaaattgttttactggttgtcacacactgttagatttaatccttctaaagatcatgtgagctaagtatccatagtttacagatgagataactgagactcatgaaaggtttggtaacttgccatggccacgcaagagagtaaagtggtagaactgagattcaaactgcacagtatttataccacactgtacgtcatatactttattgacagactaagatttaaagaaaaaattagcttgaagtggaagattgacacatagaactgatagctggtttggaagaactgcaa

SEQ ID NO: 23008 - DNA, 187 bp, Homo sapiens
  misc_feature 2, 7, 12, 25, 27, 31, 42, 43, 49, 51, 56, 61, 111, 117, 121,125, 126, 128, 131, 142, 144, 148, 156: n = A,T,C or G
tnagcanattgnacaggaaaaaaananagangaggggatacnnaagccnanaaaangctanctaccactccccgggcgtcaaagtacatgagccagtatgaaacttatcanggggangagnactnngnccnagacccagatnangatnaccaaacnggattcccatttcgtcaaagggtagactacg

SEQ ID NO: 23009 - DNA, 400 bp, Homo sapiens
  misc_feature 34, 44, 77, 383: n = A,T,C or G
aaaggggtgctactgggccatggtgcaggctccngcagatgctncagaatgaaagccttctcagacctgcgcactcnatctccctcccttttcttctctctgtggtggagaaccacagctgcagagtaggcagctgcctccaggatgagttacttgaaatttgccttgagtgtgttacctcctttccaagctcctcgtgataatgcagacttcctggagtacaaacacaggatttgtaattccttactgtaacggagtttagagccagggctgatgctttggtgtggcagcactctgaaactgagaaatgtcagaatgtacggaaagatgatcaagctattttcaacataactgaaggcatatgctgcccataaacaccctgnaggttcttgatatttat

SEQ ID NO: 23010 - DNA, 397 bp, Homo sapiens
  misc_feature 24, 65, 92, 120, 151, 304: n = A,T,C or G
gaaacaaccccctaacgaagattnacccaaaagcctttctaaccacaaagaaagttgctgaaggntcgtatctgtcccacaatcaactaagngaaataccacttaatcttcccaaatcantagcagaactcagaattcatgaaaataaagntaagaaaatacaaaaggacacattcaaaggaatgaatgctttacacgttttggaaatgagtgcaaaccctcttgataataatgggatagagccaggggcatttgaaggggtgacggtgttccatatcagaattgcagaagcaaaactgacctnagttcctaaaggcttaccaccaactttattggagcttcacttagattataataaaatttcaacagtggaacttgaggattttaaacgatacaa

SEQ ID NO: 23011 - DNA, 399 bp, Homo sapiens
  misc_feature 4: n = A,T,C or G
caancccagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttctgggatcaaatgatgaggagatgtcctatgacaataatccttttatcaaaacactgtatgatggttgtgcgccagaaaaggctatgaaaagactgcattgaaatcaatacaccaaaaattgatcaagacctattgtggatgcatgatcaatgactttggggatcagaatcaagaagtcgggatttg

SEQ ID NO: 23012 - DNA, 193 bp, Homo sapiens
  misc_feature 14: n = A,T,C or G
ctggccaacatggngaaaccccatctgttctgaaaatacaaatatcagctgggcgcggtggagcacacctgtagtcccagctactggggaggctgagacaggagaatcacttgaacctgggaagtggaggtagcagtgagccaggctcacgctactgcactctagcctgggtgacagagcaagactctgtcac

SEQ ID NO: 23013 - DNA, 397 bp, Homo sapiens
  misc_feature 3, 13, 56: n = A,T,C or G
ggnaaattaaccnagggtaccagattaaataaactctggggattcatcccaattcnaactctgtaattctctgaatgaactctctcttcaattaaagccaaattattaacattttaactcaagtttaaatttaatagagaagtcaaaatgaggtatgcactttgtggaatgtttttggtcttatcacaataacctgattaaaatggtgcctttatttccatgtttactcctttaaataagatgaaagctttcagaacatttatttgcaaaatgactgtcaatatcaacaatatgcatcaaagtaccatatatgctaagggagaggagcacttgatgggctgctatgttaactgtaaattgagaactgcttgttttatggcttttgctgtaaaaaaaa

SEQ ID NO: 23014 - DNA, 400 bp, Homo sapiens
  misc_feature 60, 382, 392, 397: n = A,T,C or G
tggggaaacttaccctgtgtctaaagcactgctggcccgccgattctacgccgccccgtngccagggagagtgaatacagctagggacgtgaaagaacggggaagataaccgaagggtggtttgagaaacccaccaggccaactgggaattagaattgattcaaaactccattgatcgcctgacctccataagctcctactctgctgcagttgagtgctgccacttaaatcctgcagtcccgagatccggttataaccaatgcatttagatttttcatttcggtggcaacaatcttcattgtaagttctgtcctacagagaagtgtggtgatcaagctcttcggagatactgggactcctctcacaaatgtatgctcacagntatgatgaanggtgnatc

SEQ ID NO: 23015 - DNA, 397 bp, Homo sapiens
  misc_feature 4, 45, 67, 296, 379: n = A,T,C or G
ggangctggccccgacggaggaggaggatggaggccggtggtgtncgtcttctctctcctcgattgntgcgcgctcatcttcctctcggctacttcataattacattgtctgatttagaatgtgattacattaatgctagatcatgttgctcaaaattaaacaagtgggtaattccagaattgattggccataccattgtcactgtattactgcccatgtcattgcactggtcatcttccttctcaacttacctgttgccacttggaatatatatcgatacattatggtgccgagnggaacatgggagggttgatccacagaaatacacaatcgagggcagctgaagcacacatgaaagaagccatgatcaagcttggnttccacttgctctgctct

SEQ ID NO: 23016 - DNA, 363 bp, Homo sapiens
  misc_feature 42, 43, 361: n = A,T,C or G
gatggcggcctcagcagcgcgaggtgctgcggcgctgcgtannagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacatanct

SEQ ID NO: 23017 - DNA, 381 bp, Homo sapiens
  misc_feature 20, 28, 37, 40, 54, 55, 58, 59, 60, 62, 67, 72, 78, 84, 87,100, 104, 120, 168, 223, 228, 280, 284, 299, 372: n = A,T,C or G
gatcacttcagagacagctntcttaatnttaccttgnccntatttgccccttgnnacnnngnagcangctanaaatcngtgggntanacatagggcagcncttngagaaagtggtttatnccactggagaaaggggattgaaaatcagttagaaccaatgtatttctngccccacggaacactattcctataagatagctgaaagaagctgctgtgaggagcncagcnccaaacacaggatcagcaccttgtataggaatccccatgaattatgacttcncatnctgttttatcagagngcatatatgtcctacttcaggaaaagtaaaacagtcatttacgaaagaaagcaatctgtatcctaagcatttnaataaaggg

SEQ ID NO: 23018 - DNA, 400 bp, Homo sapiens
  misc_feature 4, 6, 36: n = A,T,C or G
tctncntactgctgctacacaagaccctgagactgncctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgctataatcgctacttcaggaagcgccgagggaccaaatgagactgagggaagaaaaaaaatctctttttttctggag

SEQ ID NO: 23019 - DNA, 167 bp, Homo sapiens
tgataatacgtaagaatatttgttaaaatgaaaagtggattgttatacttaagcggaaaaaaacaaattacaaagaacactgatacagtatgatgaacccaagagtctttattatgccttttattggttttgctttctgtaatgaacatgtataattcttccaatga

SEQ ID NO: 23020 - DNA, 236 bp, Homo sapiens
  misc_feature 6, 9, 34: n = A,T,C or G
acattnccnactagtcactctcccagacttgcgngggtcaagatctttctgagtagaggacttgctggtaaaggggcagatgctttttattagtactgataaaacaaactgagggaagcatccctcttagctgggaaacttttactcttcaggagcttggcatcatggactgttaatgtatgtgattttccccctattttctctctccaaaatgataaaaacaataattttattac

SEQ ID NO: 23021 - DNA, 397 bp, Homo sapiens
  misc_feature 9, 55: n = A,T,C or G
ggaacatgncccaggacagaaacaagattaaaacctggatccacagactgtgccncctcagaaggaataatcggtaaattaagaattgctactcgaaggtgccagaatgacacaaaggacagaattcctttcccagttgttaccctagcaaggctagggagggcatgaacacaaacataagaactggtcttctacactttctctgaatcatttaggtttaaggtgtaagtgaacaattctttctttctgccaagaaacaaagttttggatgagcttttatatatggaacttactccaacaggactgagggaccaaggaaacatgatggggggaggcaggagaggcaagagtaaaactgtagcatagcttttgtcacggcactagctgatccctcaag

SEQ ID NO: 23022 - DNA, 400 bp, Homo sapiens
  misc_feature 8, 13, 32, 34: n = A,T,C or G
atcccccnggagnctctctccctactgctgcnanacaagaccctgagactgacctgcaggacgaaaccatgaagagcctgatccttcttgccatcccggccgcttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgctataatcgctacttcaggaagcgccgagggaccaaatgagactgagggaagaaaaaaaatc

SEQ ID NO: 23023 - DNA, 365 bp, Homo sapiens
  misc_feature 3: n = A,T,C or G
ggnaccatcccaattcaatattcacctgccagactggcttatcaagacaaaggttgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgac

SEQ ID NO: 23024 - DNA, 253 bp, Homo sapiens
  misc_feature 6, 13, 52, 57, 185, 193: n = A,T,C or G
attgtncccaagncaaaaaagtgattaagctcagaggacatattccacaatnagggnactaaaagctaagcagaactcagaagaatccccctaaatgatttttcagcatctttgttaaatgagtgctctgagaataatattcgctgacccatttgtgtggtgtgggcagaactatctattgcagntcttgcanccaaacagatggagtccaaacctgtgcacactactcattattatgggctcttccagaact

SEQ ID NO: 23025 - DNA, 397 bp, Homo sapiens
  misc_feature 35, 37: n = A,T,C or G
ggaaggagccctgggtgactttggaagtccgtagngnctcattgcagataatttttagcttagggcctggtggctaggtcggttctctcctttccagtcggagacctctgccgcaaacatgctccgcagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgccagatttctaaatgaaatgtttcactataacgctgcttagaatgaa

SEQ ID NO: 23026 - DNA, 396 bp, Homo sapiens
  misc_feature 2, 142, 240, 326, 335, 354, 364: n = A,T,C or G
gnaaagcaccccgcgtttggatggcaatcgcatctcagaaaccagtcttccaccgtatatgtatgaatgtctacgtgttgctaacgaagtcactcttaattaatatctgtatcctggaacaatattttatggttatgttttnctgtgtgcagttttcatagtatccatattttattactgtttattacttccatgaattttaaaatctgagggaaatgttttgtaaacatttattttttntaaagaaaagatgaaaggcaggcctatttcatcacaagaacacacacatatacacgaatagacatcaaactcaatgctttatttgnaaatttagngtttttttatttctactgncaaatgatgngcaaaaccttttactgggttgcatgggaaatc

SEQ ID NO: 23027 - DNA, 357 bp, Homo sapiens
  misc_feature 10, 181, 307, 334: n = A,T,C or G
gggagtcatncctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgntaactgagctactagagatattcttatttcactaaatgtaaaatttggagtaaatatatatgtcaatatttagtaaagcttttcttttttaatttccaggaaaaaataaaaagagtatgagcttcngtaattcattgagcagttagctcattngagataaagcaaatgccaaacac

SEQ ID NO: 23028 - DNA, 400 bp, Homo sapiens
  misc_feature 44: n = A,T,C or G
aaatccaaagagtgaagatgcaggtggtgcttgaaggagaaacncctcatatgcttctcaggccccatgtgttcatgcctgaagttactcccgacatggattacttaccgagagtacccagtcaaggcattatcatcaatcccatgctttccgatgagaccaatatatgcaatggtaagccagtagatggactgactactttgcgcaatgggacattagttgcattccgaggtcattatttctggatgctaagtccattcaagtccaccatctccagctcgcagaattactgaagtttggggtattccttcccccattgatactgttttactaggtgcaactgtgaaggaaaaactttcttctttaaggattctcagtactggcggtttaccaatgatat

SEQ ID NO: 23029 - DNA, 312 bp, Homo sapiens
  misc_feature 21, 29, 40, 42, 44, 60, 67, 68, 69, 162: n = A,T,C or G
cctgggcaaatatgctctggngcccaaangaacattgtancntngcctgctggaaggcanacatgcnnnctgctatgtaattgctaacattcatattagatgaggtgctgtagcttgatcttccttagcctactgccactgaggcagtaggttttaggtggnatcgtagtgccttttgattaatttaagtatttaattttcatcttccttctttggatctatttggcctctcaaatgaactgagattcctgttaaaaaagattgatgttattgctcttgtagaggaaactaataaagtgtgtgtacctgtgc

SEQ ID NO: 23030 - DNA, 400 bp, Homo sapiens
  misc_feature 10, 14, 54, 375, 386: n = A,T,C or G
aatgggaccntcgnttggaaccatgtaaagaagttcctcgagcgatctggaccnttcacacaccctgatttcgaaccgagcactgaagtgagaaacgtttatttttaaataactgctctaatagttttatgtttcaaaactaatagaatgcttcttttttaatttgctcttacaatgaaaatactaataaaattgttttgtgaaactaaatttttcttaaaatatgagattgaatattcacaactgattttgtttgaatatttgagtcttaacatttctcatgtaatataagttgaaaatttttgtgagaaaaatctaacttcatgacctcatgtaaaaatttaaaatgctttctgaaacatactccccttttgnagtgctactgngaagaaattaattt

SEQ ID NO: 23031 - DNA, 400 bp, Homo sapiens
  misc_feature 41, 42, 51, 103, 123: n = A,T,C or G
gaagtagcccagattttagtcacatttgtgcaattgatttnngacaggtgngtttctaggatattatctcccattgagtcaatatgccgaattcaaatagttntaaatattttattgtgcttntaaaagtattttattgccaaggtagacccacccttattgacagttccaatatagataaaatggattactgcacatccttttctcacacctcagtgttttatgggtttccagaacttaagtgcagtccaaagtaaagggagtatttatgacattttaaaaagcaaaacaggagataattattcttttctctcttcctccaccccctcaaactgaagaacatgattgacttggctttatagggtacacattcctcatctaaatgaaacccaagctgagg

SEQ ID NO: 23032 - DNA, 335 bp, Homo sapiens
  misc_feature 55: n = A,T,C or G
ggaaacaaacccatttatacatatttcttagtgaggctcattgtacatgtattgnagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaaaaaaaaaaaaa

SEQ ID NO: 23033 - DNA, 145 bp, Homo sapiens
  misc_feature 4, 8, 54, 55, 124, 128: n = A,T,C or G
gaancaancccagtaaacaacatagactaaggcactttcctgttttccctcccnntaatctgtcaatattactaacctcttgtgtgtcttaccagagatgttttgtgtatttgtgtgtgtgtgngtgngtgtgtgtgtgtgtgtg

SEQ ID NO: 23034 - DNA, 252 bp, Homo sapiens
  misc_feature 8, 11, 55: n = A,T,C or G
gaaatggnccnaaatttcagaagattagagtcaaggaactaatattcaggaggtnacttcagcagacttgacatccatcttaggtaatattcttaaactacttatgaacaagaataagttaagaggcctggcacagtggctcacgcctgaaatcccagcactttgggaggtggagtcgggcggatcacttgaggtcaggagtttgagaccagcctggccaacatgatgaaaccccatctctactaaaaatac

SEQ ID NO: 23035 - DNA, 128 bp, Homo sapiens
  misc_feature 43, 93, 110: n = A,T,C or G
aataaatacaacacacccaaatacaggatgatagttcgtgtgncaaacagagatatcatttgtcagattgcttatgcccgtatagaggggganatgatagtctgcgcagnggcatgcacacgaactgc

SEQ ID NO: 23036 - DNA, 400 bp, Homo sapiens
  misc_feature 371: n = A,T,C or G
atgtacctgttaatacacagaatgcgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggcttttattattggctgctagatcctggggttctatgttcttttttaagcccaaaaagaagatggggaagaaaagaaggaaaattnctgaataaatatgggggtcaaatatgagt

SEQ ID NO: 23037 - DNA, 319 bp, Homo sapiens
gggaataggccccggtcctagcctttctattagctcttagtaagattacacatgctagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctc

SEQ ID NO: 23038 - DNA, 397 bp, Homo sapiens
  misc_feature 7: n = A,T,C or G
gaatggncccgcttagatgcgccacggtttcggtagcgacggtatctctagccgggcctgagctgtgctagcaccccccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctggccaagtggcattcttctgttcaaatctgggtaaaagca

SEQ ID NO: 23039 - DNA, 335 bp, Homo sapiens
  misc_feature 57: n = A,T,C or G
ggaaaaatgccccgtacctcagctatatcactgcccaacatcagaaaacctgacggntatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttg

SEQ ID NO: 23040 - DNA, 400 bp, Homo sapiens
  misc_feature 21, 27, 33, 35, 43, 93, 95, 121, 168, 189, 225, 242, 349: n = A,T,C or G
gattattactttagtgtggangcagangttgantngacaaatncaaggactttaaaaactttgattgaacaaaacagaaagatcattgctccncntgtaactcgtcatggaaagctgtggnccaatttctggggagcattgagtcctgatggatactatgcacgatcngaagattatgtggatattgtncaagggaatagagtaggagtatggaatgtcccatanatggctaatgtgtactnaattaaaggaaagacactccgatcagagatgaatgaaaggaactattttgttcgtgataaactggatcctgatatggctctttgccgaaatgctagagaaatgactntacaaaggggaaaaagactcccctactccggaaacattccaaatgctcagc

SEQ ID NO: 23041 - DNA, 253 bp, Homo sapiens
  misc_feature 45, 46, 108, 191, 194, 236, 248: n = A,T,C or G
aagaggaaacccgcaccatacaaaaggcatgggaggtgtgaaacnnaagaaaatgtaaagaacctcagcactgctggaaagcatgggtgacttaagatccacaggggncgttcagtggaattggtattaggaagtgaggccggagatgtgagcaaagcctgttcttgatcatgatagagatttcggacttnatngtgtaggccatgaaaaaaggaggaattacaagtcatcgtttnttttttcccccncctgg

SEQ ID NO: 23042 - DNA, 399 bp, Homo sapiens
  misc_feature 42: n = A,T,C or G
gcctttgagaatgtaactgatctgcagtgctcattctagatnacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggcttaaatcactcgaataccttgacttgagcttcaatcagatagccagactgccttctggctccctgtctctcttctaactctctacttagacaacaataagatcagg

SEQ ID NO: 23043 - DNA, 291 bp, Homo sapiens
  misc_feature 4, 12: n = A,T,C or G
gggnattgaccnagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaact

SEQ ID NO: 23044 - DNA, 397 bp, Homo sapiens
  misc_feature 54: n = A,T,C or G
ggaaaggccccgaggcagccagcgcaggggcttctgctgagggggcaggccggnttttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggctgagatgaagcttcttcatggagtaaaaaatgtatttaaaagaaaattgagagaaaggactacagagccccgaattaataccaatagaagggcaatgcttttagattaaaatgaaggtgacttaaacag

SEQ ID NO: 23045 - DNA, 304 bp, Homo sapiens
  misc_feature 23, 36, 77, 83, 93, 96, 124, 132, 133, 138, 146, 161, 186,188, 195, 198, 230, 234, 236, 267, 268, 270, 277, 283: n = A,T,C or G
attccaacttaaaattatgaggnttcagaaatatantgaaagtttaacaatgtttaaaaatagaaaagcatgagtgncatgcnttaaaatganttntaaatttgtactttatattgtgttatcnatctgacnntgcangcagtctncaggttaaagatacntctaacaggttacagtacattgccncngtatgtnaantagatgggataatagaatgcataacccataanattntntgaaagctaagctctaaacttcattctatgnncnctcacanataaantagcttaaaacagaaaggggt

SEQ ID NO: 23046 - DNA, 398 bp, Homo sapiens
  misc_feature 1, 10, 56: n = A,T,C or G
nggagagccncccgcagtacattgagctccatagagacagcgccggggcaagtganagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtgggaagaccatgtctgctaaagagaaaggaaaatttgaagatatggcaagagcggacaaggcccgttatgaaagagaaatgaaaacctatatccctcccaaaggggagacaaaaaagaagtcaaggatcccaatgcacccaaga

SEQ ID NO: 23047 - DNA, 304 bp, Homo sapiens
  misc_feature 55, 95: n = A,T,C or G
ggaagctaacccaaacttacaaaatcaagctctctgtgatcctggttaatacatntaagtacttgagccgataatccaagtactttggggggtcngaggtgagaggatagcatgtggccagaagttcaagaccagcctgggcaacatagcgagactccatctccacaaaaaagtgttaaaaattagccagacatggtggtgcatgtcttagttctaactactcaggaggctgagaaaggaagattactttagcccaggagctcaaaggtgcagtgagctgtgactgcactccagcccgctaaaa

SEQ ID NO: 23048 - DNA, 271 bp, Homo sapiens
  misc_feature 7, 15: n = A,T,C or G
gcggggnatttaccnatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaac

SEQ ID NO: 23049 - DNA, 397 bp, Homo sapiens
  misc_feature 4, 355, 394: n = A,T,C or G
ggangactgcccttggtttcactaagcaagaacatttgtaagaatcagtgctgtcccagatgtagtaatcgctattgagaaataatgaagttccccttactggaagtactcaggaagaagttgaataactaactgcctatgaggagattctgatatgggagggaatctgggagataaagttactgggaagtgaagattctgggagccgatttaatcctcacaacagcacgttaaacaggtagaggaggtttgtaaggaatagtggttaatatcacagagctagaagctagtttcagcagaaccagaattagaatctggcttctgtgccttactaagtttattaagcattcattgngtctactcttttgacttatttaattcactaatggatttnaat

SEQ ID NO: 23050 - DNA, 398 bp, Homo sapiens
  misc_feature 1, 10, 56: n = A,T,C or G
nggagaggcncccgaggcagccagcgcaggggctcctgctgagggggcaggcggancttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggctacagagccccgaattaataccaatagaagggcaatgcttttagattaaaatgaaggtgacttaaacagc

SEQ ID NO: 23051 - DNA, 109 bp, Homo sapiens
  misc_feature 7, 20, 30, 34, 37, 44, 46, 49, 55, 67, 75, 78, 81, 82, 83,86, 87, 89, 101, 102: n = A,T,C or G
cagaagnaaactatgccaantaacaaaagnaaanaanaaaaatntncanaaagcngaaaaggaaaanaaggaaanaangannnaannanaaaaaaaaaatnngctgctg

SEQ ID NO: 23052 - DNA, 397 bp, Homo sapiens
  misc_feature 3, 10, 57: n = A,T,C or G
ggnagagcancccaagaagcatcctctgccaagaccaaaaggaaagaagaaaaaggnccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgccaaaagacgttttctttggccaaagatctctttcgtgattccttgcaacaatcaatgagaatcttcatgtattctggagaacaccattcct

SEQ ID NO: 23053 - DNA, 347 bp, Homo sapiens
  misc_feature 12, 56, 281: n = A,T,C or G
ggaaggaaaccntctgataaaaaccaagatgcctccacattttgtcataattgttnccaatttcacctctgtctccagtatcaccacaaaattgttcttccttggagtgcttggctattcttagccaactgttcctccatattacttctagaattagaccaacaatttataaatcaaacaaacccaagagcattgaaattttgattggatttgtattgaatttatagattaatctggtaaaccatgtcatctttacaatgttgtcttccaatacatgaatntggtacagctcttcatttacttaggcctttgaaatatctttcaataaagtttataattttctccat

SEQ ID NO: 23054 - DNA, 396 bp, Homo sapiens
  misc_feature 2, 34, 56, 64, 73, 95: n = A,T,C or G
gnaaatctcccgagaaaactgaggcaccggagtnattaaccaccttatcaaggttncatgcttngtaggtagnagaatgcgggttacagttcggncagcctgattccacagtccatagtcctgattgctatactgcactatatgctgcctctaaacactgaagcaggagccatggactctcatttacaagtaaggaaactgaagctgaaccagcttaaatatctggctgtaatgatcatatagctagtaataaggtgttactgggttcaaaactagacctagatgattctaaagccattaattcctatatgttattgcctgcaggtaatcagactttctctttctgcaaaagtgcctccccaactgatctttgataaaggagcaaacgcacacagt

SEQ ID NO: 23055 - DNA, 254 bp, Homo sapiens
  misc_feature 6, 21, 50, 54, 73, 253: n = A,T,C or G
gaaagntccccagtatgagancagcctgaccaacatggagaaaccctgtntctnctaaaaatacaaaattagntgggtgtggtggcgcatgcctataatcacagctactcgggaggctgaggcaggggaatcacttgaacccaggaagcagaggttgcagtgagtccagatcacgccattgcactccagcctgggcaacaagagcaaaactccatcgaaagaaagaaaagaaagaaaagagaaagaaaagaang

SEQ ID NO: 23056 - DNA, 399 bp, Homo sapiens
  misc_feature 42, 269, 371, 379, 393: n = A,T,C or G
gagtacttaggtgaaacaaaaaggagttttagtagacagtantatactacatttgaaaatcaaggagcagtttatgcaacgtaaaacgtttacaaactgcagcacaatctactgttcgtgaatgtcaaagtgtcatgaggaaagtgtctatacaatcacagagttatatttcctcacaaagttctttacaaagagtgaaatatgtttttatacctctcagtttcagttagaggcatattttgtgtaatatttatggcttaaaatggacnaaaggcctgtcttgccttgctgaacttgccgcttttgcattctttgagtcaggttaaagacagtactttaagcccattttaaaccctcaggctagaaatcgnaccactgntaattaagccacantattgg

SEQ ID NO: 23057 - DNA, 400 bp, Homo sapiens
  misc_feature 44: n = A,T,C or G
ctcctgaaaactgcagctttccttctcaccttgaagaataatcntagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagcactgcagatgacaggaaagtcaagagcaccataaccttagatgggggtgcctgggacatgtgcagaaatgggatggaaaatcaaccaccataaagagaaaacgagaggatgataaactgg

SEQ ID NO: 23058 - DNA, 397 bp, Homo sapiens
  misc_feature 3, 5, 53, 345, 362: n = A,T,C or G
ggnanaatacccatttataattatttgtaattaactcattagttcaggctaantatcctgaatttttttaagaggaacaaacaccatgatcttccagtttgtcccatgttaaggtagacaatgccactacagtgtgcattccttatggtagatacaacacatatcctgctttgcagaggcagcctggtcatgcaaattgtcctggaataattattaatagtatccactttcacactcaagagtgtcctgctttgaattataaatgatttggcatcctacacataaaatatcctgctttggaacagttactttattattatttttttgctggatatatgaagttgntcctacttcttcatagnatgcattagtattttctaactctcccttaagcagg

SEQ ID NO: 23059 - DNA, 356 bp, Homo sapiens
  misc_feature 40, 43: n = A,T,C or G
cggcgtaaatctaactttcttcccacaacactttctcggnctntccggaatgccccgacgttactcggactaccccgatgcatacaccacatgaaatatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggctccatgactttttcaa

SEQ ID NO: 23060 - DNA, 397 bp, Homo sapiens
  misc_feature 5, 54: n = A,T,C or G
ggaanttgcccaagagaaaagaaaggagacacttagtaccaccagtttcagcantaaagaagggtcattctgtattcaaaattgtactgtagataaatcattcatgagattgtaaaaaatgtttgtcttgtgaccttgtgtttttgaagtcagacaaaaccgtgtaatcaacttgcacaaaaagagggtacacagtgaacatataaacacagacctaatcaaacaggagcagattcctcatggtgcttgtttattatatatatttaatcctgcttgacactttacccaagggagatggcccttttatcagttgaatgttagcagcgttatttcagagtgtgggactggttagagaaactcatgactcaaccagcacagtttcaaacaaaatttttat

SEQ ID NO: 23061 - DNA, 400 bp, Homo sapiens
  misc_feature 47, 48: n = A,T,C or G
gaggcagccagcgcaggggctttcttgctggaggggggcaggcgggnntttgagggaaaccgcagataagtttttttctctttgaaagatagagattaatacaactacttaaaaaatatagtcaataggttactaagatattgcttagcgttaagtttttaacggtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagg

SEQ ID NO: 23062 - DNA, 400 bp, Homo sapiens
  misc_feature 43, 125, 166, 167, 174, 224, 312, 334, 368: n = A,T,C or G
taaatatatttttgtggaaactaagcgcgtggattttgagtcnatgttttagacatagtgctgtatttcatttttctgttcaaaaggccatagacaaaggaatcaatataattgaaaggggtaangaaaaggggtattgaaaaatgaaagtgtggctagtggaatnntatcacngggaaaagataatttgctgaacttgtgatcagacttttctaagatgcagnatatatatcttatgaactcccacactcctctatcttaattggtctttcctgtcacttcttactttatatcgctacttaattatggggnagccatttctgtgacagtcttnagaaggttctctgtttggaccccctaagataagnattacttttttcataacacactttccttcttc

SEQ ID NO: 23063 - DNA, 399 bp, Homo sapiens
gttctcagatcaatagtgtaagtttctttctcaaggaactacttagtttctatgtaagagactagaaaaagaagagaaaataaacccgaagtaagcataaataaataaataatgaagacaaaaacagaaatcgaagaaattgaaaatacaaaaacaacagagaaaaaccatgaaacaaaagctatttttggaaaaaaaaattaataaaattggtaaacctttgacaagactgaaaaatctaagaagggaaggcctgaatcaccaatatcagaaatggaatagtggatatcagtacagatcctgcagccattaaaaagttaacaagaaaacactataaacaacttgatacccataatttaggaagaaatgaatctcaattctttgaaaaccacagactac

SEQ ID NO: 23064 - DNA, 399 bp, Homo sapiens
  misc_feature 23, 267: n = A,T,C or G
gtggcgtttccttgaggaagagngagggttccaacttttctgcttatctgggaggtgttgggcgcggacagtcgagatgtcagagaaaaagcagccggtagacttaggtctgttagaggaagacgacgagtttgaagagttccctgccgaagactgggctgcttagatgaagatgaagatgcacatgtctgggaggataattgggatgatgacaatgtagaggatgacttctctaatcagttacgagctgaactagagaaacatggntataagatggagacttcgtagcatccagaagaagtggtgaagtaacctaaacttgacctgcttaatacattctagggcagagaacccaggatgggacactaaaaaaatgggttattttcattatctgcttgg

SEQ ID NO: 23065 - DNA, 385 bp, Homo sapiens
  misc_feature 44, 298, 316, 318, 350: n = A,T,C or G
tcaaacacagactgatattaaccagccaggtaaattgaacgacnatgtggcattaggtatttggctgtttattggtcgttaaatactatggttttgcaatatgattgatggtaaaagagtgatgtcatattgatactagagtagcttgtttttttagtaggtgtgggaccatctcttttacaagtgcaactcagtctaggacagccatggatgcagtgctggagttgggaccctctgagcccgctgctgccccagtagcatctgcattggtgaccaaggacactgcactttgaagagncgccactgggtatttagngncttcactgctttggtaaaaattggaaaatttngacacaaaaagtggggttttgaatatcaattggtt

SEQ ID NO: 23066 - DNA, 397 bp, Homo sapiens
  misc_feature 30, 78, 337, 391: n = A,T,C or G
ggaaaattccccaagatgacagaattcggnccgagatgtctcgctccgtggccttagctgtgctcgcgctactctctntttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggctttctatctcttgtactacactgaattcacccccactgaaaaagatgagtatgcctgccgngtgaaccatgtgactttgcacagcccaagatagttaagtgggatcgagacatgnaagcag

SEQ ID NO: 23067 - DNA, 238 bp, Homo sapiens
  misc_feature 3, 14, 36, 42, 47, 48, 93: n = A,T,C or G
gtnacgcgagcttnttcacgaggtcaggagttcganaccagnctggnnaacgtagtgagactccgtctctactaaaaacacaaaaaaaattanccgggcatggtggcgtgcacctgtagtcccagctgcctgggaggctgaggcaggagaattgctggaacctgggaggcggagcttgcagtgagccaagattgcaccactgcactccagcctgggcaacacagaacagaccctgtct

SEQ ID NO: 23068 - DNA, 349 bp, Homo sapiens
  misc_feature 3, 9, 333: n = A,T,C or G
agnttaagnaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagcaaatgccaaacactagctctgtattaatccccatcattactggtaaagcctcatttgaatgtgtgaattcaatacaggctatgtaaaaanttttactaatgtcatt

SEQ ID NO: 23069 - DNA, 168 bp, Homo sapiens
  misc_feature 7, 26, 27, 28, 33, 39, 44, 74, 80, 117: n = A,T,C or G
gtgcttnaaatcagtcttcagggctnnnacagnatgggncctgntgacacgagaacccaaagttttcccaaatntaaatnatgaaaacagaatccccaccccaatcccaaattttgntttggttctaactacctccagaatgtgttcaataaaatgcttttataatat

SEQ ID NO: 23070 - DNA, 193 bp, Homo sapiens
  misc_feature 4, 24, 48, 55: n = A,T,C or G
catnacttcatgataaaaacaacntgagtacagaaggaacatactttngcatganaaagccatatactaaaaatccacagctagtatactaaaaaggaataactgaaagcttttcctctaagatctggaacaagacaaggatgcctactttcatcacttttgttcaacatagtactagaagccctagccagag

SEQ ID NO: 23071 - DNA, 289 bp, Homo sapiens
  misc_feature 4, 14, 26, 27, 34, 37, 43, 53, 57, 89, 92, 190, 247, 253: n = A,T,C or G
tganattgtatctnttacttacaagnnctatganctnaaattnttgacttaangganatggggtgtattttcctcaaattaatattggnggncaagactatatctaattcctctgatcactttgagaaacaaacttttattaaatgtaaggcacttttctatgaattttaaatataaaaataaatattgntctgattattactgaaaagatgcagccatttcaatgttatgggaaacaattttttgnttttgntctgttttctttttgcttcaataaaacaatagctgg

SEQ ID NO: 23072 - DNA, 272 bp, Homo sapiens
  misc_feature 3, 5, 27, 44, 62, 66, 81, 97, 106, 178, 191, 217: n = A,T,C or G
agnanaaagtatagacttagaaatatnaaggtaagagctatctntttaaatatatagatatngagngcttggaatcctagngtactatgtgaaaatnaaggctaanggcagaataactcacagaaaaatagaaaatgcacagctttaaaatgggcagaggtaaaatctattcccagcnttatcacttattnagccatgctagcctaggcctctattnccttgctccaaaatgagaataataaaatttaggcaggattactatataaactaag

SEQ ID NO: 23073 - DNA, 124 bp, Homo sapiens
  misc_feature 12, 19, 38, 40, 43, 46, 47, 59, 62, 79, 80, 81, 83: n = A,T,C or G
tgaagtagaaanaagaggnaattgaaaaaaggtaggananaanttnntctgcatatggntgnatatatgtaagaacagnnngnatgggaagggagggagcagaatgatgcgaataaagacggta

SEQ ID NO: 23074 - DNA, 383 bp, Homo sapiens
  misc_feature 24, 25, 44, 47, 80, 82, 83: n = A,T,C or G
catgtggtttaaagtactcatgcnntaatcacaaaatgttactnttncattagattgaaataatgcttcactaatttgcnannatggagaaatagtgcaggtaaaactctcagacagcatttccacaaaatggaaattagtttttaaataattttaaatctaaaaaccttatcatttagaacatttaaactcttcattaactttctgatcaaataggaaatttaaaagtataggaaatctacaaagtaacagcaacacatatataatcagaatctatgggatattgctaaatcgataaacaagaaagaaaataaatgaagtatccagtctagaagtttaaaagaacaataacactaaggcaaacagatggaaagaatactaac

SEQ ID NO: 23075 - DNA, 173 bp, Homo sapiens
  misc_feature 2, 15, 32, 42, 43, 45, 55, 56, 61, 68, 75, 85, 94, 151, 158: n = A,T,C or G
cnacatattaagcangctactatagaaagatnactgtcattnntntggaacaagnnatggnacaaggnttgatgnagaggaactntcaactatngaacagtatcaatagtgggaattacctgaatttcagttgactggactccctcattgntaaaggntatctttatgttatt

SEQ ID NO: 23076 - DNA, 226 bp, Homo sapiens
  misc_feature 3, 22, 35, 43, 70, 86, 100, 156: n = A,T,C or G
gancagtgtattccagtatcanccagggtgcagcnacaccatnactgtgttgaagggggtgttttttctnttaaatgtaatacctnctcatcttttcttnttacacagtgtctgagaacatttacattatagataagtagtacatgggggataacntctacttttaggaggctactctcttctgacaagtcctagactggcttctacactaagacaccatgaagga

SEQ ID NO: 23077 - DNA, 342 bp, Homo sapiens
  misc_feature 10, 23, 42, 43, 44, 46, 61, 64, 65, 77, 78, 79, 213, 221,295, 308: n = A,T,C or G
aggaaaaggnccggagagctgancagtcaagatgtgtgactnnntngaaaccagaccgcanagnncaaggaggcctnnnagctgtgtgaccgaacaggtgatggcaagatcctgtacagccagtgtggggatgtgatgagggccctgggccagaaccctaccaacgccgaggtgctcaaggtcctggggaaccccaagagtgatgagatgaangtgaaggngctggactttgagcactttctgccatgctgcagacagggccaagaacaaggaccagggcacctatgaggattangtcgaaggacttnggggtgttgacaaggaaggaaatgcaccgcatgg

SEQ ID NO: 23078 - DNA, 379 bp, Homo sapiens
  misc_feature 31, 38, 44, 45, 47, 125, 223, 229, 344: n = A,T,C or G
gactatgaattaaacaggcagtgcttgggtntggatgncctctnntnctcagggtgcctcccattcatgaggagccccaggtgtattgtgacaacaagatcattaccacatgcgtggctgcgggnggatgtgtaggttttgggaaatgattacttggaaaattaagttcttatacctggcagcttacctcttaaaagtggagaaacagtggccaggtagactntgctgngaattacaagggcatttcttctgctgaaaggcatttcaggccgggtgtggtggctcacgcctataatcccaacattttgggaggctgaggtgagaggatcagttgaggcaggagntagagatcagcctggcaacaaggagaccctgctct

SEQ ID NO: 23079 - DNA, 185 bp, Homo sapiens
aatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaag

SEQ ID NO: 23080 - DNA, 235 bp, Homo sapiens
  misc_feature 5, 7, 30, 31, 57, 58, 67, 73, 95, 131, 182, 195, 206: n = A,T,C or G
tctgntnttgagagtctacttaagataccnnttacaagcgggatctggcttacattnnttgagcatngtattntggaaaagagtttccttcctcngaaaaatgggcagagttctgaaggagaactactggncttattgacacttgctgacctatttttatttaacaaatattcatctatggnataataaagatgncatgattgagntgctcactggaatctttggtatctcagag

SEQ ID NO: 23081 - DNA, 110 bp, Homo sapiens
  misc_feature 5, 7, 30, 38, 42, 43, 52, 58, 65, 77, 102, 106, 107: n = A,T,C or G
gctgncngggaagcttttgcgaaaagggangggatatnggannaataacctngaaatngtaaagngacacggggcgnggcaagaccgagtcaaagctaaatngggnnggg

SEQ ID NO: 23082 - DNA, 347 bp, Homo sapiens
  misc_feature 7, 48, 121: n = A,T,C or G
cctcttnttaaaattggatgccctctcaaacttccactttatcctttnaccgcctgtaccagagattaaagttgtgtcaaatctgccagccataaccatggaggaagtagccccagtgagngttagtgatgcagctctcctggccccagaggagatcaaggagaaaaataaagctggagatataaaaacagctgctgaaaaaacagctacagacaagaaacgagagcgaaggaaaaagaaatatcaaaagcgtatgaaaataaaagagaaggagaagcggagaaaactgcttgaaaagagcagtgtagatcaagcagggaaatacagcaaaacagtagcttcggaga

SEQ ID NO: 23083 - DNA, 400 bp, Homo sapiens
  misc_feature 45, 74, 77, 94, 337, 341: n = A,T,C or G
caggataccagcttccttcagcagcgcaggcgggtggccctgatnttcgtggaaggagtcaaacttgcgggaanttngcagaggtcattgtatncaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaancggnatttaagcaatgaagatatgtttaagagaaggggatgaaatagatgagataaggagagc

SEQ ID NO: 23084 - DNA, 380 bp, Homo sapiens
  misc_feature 12, 31, 63, 90, 111, 300, 365, 377: n = A,T,C or G
aacagtaggctnccaccttaaagaacatggngtatatagtaatgttttgaagtgaagactggngctcgaatgaattgaatgttggtagtngtctttgaaaaccaagagggnacggtactcagattaaaaatatgtctaaaagtacagaatttaaaagtatagttatctatactttatacttatctgtgatagataactatagctgtcacatttggggcattggtgtgaaagcaagagggctctaggatttggcagcatcaaaagcagaacttagtgaaaatcagggtgatttaaaatttntccattaagaatatgaatcagaacgaatgcatcttgggctaaattagaatttgagaaggttattngggaaactgggntta

SEQ ID NO: 23085 - DNA, 289 bp, Homo sapiens
  misc_feature 6, 7, 55: n = A,T,C or G
gaatcnncccatatagtaccgcaagggaaagatgaaaaattataaccaagcatantttagcaaggactaacccctataccttctgcataatgaattaactagaaataactttgcaaggagagccaaagctaagacccccgaaaccggacgagctacctaagaacagctaaaagagcacacccgtctatgtagcaaaatagtgggaagatttataggtagaggcgacaaacctaccgagcctggtgatagctggttgccaagatagaatcttagttcaactttaaatttg

SEQ ID NO: 23086 - DNA, 397 bp, Homo sapiens
  misc_feature 4, 11, 373: n = A,T,C or G
gaanaagcccnatctataatgtggttgtgcaccaaaatagttcctagaacttttctgaatgaagagaaaaggaaaacaattttattttattcacatgataataaaaactgactatacatgactaacttgaaacttcagttaactactaggctactacttgccttatctatagttggcattatgatcacaagccagctcctaatagtacttgttagcatatatcctagcctaggaaaggctggggggaaaaaagcacttgacaaaacaacagttacattctaagtaggaaaatcagtatacatatacacaaaacattgtaagagcacaagataatgcagtactaataatgctaatttggatgggggtctgtagntccaaaatgcttatatattttctc

SEQ ID NO: 23087 - DNA, 380 bp, Homo sapiens
  misc_feature 284, 291, 324, 378: n = A,T,C or G
gcctctccagatggtaatatactagcgtaagattccagtaagaccaacaccacactgcagtttgaggtgtgttccatggctctgccaatgttgtgttttcattttttaattactcaacagtttgctacaacgactgagatctctaccatagaaattgcttcttggattgagatattctttccagaatgtcacagaaaaagttttatattttacctgggttgatttaacttcatcggtgggaagacctgattcttctttttatagagatgtatataactcattgngattagntccttttatccttgctaccaggaaaacaatggnaaattgaatatataaaaactatatagattataatcaataaggttatatacatgngt

SEQ ID NO: 23088 - DNA, 400 bp, Homo sapiens
  misc_feature 47: n = A,T,C or G
ccggctggaaccatggagggtgtagaagagaagaagaaggaggtttntgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcaagaggtatcaatggagtgagcccaaaggttcgaaaggtgttgcagcttcttcgcttcgtcaaatcttcaatggaacctttgtgaagctcaacaaggcttcga

SEQ ID NO: 23089 - DNA, 100 bp, Homo sapiens
  misc_feature 6, 22, 35, 47, 50, 53, 59, 67, 68, 75, 79, 85: n = A,T,C or G
agaganatatgcagcggaatcnctagcacaaagtnacactaataagnaanatnagcganctaacatnngcgcaantgancaaganaaccaaaaacgacca

SEQ ID NO: 23090 - DNA, 400 bp, Homo sapiens
  misc_feature 7, 30, 44, 48, 120: n = A,T,C or G
catgctntggtatgacagactatcagaggntccaaaggtcctcntttnggcctcggctgacactgtcttctctcaccatgctcagttttttctgaacccagagctctgagagccgagtgngaagaaagctccagacttggccagaactccaaccatgtggaatctgagggcctggccttctagagcaggttctagaaggtggatgtgttctatggtataaagcatcccctttctggccaaactagctcttggaggaacgagcaaaacagaagcggtgcatacctcagagcctggataaatcacagactattgaacctggaactggctttgaccatgaaactgtgaatggcctaacttcaagggaaatgagaaatcgaaggaattggccaatggcgaggag

SEQ ID NO: 23091 - DNA, 384 bp, Homo sapiens
  misc_feature 1, 47, 89, 111, 134, 331, 371: n = A,T,C or G
nggtttatgaggtctgctgaggcgactagcaagattttctattgcgntatgaacacgtttgccatctttctgtctcttatcatgtgggnggagggggccgcagccattgcnggctatgtgtttagagataaggngatgtcagagtttaataacaacttccggcagcagatggagaattacccgaaaaacaaccacactgcttcgatcctggacaggatgcaggcagattttaagtgctgtggggcttgctaactacacagattgggagaaaatcccttccatgtcgaagaaccgagccccgactcctgctgcattaatgtactgtggctgngggattaatttcaacgagaagcgatccataaggaggctgngtggagaagattg

SEQ ID NO: 23092 - DNA, 113 bp, Homo sapiens
  misc_feature 18, 42, 57, 76, 85, 99, 100: n = A,T,C or G
aatatagcttaaaattgnggagatattccaatacaaccacantgttttcatggggtnaggggcagactgggatganttactcttnacacccagccctgnntctcagtacatac

SEQ ID NO: 23093 - DNA, 100 bp, Homo sapiens
  misc_feature 4, 10, 30, 38, 40, 46, 48, 73, 75, 81, 83, 84, 87, 91, 95: n = A,T,C or G
gatnagtatnaacgagaaattgggataccnacgctctntntactancnaatcatcacccgaagatgtaagatncnccaaantnnagnttgnttgnaacat

SEQ ID NO: 23094 - DNA, 100 bp, Homo sapiens
  misc_feature 30, 37, 38, 44, 46, 47, 50, 56, 58, 59, 60, 72, 79, 82, 87,89, 91, 95, 96: n = A,T,C or G
cggtgggggctatagcatatgctttttttntttaaannataacntnnttnaaaaancnnngaaaaaacgggnagggttncanaaaancngnaacnngcat

SEQ ID NO: 23095 - DNA, 223 bp, Homo sapiens
  misc_feature 4, 18, 34, 43, 46, 78, 82, 90, 91, 93, 109, 122, 165, 167,174: n = A,T,C or G
cgantaaaggcaaaggcngcataatgaaactggnagatggaanatnaggacacatgctggaggatacaatatcagatntganaatgtagnnantactgcgagtcatggncaaaataaaaaantgaggtacattatcttatgagttcaggtgtgtgtctctagcangnatatagngaagcctgattcactttttattccaaaggtatgtgggacagatcacttg

SEQ ID NO: 23096 - DNA, 100 bp, Homo sapiens
  misc_feature 16, 43, 81: n = A,T,C or G
cccatactggctttgnaatcattaattttttggcagattgaangtgttgtattgatatgtatctatgtaattgtattgtangtctatagctaattcacgt

SEQ ID NO: 23097 - DNA, 100 bp, Homo sapiens
  misc_feature 2, 15, 32, 34, 37, 47, 50, 56, 62, 74, 81, 97, 98: n = A,T,C or G
tngtttataagcaangttagaagcattaatananttnaagcgttgcngangtatantcgagntcagcacagagnggaggcnacacagaacaggagcnngg

SEQ ID NO: 23098 - DNA, 349 bp, Homo sapiens
  misc_feature 7, 52, 322: n = A,T,C or G
aaatgancccgcagcttcttctaccttgaagaataatcctagaaaactcacntttgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagcactgcagatgacaggaaagtcaagagcaccataaccttagatgggggngcctggtacatgtgcagaaatgggatg

SEQ ID NO: 23099 - DNA, 100 bp, Homo sapiens
  misc_feature 8, 17, 50, 71: n = A,T,C or G
aaaccacncaaaacagnagctattttagtacaaaaatacatatggaagcngaatcaacttacattcacctnaggcataacatgggaaacctttaggggag

SEQ ID NO: 23100 - DNA, 276 bp, Homo sapiens
  misc_feature 4, 10, 28, 34, 45, 79, 102: n = A,T,C or G
tcantgcaanctccacctcccaggtttnagcgantctcctgcctnagcctcccgagtagctgggattacagacatgcgncaccatgcccagcaaatttttgnatttttagtagagtcagggtttcaccatattggtcaggctggtctcaaactcccgacctcaggtgatccacccgctcagcctgcaaagtgctgggattataggcatgagacaccatgcccggctgacaatccaattttataaaactggaagagtttggcacttcaaaaaagaag

SEQ ID NO: 23101 - DNA, 226 bp, Homo sapiens
  misc_feature 10, 19, 29, 47, 72, 75, 101, 102: n = A,T,C or G
aaaatcaaantctaaatgnagaagttttnctaggtttgccttgcaanagctcattattcccagccaacaganctncagctactctttgcatttgaatatgnngggaaaaaataccacaattcaggtaaatatgaaaatattaaatattgtgactaattttacatgtgtaaattttactcttatgtttaccggaagcctccaagtacatgagctttaatgattgtag

SEQ ID NO: 23102 - DNA, 99 bp, Homo sapiens
  misc_feature 9, 38, 60, 73, 76, 79, 88, 89, 90: n = A,T,C or G
cgacatggngcacctgactgctgaggagaagtatgttnttactgccctgtggggcaaggngaacgtggatgangtnggnggagaggcnnngggcaggct

SEQ ID NO: 23103 - DNA, 225 bp, Homo sapiens
  misc_feature 133, 144, 156, 170, 181: n = A,T,C or G
ctaatgtatgtgaatggagtagattgaaagtaaagaaaacccatgttcaaattgttcattgttctatctgaagggtaataaatatactgggagagagagaatttatatatttgcagctttaactaattttggntttgctatagnccaaaggcattnctgcttagaaatgnttgtaaggtgnttctttccccagtaactggattctaatgaggatagcaggtatta

SEQ ID NO: 23104 - DNA, 319 bp, Homo sapiens
  misc_feature 11, 41, 49, 263, 270, 274, 309: n = A,T,C or G
gcactgcgcanaccagacttcgctcgtactcgtgcgcctcntttcgctnttcctccgcaaccatgtctgacaaacccgatatggctgagatcgagaaattcgataagtccgaaactgaagaagacagagacgcaagagaaaaatccactgccttccaaagaaacgattgaacaggagaagcaagcaggcgaatcgtaatgaggcgtgcgccgccaatatgcactgtacattccacaagcattgcttcttattttacttctttnagctgcnaacntggtaagatgcaaagaggttggatcaagtttaaangactgtgctg

SEQ ID NO: 23105 - DNA, 100 bp, Homo sapiens
  misc_feature 9, 20, 28, 38, 40, 44, 46, 48, 49, 52, 54, 62, 65, 76, 77,97: n = A,T,C or G
gcaggaacntgtatttattngggttatnaaggtgcgtntnggcncngnnttntnctggtttnacngcactcggtannctattcatgattaatcaggnaga

SEQ ID NO: 23106 - DNA, 194 bp, Homo sapiens
  misc_feature 29, 31, 35, 37, 41, 44, 48, 58, 122, 142: n = A,T,C or G
caggaaaatattttctttatgtaaatatnancatncnaagnctntttnaaaaagtttnaaactcaagcaggccaaaaccaatatgcttataagaaataatgaaaagttcatccatttctganaaagttctctatggcaaagnctttcaaatacgagataactgcaaaatattttccttttatactacagaaatg

SEQ ID NO: 23107 - DNA, 292 bp, Homo sapiens
  misc_feature 3, 4, 45, 47, 52, 81, 120, 228, 237: n = A,T,C or G
agnngagaacatggacgttaatatcgccccactccgcgcctggtntnatttnttcccgggttccgatcgctttgcccgggnggacttcagggacatttccaaatggaacaaccgcgtagngagcaacctgctctattaccagaccaactacctggtggtggctgccatgatgatttccattgtggggtttctgagtcccttcaacatgatcctgggaggaatcgtggnggtgctggngttcacagggtttgtgtgggcagccacaataaagacgtccttcgccggatgaaga

SEQ ID NO: 23108 - DNA, 100 bp, Homo sapiens
  misc_feature 2, 22, 45, 47, 50, 53, 56, 57, 62, 69, 72, 79, 83, 95: n = A,T,C or G
cnagggagattgaagtcaatcngtatcgcgaggtagagaaggaantntangangtnnagaanataacanaanacagagngggnaataattgcgcncaaag

SEQ ID NO: 23109 - DNA, 235 bp, Homo sapiens
  misc_feature 10, 14, 28, 39, 113, 179, 220: n = A,T,C or G
ataaaagctntgantttgccctgtatgnatgatgacttnagtgtgcaagatgaagtttaatacctgtaaaaactacaaagaagttcccctagcatttctaggccaaaccttgnaattgacttcagctatgtacgtggcaagcttagactgaaatgctaggtatatgtattggcttcagngatgacccttcattgtaagctatgaaagtaaaactctgtanttaactggcaatgag

SEQ ID NO: 23110 - DNA, 100 bp, Homo sapiens
  misc_feature 9, 19, 35, 50, 52, 53, 67, 77, 85, 88: n = A,T,C or G
agtgtagtntctgtggggnagcgagttttaccgantagttttctttgaantnnatatcactctaaanttagcatagnctagttgntangtagtttacgat

SEQ ID NO: 23111 - DNA, 213 bp, Homo sapiens
  misc_feature 18, 38, 39, 45, 48: n = A,T,C or G
cggacagtatcctcaagntatgcactgacctaagaagnnataaanttntgaatagaactttaaccattacagaaattgacacttaaaaagaaacaggccaggcgcagtggctcacacctgtaatcccagctctcagggaggcagaggcgggaggatagcttgagcccaggagttcgagacctgcctgggcaatatagcgagaccccgttctcc

SEQ ID NO: 23112 - DNA, 319 bp, Homo sapiens
  misc_feature 2, 29, 30, 45, 47, 49, 53, 55, 58, 60, 74, 86, 91, 95, 104,105, 296: n = A,T,C or G
cntatgatatccaaaattggacggactcnnactacaaagtagcanantntttnanganancctaaactattacngagaaagttgcngatgnaggnacagaccanntgtggtggaaatcacgcatagagcaaacctggtgctcatttttaagtgggcatgggaagagggccccaagcctagtaaagcctaagctgggcttcacaggtgctgggaagaatgtgtttgggtggataaatatatgatataagatttatatatgttgctaacgccacatattgaaggccaacataactggnggcagcgtgggtgacagaaaatg

SEQ ID NO: 23113 - DNA, 243 bp, Homo sapiens
  misc_feature 10, 14, 30, 36, 45, 56, 71, 102: n = A,T,C or G
aatttaaccnaggnagaccaggaggatttnctgatnatccacatngagggtttgtnacagtatcctacctnctggaagggggcagcatggccatgaagactnctgtggcacactggtaaaatgaacccaggagatttgcagtggatgactgcggccggggcattctgcatgctgagatgccttgctcagaggagccagcccatggcctacaactgtgggttaatttgaggagctcagagaaga

SEQ ID NO: 23114 - DNA, 397 bp, Homo sapiens
  misc_feature 14, 51, 91, 171, 173, 264, 328, 351, 357: n = A,T,C or G
atgggaaatgcttntacttgaaaagaaacagcagttaacatagctagtgtncagcttgtggattaataaggaagtgttttacttaaaaaantttaacataatttaaccccttgctagtgcctatgtagggaatctacctttaactgtattattatagtatgtttaaaattngngtttaaatagcataaaatttaatcagtgcaagtgttaaaagctgttatagcatttcaaaaaattttaaaatattagacgttgaaaataagntgggggaaatgaactacgatatattgcatattttaaaggcattgcactatcagaaacaatttgnaataattacagatatagatttgnttactntcaggggggatattttgtcttaaacagacttcaattgtgg

SEQ ID NO: 23115 - DNA, 399 bp, Homo sapiens
  misc_feature 29, 34, 35, 38, 44, 47, 395: n = A,T,C or G
aagagaacaagattactatcactaatganaaggnncgnttgagnttngaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcaggctgctgagaaggaagaatttgaacatcaacagaaagagctggagaaagtttgcaaccccatcatcaccaagctgcaccagagtgcaggaggcatgccaggaggaatgcctgggggatttcctggtggnggag

SEQ ID NO: 23116 - DNA, 172 bp, Homo sapiens
  misc_feature 19, 20, 31, 38, 41, 43, 44, 48, 61: n = A,T,C or G
gtgtctactaaaaatacannattagagtggncggtggngantnntgcntgtaatcccagcnactcaggaggttgaggcaggagaatcacttgaacccaggaggtggaggttgtggtgagctgagatcgtgccattgcactccagcctgggcaacaagagtaaaacttcatct

SEQ ID NO: 23117 - DNA, 200 bp, Homo sapiens
  misc_feature 10, 11, 37, 51: n = A,T,C or G
agtatgtggnnagtgtctatgctcagaatccaagttnagagaggcagcctntggttcagactgcagtaaccactattcctgcaccaactgacctgaagttcactcaggtcacacccacaagcctgagcgcccagtggacaccacccaatgctcagctcactggatatcgagtgcgggtgacccccaaggagaagaccgga

SEQ ID NO: 23118 - DNA, 195 bp, Homo sapiens
  misc_feature 2, 8, 50, 53, 61, 91, 167: n = A,T,C or G
cngtagtngcctcaatcgtattatggctgaaagaagccaggattcataanttngagccagnaactttacctggtctctcatgctttgtatnattaaacattcactgacactaactttgtgttaaatttaactaatttagaattccgaaagcataggataaaactttncttctgaattaaagcaaatcttgagatt

SEQ ID NO: 23119 - DNA, 142 bp, Homo sapiens
  misc_feature 5, 48, 82: n = A,T,C or G
catgngaaaaggccaaacctacctttgattgatacacctgaaaatttnagggagaatggaaccaagttggaaaacactcttnaggatattatccaggagaatttccccaacatggcaagacggaccaacattcaaattcagg

SEQ ID NO: 23120 - DNA, 309 bp, Homo sapiens
  misc_feature 288: n = A,T,C or G
caaaagagcacagtttatgtggtgcggaattaaacttccccatcctgcagattatgtggaaatacccaaagataatagtgcatagctcctttcagcctctagccttcactcctgggctccaaaagctatcccagttgcctgtttttcaaatgaggttcaaggtgctgctttgcatgcctgcaacccatggaagttgtttcttacttcttttctctcttatttattaaccatggctgagagttgtttttgtctatgtaacagtattgcacaaaactataggcaaatcgngttgcagggagatttctgatg

SEQ ID NO: 23121 - DNA, 308 bp, Homo sapiens
  misc_feature 6, 23, 42, 45, 46, 94, 139, 178, 186, 249, 261, 274, 294,300, 307: n = A,T,C or G
cacggngggggcaacttgaaganattagacatcagagaggcnttnntagtggctcatgcctgtaatcccagcactttgggaggccaaggcaggngcatcacctgaggtcaggagtttgagaccagcctgccaatgtggnaaaaccctgctctactaaagatacaaaaataagccaggngtggtggngcacacctgtaatcccagctactcaggaggctgaggcaggagaatcacttgagcctgggaagnggaagttgcagngagccaagattgnccactgcactctgcctgggngacagngagactng

SEQ ID NO: 23122 - DNA, 102 bp, Homo sapiens
  misc_feature 20, 23, 33, 34, 43, 46, 48, 49, 50, 78, 93, 96: n = A,T,C or G
cgacaggaattggggaaggntantatccactgnnaattacaanacntnnnattataacaatgacctatgacaagaatnttgaaaatcctgtgnacnggaagg

SEQ ID NO: 23123 - DNA, 105 bp, Homo sapiens
  misc_feature 21, 41, 44, 46, 70, 80, 81, 85, 86, 93, 95, 97, 99: n = A,T,C or G
caacggggagagtaaaaagcngcacgcaagagttaaacttnacnantttggccaagaacaaagtaagagnggcggaagtnnaggnnatgaatntnananagccag

SEQ ID NO: 23124 - DNA, 351 bp, Homo sapiens
  misc_feature 15, 46, 48: n = A,T,C or G
cctgaaaactgcagnttccttctcaccttgaagaataatcctagantnctcacaaaatgtgtgatgcttttgtaggtacctggaaacttgtctccagtgaaaactttgatgattatatgaaagaagtaggagtgggctttgccaccaggaaagtggctggcatggcaaacctaacatgatcatcagtgtgaatggggatgtgatcaccattaaatctgaaagtacctttaaaaatactgagatttccttcatactgggccaggaatttgacgaagcactgcagatgacagggaaagcaagagcaccataaccttagatgggggggcctggtacatgtgcagaaatgggatg

SEQ ID NO: 23125 - DNA, 100 bp, Homo sapiens
  misc_feature 8, 21, 27, 38, 55, 60, 61, 62: n = A,T,C or G
agcggggnctttccggcgggnccagtnagagctctggncttttggcataacgctntgctnnntaagccaaagatctgggggctcagggcaggaaacgcag

SEQ ID NO: 23126 - DNA, 400 bp, Homo sapiens
  misc_feature 8, 47, 48, 273, 309, 322, 362: n = A,T,C or G
ctgacagnattcgggccgagatgtctcgctccgtggccttagctgtnntcgcgctactctctctttctggctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgctttcagcaaggactggctttctatctcttgnactacactgaattcacccccactgaaaaagatgagnatgcctgccgggngaccatgtgactttgcacagcccaagataggtaaggggancgagacatgtaagcagcatcatggaggtttgaagatgc

SEQ ID NO: 23127 - DNA, 324 bp, Homo sapiens
  misc_feature 18, 19, 25, 30, 31, 34, 35, 43, 46, 52, 59, 71, 80, 85, 87,91, 94, 122, 125, 166, 171, 186, 216, 231, 271, 301: n = A,T,C or G
cttaatagactacttaannactttngatgnntannaatagaanganaaaggnacagagntcctataagcangacatactntggcntncagnagntccaccgtaaagaaaaaaacttgaaaanagnaatacctgagtacccatgggaataatagacactggggaggnagggnggggagcgggagaangagctgaaaaacttacctactggggactgngctcactacctgggngacaggatcatacgtaccccaaacctcaacatcacacagnatactcagctaacaaacctgcccatgtgtntcctgaatctaaaataaaaatcg

SEQ ID NO: 23128 - DNA, 400 bp, Homo sapiens
  misc_feature 2, 13, 72, 209, 340, 361, 369, 376: n = A,T,C or G
gnagcatggtcgngtcccaagaagcatctgaagcgttttggcagctccaaagcattggatgctggataaatngaccggtgtgtttgctcctcgtccatccaccggtccccacaagttgagagagtgtctccccctcatcattttcctgaggaacagacttaagtatgccctgacaggagatgaagtaaagaagatttgcatgcagcggntcattaaaatcgatggcaaggtccgaactgatataacctaccctgctggattcatggatgtcatcagcattgacaagacgggagagaatttccgctgatctatgacaccaagggcgctttgctgacatcgnattacacctgaggaggcaagnacaagtgngcaaagngagaaagactttggggcacaaaag

SEQ ID NO: 23129 - DNA, 333 bp, Homo sapiens
  misc_feature 44, 46, 47: n = A,T,C or G
aatgagtaaactgcagtatctaaagatttaaatctcagaatacntnncagatgccaggcatggtgggtcacgcctataatcccagcactttgggaggccaaggcgggtgaatgacttgagttcaggagttcgagaacagcttgggcaacatggctgaaaccctgtctctacaaaaaatacaaaaattagctgagcatggtagcgcacacctgtagtcacagctacttgagaggctgaggcaggagggtcacctatgcccaggaagtcaaggctgcagtgagctgtgatcacaccactgcactccagcctgggtgacagagcaagaccttgtct

SEQ ID NO: 23130 - DNA, 100 bp, Homo sapiens
  misc_feature 24, 25, 53, 66, 69, 70, 76, 88, 98: n = A,T,C or G
tacgtaaccttgtggagaagaccnnggcgctggtgaacgctgctgagacttantcgaagcctcgantgnncacatnttggtactacgncaaggttganct

SEQ ID NO: 23131 - DNA, 399 bp, Homo sapiens
  misc_feature 58, 61, 107, 174, 272, 290: n = A,T,C or G
atgaaacagctttggagtgatatctttaggagcctggaagccatttttgtaattttgntgnctatataaatgctacctttgcctggaggtagtgcgcctgtggctgngtacatccagagggcaacagtaatagccaacaaccagacaaactagtgaaggtaatctgtgagtgangattttatgatacttatatgcaaattaaaggcagaagttagtttcttctcaagatgcctttttggctgaacattaccatttttctttccccagggttngaaagaaaagggcttttntggatttaactatattctgctgcattctattcttcatgcgtaggttctactagaacctgtggaggggggcaccaaatttagattgagcagccatgctgataagaagcgt

SEQ ID NO: 23132 - DNA, 400 bp, Homo sapiens
  misc_feature 28, 34, 37, 82, 95, 96, 99, 108, 117, 118, 147, 157, 170,182, 201, 217, 224, 288, 292, 314, 322, 343, 378, 382: n = A,T,C or G
tgtaattcgggagggctatataaatgcntgagcnttntgaccattaactgagttaggggagggtaaaacctgccaggctgantgtgaaccgactnnagntcaattgtnaacctggannttacaagtccacaaggtcatggatgccanggaaaaactnccccctgaaaggngcacaagcaggnggaacccagccaataatgnaatacattaggatgcnaccaganggtacattgcaaacccactgcttgaaaggtaataaattcatattgagctaataatgtgtaaggngaantgataatgaatttatattaagngaatcaantaagtaattctgaatggcttngaaagctgggagaggctggcaccatggctcacgcntgtnatcctagcacttttggga

SEQ ID NO: 23133 - DNA, 400 bp, Homo sapiens
  misc_feature 7, 40, 48, 341, 394: n = A,T,C or G
cttgagnttaaatcagatagccagactgccttctggtctncctgtttntcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggcaatcaacttgagaagtttgacataaagagcttctgcaagatcctggggccattatcctactncaagatcaagcatttgcgttgggatggcaatcgcatctcagaaaccagtcttncaccgg

SEQ ID NO: 23134 - DNA, 234 bp, Homo sapiens
  misc_feature 44: n = A,T,C or G
gctttggactgaatcccaaaagtgtttataaggtcaaaagcaantttatttgtaatttcaacaacaaaaaatgtatttctttatgtaatcttgaaattattaaaagtccttttagcttctagcacatatttgtacaaagagtttaaggaatggtggctggtttggtttgttttttaaaaatgtttactgacgaggccgggcgtggtggctcacccctgcaatcccagcactttg

SEQ ID NO: 23135 - DNA, 181 bp, Homo sapiens
  misc_feature 10, 77, 80, 102, 106, 123, 139, 140, 160: n = A,T,C or G
agttgaaaangtaatgatgagcttggtggagaagaatgagtcgtttttggaatacctatgtgcagccactacccatntgnttgtcaccttgtttgcattctngganagcttgtataccgcagnaagtttgatgaataanntaaagaaaaacacctaaaanttgaaaaatgattgtaggatc

SEQ ID NO: 23136 - DNA, 374 bp, Homo sapiens
  misc_feature 7, 22, 32, 34, 105, 118, 203, 225, 244, 246, 303, 319, 328: n = A,T,C or G
aacctgnattaaaaagttcggntggggcgatntnggagcagaacccaacctccgagcagtacatgctaagacttcaccagtcaaagcgaactactatactcaatngatccaataactngaccaacggaacaagttaccctagggataacagcgcaatcctattctagagtccatatcaacaatagggtttacgacctcgatgntggatcaggacatcccgatggngcagccgctattaaaggtngnttgtcaacgattaaagcctacgtgatctgagttcagaccggagtaatccaggcgggntctatctacttcaaantcctcctgnacgaaaggacaagagaataaggcctacttacaaagcgccttcccct

SEQ ID NO: 23137 - DNA, 105 bp, Homo sapiens
  misc_feature 7, 11, 31, 32, 37, 39, 56, 65: n = A,T,C or G
tgggttncccnctgacaggaacacaaggggnnggccncncccgcccgggggcccanagaactagnaccagcagttggtattgggaaaggacaggctcaaaaccag

SEQ ID NO: 23138 - DNA, 205 bp, Homo sapiens
  misc_feature 14, 66, 68, 73, 192: n = A,T,C or G
caacagcacttgcntgcggaactcttcctgggttgcattcactcagcatccccaaccgtgcaacgngnaaccngtgcttttgcaaaagaagttgatctgaaattcctctgtagaatttagcttatacaattcagagaatagcagtttcactgccaacttttagtgggtgagaaattttaagtttaggtgttngggatcggacctc

SEQ ID NO: 23139 - DNA, 109 bp, Homo sapiens
  misc_feature 10, 45, 55, 71, 76: n = A,T,C or G
caaatgcgcngtcttgctacagaaagatactaaaagatcacaacngtcacaaccntccggaaggagtagcngaccngacacagatagatgacaatgtccaggatcattt

SEQ ID NO: 23140 - DNA, 332 bp, Homo sapiens
  misc_feature 7, 10, 29, 32, 35, 44, 45, 48, 49, 50, 61, 73, 75, 79, 83,84, 90, 97, 100, 113, 120, 123, 198, 206, 250, 252, 261,297: n = A,T,C or G
gactggnagncagacgcggtctttagagngantgngctaccccnnttnnncagacgccganacagataagaananaagnggtnncagcgnatgcganggntaaaaaccagttnagatgangcnaccaaatgaaaacaagtctgtattagcaaatgccacattatatttagtcgtattctcactaaattctccgttatnaaaatganttctgcatcttgctggaaaatgcacttacatatttacaagcgtngnatgcaatgngcatgttttgaatttcctaacagggctaatcttagnaggttcatagggaggtatgaaaatctctttaactg

SEQ ID NO: 23141 - DNA, 380 bp, Homo sapiens
  misc_feature 12, 29, 32, 35, 38, 72, 245, 302, 305, 333, 350: n = A,T,C or G
aaactgaggctnaaatagttgaaataagncanttntgntagtgagcggcagaatgacaagtcacgatctagngccgtctaactccaaagataatataaaataatgtatctctctcttttcccttatgcataaaatatgggagcatattaaatcatacacatagattgcaaaaaatactttgggaaactgattataatatcaaataattcagtgctgctggctcttacacttttatccctatctgnaaaacaaactacaaattgagagagacattccataggcttgggaaaaaacccaattgnggnggacctaaactaatcatcttaaggcagnaggtcaagaagaacagnactactataagcctcagaaagagggaacta

SEQ ID NO: 23142 - DNA, 199 bp, Homo sapiens
  misc_feature 12, 28, 44, 102, 105, 114, 187: n = A,T,C or G
gccctatcttgngagtggggcatctgtnggactttccacctggncatatactctgcagctggtagaatgtgcaagcacttggggacagcatgagcttgctgntgnacacagggnatttctagaagcagaaatagactgggaagatgcacaaccaaggggttacaggcatcgccatgctcctacctgnattttggaatca

SEQ ID NO: 23143 - DNA, 400 bp, Homo sapiens
  misc_feature 47, 83, 104, 119, 302, 375, 392: n = A,T,C or G
aactgactcctttgtaatctacctttacatccttaatagggaatttnagcatatttttaagcagaaaatcaagtctccggttngtgcctccatgatcatgcatngaacgcttaaaatgngcaacaatgaccaggatcatagcgaatactcctattcaaaatgctagtgggataaaaagaggagatacgtgaagaattttgcctttgaaaaacagaggtatatttgagaaatctttgggattttttgagaaatcagcatatttagttctgagtgaaactctcaagcttactttcagatcttgntctcttgaattttatatttttttaaagatgataagcaaaaatttttattttatttattactttctaaactttnattttcgggtcaggcgnacatggca

SEQ ID NO: 23144 - DNA, 398 bp, Homo sapiens
  misc_feature 1, 15, 33, 39, 45, 52, 57, 67, 69, 89, 131, 149, 161, 165,208, 223, 232: n = A,T,C or G
nggcgaaaagatggnaatactgctctggttacntgttanaggaantgctatngaganacctgaaaangngaaacatatctttcccaaanaaatagcagattatataaatgagccagcttcatggatcatgnattgaaataattagttgnaacctataaagnttgnaagcattcttacaataggaggcaatcttaagattactattatnagggacttaagaganttgagaagntgggagctaacaaattaagaccctaatgggatatgccttaacctggaacaggagttattttgcaagctatttttcccatcctattcattactactaaaaaatattgcttaaaaacattttcttccttcgggaggctcttaagaatgtaaatttaccttctaaaaat

SEQ ID NO: 23145 - DNA, 188 bp, Homo sapiens
  misc_feature 14, 23, 36, 42, 54, 55, 67, 108, 116, 117, 173, 175: n = A,T,C or G
agcaaggaagcacnattaaactnatcgaatatacantgacantttaaatcacanntggggcacaggnggcatctatggggtacagtataaaaccctggggctaggaangaaaggcnngcccagacttgcatctgcacatagaaggagggaattcatgctggtatcagcctaantntagcctatagaat

SEQ ID NO: 23146 - DNA, 119 bp, Homo sapiens
  misc_feature 18, 45, 60, 81, 110: n = A,T,C or G
caagaagacggattatcnagagaataatcatatatatgcatacgnaaaaatggccacagngacttatttggaggtgtaagnggcctgctacctaagttggtagggcattngagcacaca

SEQ ID NO: 23147 - DNA, 122 bp, Homo sapiens
  misc_feature 5, 34, 36, 46, 52, 55, 56, 72, 96, 101, 115: n = A,T,C or G
gttgnagagacaccaggaggtgcaaggaacaggntnggactaggcngaaganacnngaccctggaggacccnagtggggcacatagctgaccaacngcctntaattcttcttagntgccttt

SEQ ID NO: 23148 - DNA, 209 bp, Homo sapiens
  misc_feature 21, 29, 34, 57, 137, 147: n = A,T,C or G
taaagaatggaatgactcctntaatgcgngcagnatataaaggaaaactcgatatgngcaaattactactgcgacatggagcccgatgtaaattgcatcaagcatgaacatggatacacagccctcatgtttgctgnactttctggngaaggtttagtatttataaatataaggtacctatacaaacttgtataaggacatatatacta

SEQ ID NO: 23149 - DNA, 215 bp, Homo sapiens
  misc_feature 6, 8, 33, 42, 46, 57, 84, 106, 109, 152, 153, 179, 193, 213: n = A,T,C or G
gaggtntngggacgaggcctgacaacacggagnaaaccccgncgtntactaaaaaanacgaaaaggaagctgggcggtgggggngcatgctataatccaggtactnggnaaggctgaggcaagagaaatggttgaacccgggaggcaagagnntgcaggtgaagcaagaagataagtgncactggactccaanctgggcaacaaagaacgaancc

SEQ ID NO: 23150 - DNA, 389 bp, Homo sapiens
  misc_feature 47, 56, 57, 58, 69, 70, 201, 258, 372, 379: n = A,T,C or G
taagattcagaaatactttagaatattatgagttttaagtcctgctntacatcctnnnggaaaacttgnntaccatgagtttggaaaaaggacaacgaaaggcttttcatgtaaagataagatctttagctatctctaaccctgccttttttcactgcattttttctagttttgcttcattgcttatcattaggatagggnaagtgaagttgctatgctgctagcatcctaagatgatacctttggtgaaagaattgngaatagcatgatcatttctagcagaggctgagttaaggcagcagcttccattgagaagcttctgggcgggaatagcatttaaaggccccttgggtcacataagcaacaacatangggccgnatctgctatg

SEQ ID NO: 23151 - DNA, 158 bp, Homo sapiens
  misc_feature 7, 17, 59: n = A,T,C or G
accgtgnttcagagacncaggctggtgaacgcgtgcctagcagaagagctccgcacatncatgcctttgaacagaaaaccctgaccccagaccaagtgggcacgtgagcgacagaaatgagggactgggatctgcacagcattaaattataaatctgg

SEQ ID NO: 23152 - DNA, 115 bp, Homo sapiens
  misc_feature 8, 17, 27, 39, 54, 55, 80, 102: n = A,T,C or G
aggtgttnctctcaganagccactggnggggcctcaagnaccaacgtaagcatnnctgaatgacgaagccggggaagagngcaaatgtacaacagggaaaanatctatgcagctc

SEQ ID NO: 23153 - DNA, 397 bp, Homo sapiens
  misc_feature 56, 67, 68, 212: n = A,T,C or G
atgctgtttcagctgcttttaaaggtcttttttcactcgaataccttgacttgagnttcaatcaganngccagactgccttctggtctccctgtctctcttctaactctctacttagacaacaataagatcagcaacatccctgatgagtatttcaagcgttttaatgcattgcagtatctgcgtttatctcacaacgaactggctgatagnggaatacctggaaattctttcaatgtgcatccctggttgagctggatctgtcctataacaagcttaaaaacataccaactgtcaatggaaaccttgaaaactatacctggaggcaatcaacttgagaaggttgacataaagagctctgcaagatcctggggccattatcctactccaagatcaag

SEQ ID NO: 23154 - DNA, 112 bp, Homo sapiens
gcatgggctacccttgagaatgtcccttccatttctgagaacaagtcagccccttctacctgcctccacccaggagactgatgcacaagatctgtttgtgaaagcctgatct

SEQ ID NO: 23155 - DNA, 179 bp, Homo sapiens
  misc_feature 7, 8, 33, 42, 43, 44, 58, 70, 72, 83, 86, 100, 115, 143, 150: n = A,T,C or G
gaaacanngggacataaatattttgactgggtntgggtttgnnnggatatagcaaganattatatagcancnaaaaatggggnttnatcttctatataantcctgtttgtattantaacaaaacagacctaaatagcagcccncaattgnaaaaaaatttactttaaactacattaggt

SEQ ID NO: 23156 - DNA, 398 bp, Homo sapiens
  misc_feature 4, 8, 34, 38, 58, 63, 67, 70, 71, 359: n = A,T,C or G
cttngctnttcctccgcaaccatgtctgacattnccgntatggctgagatcgagaaantcganaagncgnnactgaagaagacagagacgcaagagaaaaatccactgccttccaaagaaacgattgaacaggagaagcaagcaggcgaatcgtaatgaggcgtgcgccgccaatatgcactgtacattccacaagcattgcttcttattttacttcttttagctgtttaactttgtaagatgcaaagaggttggatcaagtttaaatgactgtgctgccctttcacatcaaagaactactgacaacgaaggccgcgctgcctttcccatctgtctatctatctggtggcagggaaggnaagaacttgcattgttggtgaaggaagaagtgggggtgg

SEQ ID NO: 23157 - DNA, 399 bp, Homo sapiens
  misc_feature 17, 23, 54, 221, 223, 268, 387, 389, 392: n = A,T,C or G
ctcggctactctctctntctggnctggagggtttccagcgtactccaaagattnaggtttactcacgcacccagcagagaatggaaagcaaatttcctgaattgctatgtgtctgggtttcatccatccgacattgaagtgacttactgaagaatggagagagaattgaaaaagtggagcattcagacttgctttcagcaaggactggctttctatctctngnactacactgaattcaccccactgaaaaagatgagtatgcctgcgngtgaaccatgtgactttgcacagcccaagatagtaagtgggatcgagacatgcaagcagcatcatggaggttgaagatgccgaatttggattgggatgaatccaaatctgcttggttgntnttnaatatgg

SEQ ID NO: 23158 - DNA, 145 bp, Homo sapiens
  misc_feature 19: n = A,T,C or G
accctaaatgaattctggntggtcagagcagaaacagatacggttatgtcgaatttttctctcagatagtgtttaaaacaaaacgcaaaaaaactatactgcattcaatgtcactgggaaagagaaccaagaaaattcccactgg

SEQ ID NO: 23159 - DNA, 206 bp, Homo sapiens
tatcagctgccactcctggcttcaacactttgagtcactgcctagacggttctcttggcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagac

SEQ ID NO: 23160 - DNA, 385 bp, Homo sapiens
  misc_feature 49, 53, 54, 60, 62, 160, 181, 272, 318: n = A,T,C or G
atcttcagggccccttgctgacttatagaaggttttagtcagtctaaantatnnaaaggntnccttgaggaccctctagccctatcctagatttgctcctggggtgcttggagaatcaaatgagttcttccctgagggggaactggaaaaatcctggagntccccaggacttgaggatttnctggagtgacctccttcttgtgagatccttcagatccatggcccagctttcaagtatgtggagaaaagagcctcagtagagttatctctgncaaagcacttcataaaaacttccttagatattttaatgcttggagncccatctgtaacattacagggattggcaattcctcacatgggtatgttctttggccagcacagtatt

SEQ ID NO: 23161 - DNA, 399 bp, Homo sapiens
  misc_feature 33, 57, 70, 241, 263, 356, 360, 379, 398: n = A,T,C or G
ctgctaattacaatacttcccattataacagtntcctctggcagatttttgaaaatnctgtggactgganggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggctgggggaaaacatcatgatagccgnatatctggtggtatgaaaatgnccaactgatgatatccacatgaagcaaggtgactggagaatggatggcttcattttatccgggagtcattgaccagtacactgaaggctttgnaggntattatacgaagggattgnactactgaatttgggaggna

SEQ ID NO: 23162 - DNA, 383 bp, Homo sapiens
  misc_feature 23, 31, 35, 38, 40, 46, 51, 56, 58, 73, 94, 102, 114, 169,207, 224, 243, 307: n = A,T,C or G
atgatgggaaggacataccacgnaggagaanggtntcngnaggaanatctnggggncntttgctcctgcacangctttggaggccagcggggcnggggctgngacaactgccgnagacctgggggtgaacccagtcccgaaggcactactggccaggcctacaaccagnattctcaagagataccatcagagaacaaacactaatgntaattgcccaattgagngcttcatgcctttagatgnacaggctgacaagagaagattcccgagaggaaatcatctttccaatccagaggaacaagcatgnctctctgccaagatccatctaaactggagggatggtaagcagaccagctagaggtcttctttctttctaaagccct

SEQ ID NO: 23163 - DNA, 355 bp, Homo sapiens
  misc_feature 8, 35, 39, 41, 56, 70, 129, 265, 311, 334: n = A,T,C or G
ccaggtantgacgtaagcactggtgatacagggtntggntnacacaaatgtgtccntgaaacatggaacncacaatctggaacattgaatacatattaaaatattttatatattaaaatatatttttgnttcattttatgaaaggattagtggtacgagataaactatttggtgttctgagggcatgataagtaatggtgttaaatcaatatgtaaacactgacatattctataataacattaagaacccactgaagtctggcgngatgctcacccctgtaatcccagcactttggggaggcaaggcgggnggatcacctgaggtcaggaggtncagaccagcctgacaacatgg

SEQ ID NO: 23164 - DNA, 138 bp, Homo sapiens
  misc_feature 4, 6, 9, 15, 22, 25, 27, 28, 30, 31, 33, 35, 41, 43, 48,51, 68, 81, 89, 93, 99, 125: n = A,T,C or G
cagnangcngcattngataccnaananngnngnanatatcncnaaacncanaacaagtcttaataaanagagactgagcangaaagcgnggcngagtanggctatttccacccacccgggagctnttaggagacattc

SEQ ID NO: 23165 - DNA, 353 bp, Homo sapiens
  misc_feature 31, 33, 282, 297, 304, 316: n = A,T,C or G
acactaatgttaattgcccaattgagtgctngntgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagtctccagcttcaagtcaactcacagcttctccaagcatcaccctgggaggttctgaggggtttctcataaatgagggctgnacattggctgtctgnttcgaanattcaataccgntcaggattttaaatgaagggatctaagattgggttgg

SEQ ID NO: 23166 - DNA, 313 bp, Homo sapiens
  misc_feature 8, 15, 30, 40, 41, 50, 53, 54, 57, 60, 67, 76, 77, 83, 180,276, 298: n = A,T,C or G
aaatgagnaagaagnaaggaagaagggttnctacatacgnngtggtgggnggnntancancagcacncctgaaggnnttgctncttcccttacggaattacatgttgatggcaacaaaatcagcagaggtgatgcagctagcctgaaaggactgaataatttggtaagttgggattgagnttcaacagcatctctgctggtgacaatggtctctggcaacacgcctcatctgagggagcttcacttggcaacaacaagcttaccagagtacctggngggtggcagagcataagacatncagggtgctacttca

SEQ ID NO: 23167 - DNA, 265 bp, Homo sapiens
  misc_feature 5, 31, 33, 34, 38, 54, 59, 60, 83: n = A,T,C or G
aggcngcaggcaagaagcctgtggtaggggntnnaagnaaagaaggctgctgtnggggnnaagaagcagaagaagcctctggngggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaac

SEQ ID NO: 23168 - DNA, 100 bp, Homo sapiens
  misc_feature 13, 50, 64, 89: n = A,T,C or G
tagacactttctnaaaatggcaatgggatcagttttcctcaagcaggccngggttagggaaaangaagagccggaatatgtcaaactgngaaagcatcca

SEQ ID NO: 23169 - DNA, 212 bp, Homo sapiens
  misc_feature 5, 10, 85, 86: n = A,T,C or G
cagangaganaattttaagaaattgctcaagggaaacatttgtaaaggtttttgaaagattgagccaaattctgttgtcagttcnnagcatgcagttctcacctccatttagtcccccatcagaacagaggtcaggaatttagctggggagcctaaatttagttcagcttacctttgagaatagcatcaattcagactctcttttcattatg

SEQ ID NO: 23170 - DNA, 159 bp, Homo sapiens
  misc_feature 20, 58, 81, 88, 152, 154: n = A,T,C or G
taaactgaaagctgagccgngaacgtggtatcaccattgatatctccttggggaaaanttgagaccaagcaagtactatgngactatnattgatgccccaggacacagagactttatcaaaaacatgattacagggacatctcaggctgacngngctgg

SEQ ID NO: 23171 - DNA, 280 bp, Homo sapiens
  misc_feature 2, 30, 31, 33, 46, 48, 78, 81, 99, 102, 111, 113, 144, 149,227: n = A,T,C or G
tngagtcacaggactgcaggctgcacaganntnatgttgccagcancngcttatcgggctggggaggccccacgagcnttnacttatggcaggtgaagnggnaccagacgngncacatggcgagaatgggagcaagaggggcgnaaggngccacacacttttaaacaaccagatctgatgagtactcactcactaccatgaggacagcaccaagccatgagggatcngccccatgacccaaacacatcccgcgggccccaccttcaactttggggaatac

SEQ ID NO: 23172 - DNA, 168 bp, Homo sapiens
  misc_feature 1, 29, 30, 34, 39, 44, 60, 65, 70, 73, 92: n = A,T,C or G
ntgctacacttacatcagacaaaataggnngttncaccnaaacngtaagaagagacgaangacgncaccnccnaatgatagagtagtcaatncagcaagaggagacgagaattttaaatacatatgtactcaacaccagagcaccaagacacataaaggaaacattat

SEQ ID NO: 23173 - DNA, 156 bp, Homo sapiens
  misc_feature 6, 55, 126: n = A,T,C or G
cactancccacaaagatggggatggaactataacaacaaaggaattgggaactgnaatgagactcttggcagaatcccacagaagcagaggtacaggacatgattaatgaagaagatgctgatggnaatggcacaattgacttccctgaatttctg

SEQ ID NO: 23174 - DNA, 109 bp, Homo sapiens
  misc_feature 2, 83, 98, 103, 107: n = A,T,C or G
gnaacatggaggaagagaataacaggaattgaacaaaggtcaatataccataatctaacatagaggccacaatcaaaagttgnctattggccccttangaccnttanag

SEQ ID NO: 23175 - DNA, 302 bp, Homo sapiens
  misc_feature 31, 72, 246, 256, 259, 296, 299: n = A,T,C or G
gtccaagtaaacccgctagcttgttgcaccngtgtttggccacaggagcagaaacatggaataccagacgcnggggatgctggtacaagttgtgggactgcatgctactgtctagagcttgtctcaatggatctagaacttcatcgccctctgatcgccgatcacctctgagacccaccttgctcataaacaaaatgcccatgttggcctctgccctggacctgtgacattctggactatttctgngtttatttgnggncgagtgtaacaaccatataataaatcacctcttccgntgntta

SEQ ID NO: 23176 - DNA, 171 bp, Homo sapiens
  misc_feature 3, 62, 65, 85, 89, 102, 134, 167: n = A,T,C or G
tgnacccgaagccagactcccaggggaatcaagcagccaggacaagacatcctagcagccgnctnccagcctgctaggaaccggncatnccatcttgctctnttggcaaacgggttcacaccttcccctgctgnatgtggggggccgatgggaaggggaccttcggnggaa

SEQ ID NO: 23177 - DNA, 387 bp, Homo sapiens
  misc_feature 31, 35, 65, 69, 71, 261, 274, 322, 362, 372: n = A,T,C or G
atcaaaggaacttgtttcttcaagctcttgngttngtgattctgacagtgaggttgacaaaaagntaangnggaaaaagcaagttgctccagaaaaacctgtaaagaaacaaaagacaggtgagacttcgagagccctgtcatcttctaaacagagcagcagcagcagagatgataacatgtttcagattgggaaaatgaggtaccgttagtgttcgcgattttaaaggcaaaggctaattgatattagagaatattgganggatcctgaaggngaaatgaaaccaggaagaaaaggtatttctttaaatccagacaatggngccagctgaaggaacagatttctgacattgatgatgcagnaagaaactgnaaaatcgagccatat

SEQ ID NO: 23178 - DNA, 260 bp, Homo sapiens
  misc_feature 15, 18, 33, 39, 56, 68: n = A,T,C or G
aagggcaattgattntcnacaaagataagggtnaatgangaaaagacaatcacttnaataaatggtgnccgacaaaactttatatccacattcagaagcatgaaattggatctttctgacacaccatatatgagaattaattcaaaacggacaaaagaccaatatgaaagactgaatcaataaatctactagaagaaaatgtagggtaaaagcttcataattttggctgggcaaggatttctgggatggaacttcaaaag

SEQ ID NO: 23179 - DNA, 384 bp, Homo sapiens
  misc_feature 33, 37, 46, 49, 78, 81, 87, 208, 230, 273, 283, 307, 351,354: n = A,T,C or G
taaaggaaactgaagatacttggtttcaccagngttntaactttgntgntaggaggtcaagccatgcctgcaaatcgnctntcttgntacagaaagatactaaaagatcacaactgtcacaaccttccggaaggagaagctgacctgacacagattgatgcaatgccaggatcatttctgggatgggaagggatgtgagatgatctgntactgcaacttcagcgaattgntctgctgccaaaagacgtttctttggccaaagatctctttcgngattccttgnaacaatcaatgagaatcttcatgnattctggagaacaccattctgatttcccacaaactggctacatnagnataactgcatttctaggttctatatagggg

SEQ ID NO: 23180 - DNA, 151 bp, Homo sapiens
  misc_feature 5, 29, 32, 52, 53, 62, 86, 94, 115, 137: n = A,T,C or G
ctccntgcctcgaaagggaccccaactgngtntgctcgcctggggctcctgnncggtccgcncccgcaaatgcaaagagtgcagancacctccngcaagaagagctgctgtcctntgcctgtggcatgcccaagtgncccagggctcatct

SEQ ID NO: 23181 - DNA, 384 bp, Homo sapiens
  misc_feature 1, 15, 18: n = A,T,C or G
ncttatggccggggnagnattgagtgtcctgagagtcagattgctgtcagacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcattagtggtttctta

SEQ ID NO: 23182 - DNA, 206 bp, Homo sapiens
caacatggcgaaaccccatctctactaaaactacaaaaaaattagctgggcatggtggcagacgcttataatcccagctactctggaggctgaggcaggagaattgcttgaacccagtaggtggaggctgcagtgagctcagatcatgcctctgcactccagcctgggcaacagagcaagaagacaccatcttaaaaaaaaaaaaa

SEQ ID NO: 23183 - DNA, 102 bp, Homo sapiens
  misc_feature 17, 24, 47, 50, 51, 60, 61, 75, 80: n = A,T,C or G
tcttatggccggggttnttaatanaggactagcacatgcttatatgnttnnctaacaagnncaaaagctggaagngagangcaggaggctggaaactcaagg

SEQ ID NO: 23184 - DNA, 106 bp, Homo sapiens
  misc_feature 91, 94, 98, 99, 100: n = A,T,C or G
cagtaaaattccctaaaaaaaaaaaaaaaaaaaaaaaaaaaaaaaaaaaaaaaaaaaaaaaaaaaaaaaaaaaaaaaaaaaaaaaattttnttngggnnncccccc

SEQ ID NO: 23185 - DNA, 352 bp, Homo sapiens
  misc_feature 4, 18: n = A,T,C or G
gggnatgctttggcaagnaggcggggagcggcgtccgccaagttacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagc

SEQ ID NO: 23186 - DNA, 204 bp, Homo sapiens
  misc_feature 8: n = A,T,C or G
agcagcanaaaatattaaaatgtagaaaacctcgatttttatagagctaggattaccttaccatcaaaatctgataaagttcagccatatgtataaatatcatctatgacatgaatatatatgaaaaatcttagagaaataatagcaaatgaaacctaactaatattaaaataatgtcatgataaccgaatttgcttcattcca

SEQ ID NO: 23187 - DNA, 372 bp, Homo sapiens
  misc_feature 84: n = A,T,C or G
caattgtgtctgagagaaatgaacttcttattcagtttttatcagacttaagtttaactgcagatgggtttattggtcactacntattcaggccaaaaaaactgcctacaactacagaacagcctgtcaccaccacattccctgtaaccacgggtttaaaacccaccgtggccttgtgccaacaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgacct

SEQ ID NO: 23188 - DNA, 376 bp, Homo sapiens
  misc_feature 27, 175, 231, 276, 364: n = A,T,C or G
agtgatgggaaaccttgagtgaaagtnagacccccatgacatgcaatttacctgtataacaaacctgcacatgtacccctgaacctaaaataaaagttaaaaaaagaaaaaaaaaagaggaaagaaagactgatggaagggatgtgacaagaatgttaacagtttaacagttagngggtttagataagcaatgtttaggtgttcattataatgttataccaacttctctgngggattttaagagataaacgagtaatataagaaacattctaagtntttgaataaaaaagtgaagcctgcctttctttgtaagtctagagcaatactaattcatctttttttttaggttttgtttaagattttntcaagatacagc

SEQ ID NO: 23189 - DNA, 388 bp, Homo sapiens
  misc_feature 1, 18: n = A,T,C or G
ntggtaaaaattccaggnaagaaatagcaaagttaattttggttagagtcatctacaggaagaaaagaaagatacaagagctctgaggaaaacatatagactatgaatgagtggaaaaatgagatgatgcctagccttttcaaaccttcaggcataagaatacatgaaggacccatgacaaggaaaacagatagtattgagtgcaggaatgaagggttataaatatatttttgccgtcttgggaacagccataaggataaaatgataatgtcaaaaatagcagttgattaagaaatggcattgattttcccatactactagaggcacagaaataagaaaccaggataaatgaagttagtgttggatgacatagtaaaagcctgacttg

SEQ ID NO: 23190 - DNA, 399 bp, Homo sapiens
  misc_feature 8: n = A,T,C or G
ttcgtttnttacggccgggtagccgaagtaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaa

SEQ ID NO: 23191 - DNA, 382 bp, Homo sapiens
tagaagggcaatgcttttagtattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaa

SEQ ID NO: 23192 - DNA, 138 bp, Homo sapiens
ggggggagaagggatgggtgagcataaagtataaagcataacacaattctaggaggtaccatttatgttttattctatgaatgtccagcagtactgatgaagggcgagagagaagaagagaaaagagggcaaaataaa

SEQ ID NO: 23193 - DNA, 107 bp, Homo sapiens
  misc_feature 17, 22, 27, 31, 34, 38, 43, 60, 61, 74, 76, 80, 90, 92, 94,97: n = A,T,C or G
atatgacctgcgggcanacccnctcanaggnganttgntaaanacgcttccgtaggaatnnactcagactgcanantgtnatgctgcctnangntgngaactgtcct

SEQ ID NO: 23194 - DNA, 399 bp, Homo sapiens
  misc_feature 5, 29: n = A,T,C or G
tcttncttaggccggggggcattcctganctgacagcattcgggccgagagtctcgctccgtggccttagctgtgctcgcgctactccctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaaagatgagtatgcctgccgtgtgaaccatgtgactttgtcacagcccaagatagttaagtgggatcg

SEQ ID NO: 23195 - DNA, 100 bp, Homo sapiens
  misc_feature 6, 20, 28, 33, 35, 38, 46, 48, 60, 73, 80, 83, 84: n = A,T,C or G
tatggnccgggcaacgtatnacctgacngggcnantanctacatcngnggggacatgtcnccatacacacgcngtatgtngtnnaatatttgaagctcgt

SEQ ID NO: 23196 - DNA, 388 bp, Homo sapiens
  misc_feature 1, 2, 22: n = A,T,C or G
nnttaaatagtcagcgtaaagnatctttcactaaattcgttatgtggtctgtctggatgtaaacctatatatttccttttgaaacagaatcatatcctgcagactcttggcactcctgcatagctttgaccgaatgttcactctcatcgtaatggaagatttctatctatgcagataatacatgtttttaaatactgttttctgtttagtcctcaatcttcctaactcaaattggggactgaggagagagaaaggtggttacccctgttaccgtgccatattcttcttgctgcttttcaaccccacgtgattgctgattgacggttcctgctataatgtgtgtgcccctttaagtttcagaaaactttcccaatcatttcacttcaat

SEQ ID NO: 23197 - DNA, 316 bp, Homo sapiens
aacagctaaggactgcaaaaccccactctgcatcaactgaacgcaaatcagccactttaattaagctaagcccttactagaccaatgggacttaaacccacaaacacttagttaacagctaagcaccctaatcaactggcttcaatctacttctcccgccgccgggaaaaaaggcgggagaagccccggcaggtttgaagctgcttcttcgaatttgcaattcaatatgaaaatcacctcggagctggtaaaaagaggcctaacccctgtctttagatttacagtccaatgcttcactcagccattttacctcacc

SEQ ID NO: 23198 - DNA, 387 bp, Homo sapiens
gagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtaagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttt

SEQ ID NO: 23199 - DNA, 376 bp, Homo sapiens
ttattattgtgggtaagttgcattattaaagagcaggcttatgtgaaacttaatacatttagagttagaagttgagtgtatttttacttaaaatgccttgcttgaacaaatgatttataaataatcttaaactcatcagaggctaactaccagaaatatttagtttttagtgtaaatagcatttgtataataagagagataagtcaataaaccattttataattagactcttatttcaaaagagaggctttaaaagtcaatgaaccaaacagaaataagccctcacatcttcaatatcatactctcttgatgatggacttgtaaggcacaaagccccatgtctaacagtgtaaggagagtaaaaggactacttaaa

SEQ ID NO: 23200 - DNA, 376 bp, Homo sapiens
gttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacgggggggagagagcttaagtgaaggcagtttttatggcgttttgtagtaaattctgtaaaatactttggtttaatttgtgactttttttgtaagaaattgtttataatatgttgcattttgtacttaagtcattccatcttt

SEQ ID NO: 23201 - DNA, 366 bp, Homo sapiens
attccagttatttacatgataattctgacattctgaaacttgcctgtatattatctgaaaaatggatttcttgaggaaaagatctgtttattgtatgtaaggaaaaattttacctgaaaacaaacaaacaaaccctaaaactcagcaccactaccatttccagaagcttttttagcaagtgaatattttttacataatggataataaatggtatttattcatcatgattttctaagtaatgcttatcagccccttcagtggtgttattctaacaaaatgaatacattacaaattattaagttagcttttcagagttttaatattaggaagttactagcactgacacactgattttgaaatgtttca

SEQ ID NO: 23202 - DNA, 376 bp, Homo sapiens
  misc_feature 247: n = A,T,C or G
aattggagtgagttaagatttattctgaatgaacaataaagaattatgcttattatttttgggctttctgcatgtaggttaaaaaaataggttgccagtttgaatgttttttcatttttcacacctgtaatcccagcactttgggaggccaaggtgggcaggatcacttgaggccaggagttcaagaccagccaggccaacatagcaaaaccctgtctctattgaaaatacaaaaaattagctgggnttggtgggtgcagacctgtaataccagctacttgagaggctgagacaggagaatcacttgaacccagaaggcagaggttgcagtgagccaagattgtgccactgcactccagtctgggagacagagcca

SEQ ID NO: 23203 - DNA, 261 bp, Homo sapiens
  misc_feature 241, 259: n = A,T,C or G
gctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatnctttgccccttaaaaggnag

SEQ ID NO: 23204 - DNA, 181 bp, Homo sapiens
ggttgaaaaccttgctcattttttaatgcgaaggctaagtgtcaccccctttctctgcctctggctgggccttgctaagggccaaggaaagaaagacattttttagggggcagccagtccaaatgccaaaagaagaccagttcttgccctgattgtatgaaatttgacattttggctcttt

SEQ ID NO: 23205 - DNA, 368 bp, Homo sapiens
  misc_feature 25: n = A,T,C or G
tgatattggagagtaacctgcaaanaagttattgttgatgttgaattgaattttcacattgcacgagaaaggccaaggctcgacattcttcatccaacaggttcctttgttgcacactcccgtcctgagaaacggaacccattccagtgtacagcttcttaaataaaaggcaaatggagtcatgatttcctctctcactttcttgaatcgagaagggatgggaaataatgaatagatgaagttgattttagatcagaagaatcctggaacacatgaatgatgaagccctttggtagacagattcatgatgtatttaaaacattgctgtcttatccgttattcttctctctgtgtagaaatatacaagt

SEQ ID NO: 23206 - DNA, 377 bp, Homo sapiens
agctaaataattttttaaaaatattttacagttgtaaaaaatatccatcagaaaaatgacacacaaaacaaaatatctggacctttacagaagacgtttgctgacccccactttaaaggattggaacagtcttctagaattgaggaatatttattaaaatacctgtaaagaaaatagtgaatcactgtagcaatggctttgattcagaccttaaaatcacataagaagaattacaacatgttatggatttttaagtggcaggtattgtaactgttttttgtgtgcaaaatactgagtaaccactgggaaaatatttcagatgaaagggatgacaaaagcatgttgcgctttgcatcagcaaggcattgacttctgaa

SEQ ID NO: 23207 - DNA, 367 bp, Homo sapiens
ggtctcaagggattaggaactgcgaggaccactggggaaggaggtgctgaggtttaggggagacactggtatcccccagctctgcccacagcactgcctgctgggtgcctactcgatgcctgtctagactctaaggtaagcttgtccaacccacagcttgtgggctacatggggcccaggatagcttttaatgcagcccaacccaaattcgtaaactttcttaaacgattatgagattttttgtgatgttttgaagctcatcagctatagctagtgttagtgtattttatgtgtggctcaagacagtttttccggtgtggcccaggaagtcaaaagattggacacccctgctgtaaggaatgtcaca

SEQ ID NO: 23208 - DNA, 359 bp, Homo sapiens
  misc_feature 2, 10, 103, 254, 320: n = A,T,C or G
gnactgcgantaggccctcaaacttaaaaaagaaaaaactttgccagttttaaggacatattttgattctttcagtattcttaacacctttttaaacgaagtncttgatagtacccactattattgggtttgttttatgccattattgattcttgatattcaagcatttacaagggagcatatttgattttcttttttctttctttttttggcatcattaacatttcatttgaaatgcatattgttcttgaagnactttgtttttagcataaatgttgggcattttatcttagggtttggatgaaaacatttggggtggntagcctttcatttgctttggatatttaataatggacctt

SEQ ID NO: 23209 - DNA, 321 bp, Homo sapiens
gtgagccggacagtaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctgg

SEQ ID NO: 23210 - DNA, 379 bp, Homo sapiens
ggatgagggacttgcggaatccacacccttcctcagcgttcctgaacctgattggcttcgtgtcgagaagggagctcgggagcattgatggagtccagcagatttctttggaggatgctctttccagccaagaggtggaggtcgcctatatctgcagtgagagctccagccatgaggactacatcaggcagttccttaatgctggcaagtacgtccttgtggaataccccatgacactgtcattggcggccgctcaggaactgtgggagcttggctgagcagaaagggaaaagtcttgcacgaggagcatgttgaactcttgatggaggaattcgctttcctgaaaaaagaagtggtggggaaagacctgctgaaaggg

SEQ ID NO: 23211 - DNA, 367 bp, Homo sapiens
  misc_feature 18: n = A,T,C or G
gatttacaaactgaaatnctgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccatttatgcaggaaactacccttttctcaatataaccaaacaaaggctaatttataaatgctttattgaaaaatacacttatcttcatataaaattacagtagcagtatcttggaggaagttttataaatatttttttgc

SEQ ID NO: 23212 - DNA, 378 bp, Homo sapiens
  misc_feature 41, 321: n = A,T,C or G
gatcccgtaggagcctctctccctactgctgctacacaagnaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccgnggtttatggatacaatgctgcctataatcgctacttcaggaagcgccgagggaccaa

SEQ ID NO: 23213 - DNA, 333 bp, Homo sapiens
  misc_feature 13: n = A,T,C or G
gtcctgatcaagnaatttggtgtggacgttggccctgtttgctttttataaaccaaactctatctgaaatcccaacaaaaaaaatttaactccatatgtgttcctcttgttctaatcttgtcaaccagcgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataac

SEQ ID NO: 23214 - DNA, 344 bp, Homo sapiens
  misc_feature 310, 343, 344: n = A,T,C or G
agctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccattttttttttgttcaaatgattttaattattggaatgcncaatttttttaatatgcaaataaaaagtttaann

SEQ ID NO: 23215 - DNA, 390 bp, Homo sapiens
ggcaggcagagctgaaatacacacacagtcaactcaccagaccgttccagactctaaggcagaagccaacttcagggctttgtcgagattttttgtgaacacggctgctgtgagtccatagtcggtgctattcgctctttttatcacttcttcgatacttttgaacttcagtattggttgcactggcccgaaaatctatgattaattgcaagaatggcaatgagaggcatgactgaatggaaatgcatgctgtgaacaagcatttccttctctttacatgtttttcatatgcccagagcacacacatgcctgaaaaacgatgattagagaagaaagaacgtccaaacattgcttcagctgcattgccattggagactgaagggaaggatt

SEQ ID NO: 23216 - DNA, 115 bp, Homo sapiens
  misc_feature 22, 25: n = A,T,C or G
gaaaaaaaaaaaaaaaaaaaanaanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23217 - DNA, 378 bp, Homo sapiens
aaataaaaataaaagtaaagataatatagtctataatgtatatctctgtctctgattattatgaaatttctaacaaagaccatctatttgtgaagcatctgcattaaaacacgcaagccagttttattaagaagctatttaaggccaggtgcagtggctcacatctgtaaaccccccactttgggaggcaggaggattgcttgagtccagaaactcaagaccagattgggtaacatagagagaccctctctctacaaagaattagttgggtgtggtggcacacacctgtagtcctagctacttaggaggctgagtgggaggatcgattgaacacaggaattagaggctgcagtgcagctatgattgcaccactgtcct

SEQ ID NO: 23218 - DNA, 374 bp, Homo sapiens
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcg

SEQ ID NO: 23219 - DNA, 382 bp, Homo sapiens
aattgattgtttttctctccaccattattcactgtctctcaagtgttagcactctgagttgttgaacggaggtttgtatgctgcgcagagccctgtcgcaatgccccagcaagcttcttgttggcatgtggccactctaaattgtgctccaggatctgctatgggtccatgcttgcaggagaaacagctgtgtagaatttcctattgcatttcatttgtgggtttagaactcggttgcttatttcatattgtctcccttttcagtccttcaaggtacatttttccaacttctctaatgaattattacatttctgagtagctgatatgtttttatcttatctaagcagtatatttataattccttctttgcattggctaatct

SEQ ID NO: 23220 - DNA, 377 bp, Homo sapiens
  misc_feature 22: n = A,T,C or G
atgttaatgatctaatataatnctcagtgcaacattgagaatttttttttaatggctcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattacaaagatatgtcattagatccaagtgctgattaaatttttatagtttatcagaaaagccttatattttaaggtttg

SEQ ID NO: 23221 - DNA, 147 bp, Homo sapiens
gagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatca

SEQ ID NO: 23222 - DNA, 400 bp, Homo sapiens
  misc_feature 23: n = A,T,C or G
atatgtaacaaatttggtagttnccagtatgtgtgatgtcctttgggggttgtttatcttgctggtccataggaggggtacactaccccaagaatcaagacatctgagttctagttctagttctagctctgccactgaagagccaccttacctggggcaagttagccattgtctcccagtcatgtttaccacccatgaaaggactcgtcggtttgatgtttccattaagctcaatgagtaactctaatagttactcttgaatctggattgaaaaacaccatgcatctgatgagataattcataaatgttgcccctttttttaaatgatacaaccctaaaagtgactgaattgcccaagtgcttgaacatggcagaggtagttactcttattttgcagttt

SEQ ID NO: 23223 - DNA, 136 bp, Homo sapiens
tatcaccctatagaagaactaatgttagtataagtaacatgaaaacattctcctctgcataagcctgcgtcagattaaaacactgaactgacaattaacagcccaatatctacaatcaaccaacaagtcattatta

SEQ ID NO: 23224 - DNA, 376 bp, Homo sapiens
cgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacag

SEQ ID NO: 23225 - DNA, 367 bp, Homo sapiens
gaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaa

SEQ ID NO: 23226 - DNA, 225 bp, Homo sapiens
  misc_feature 28: n = A,T,C or G
gacagggaaaatagagacaaggacaagnagatcactggaatagactaggtgaaagaccctgagggtaaggcagtccaccttccacaccgctgccagcactgtctttctcttaaacacacatgggcacacacacatataaacatgtgagtgcacacacacagatcaagtaagtcatggtccttccagtgttaataagcacgtactggctgcaagtactacaaaaac

SEQ ID NO: 23227 - DNA, 329 bp, Homo sapiens
ctgcacgtcaccaagtaaccaggccccagcctccaggcccccaactccgcccagcctctccccgctctggatcctgcactctaacactcgactctgctgctcatgggaagaacagaattgctcctgcatgcaactaattcaataaaactgtcttgtgagctgatcgcttggagggtcctctttttatgttgagttgctgcttcccggcatgccttcattttgctatggggggcaggcagggggggatggaaaataagtagaaacaaaaaagcagtggctaagatggtatagggactgtcataccagtgaagaataaaagggtgaagaat

SEQ ID NO: 23228 - DNA, 364 bp, Homo sapiens
gcttaaataaatcttgttcagactttttaacagaaaagagtctagatgtaaagtttttaataatggttatttctgcatggtggaattatggggtatctcttttcatttatacacttaaatgtattctaggctttctacactaaacatacattacttttcaaattcaaattttatatatctggaatagttacaaatttctaattgatattaatatgagagtcaatgtcaaaacttgtgatttcttttatgttgatttagagtttaacgttatccagttagatctaccaggtgaaataactgatttgtgttaaaatgtttgttctctagaaacaactatattttggtcttttaccatagatacttt

SEQ ID NO: 23229 - DNA, 382 bp, Homo sapiens
  misc_feature 168, 170, 232, 249, 262: n = A,T,C or G
atttctagggtgacttttgggtaaaactatgacaaacaaaattggaaaaatatatttattgacatgggaagatgtttgtcttttttttttaattgggtaaaaaaagaaaatagattagaaaataatatatacagtatgatcccattttgctaaaatatttatatctgngngccttgatatatatttgcatattgaaactttcaggaagtatatatgccaaaatatcattagngattgtctctggatagngggctttatgagngcttttattttgttctttttgctggcagtattttctgattctttgacaatgaacatatatttccagatatttccagtacagtatatgaaaaccaagtttcttttaggtacaaaaattttt

SEQ ID NO: 23230 - DNA, 269 bp, Homo sapiens
gaaggccgagtggagaagggttccatgtgaacagcagttgaacatgggtcagtcggtcctgagagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacggat

SEQ ID NO: 23231 - DNA, 377 bp, Homo sapiens
attatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtat

SEQ ID NO: 23232 - DNA, 362 bp, Homo sapiens
caccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtggtgagtcttttcagcaac

SEQ ID NO: 23233 - DNA, 376 bp, Homo sapiens
agcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctct

SEQ ID NO: 23234 - DNA, 153 bp, Homo sapiens
  misc_feature 3, 10: n = A,T,C or G
agnaagacanaccagagcttctgcaagatcctggggccattatcctactccaagatcaagcatttgcgtttggatggcaatcgcatctcagaaaccagtcttccaccggatatgtatgaatgtctacgtgttgctaacgaagccactcttaat

SEQ ID NO: 23235 - DNA, 216 bp, Homo sapiens
  misc_feature 13, 21: n = A,T,C or G
agtttgtgtttgngagaatcngcaaaactaatgcaaaactgagagattatttgaatggcaaatatcatggggccttgataaaatgatctgttctagaacttgatttctattaagatatccaaaggtcttaaatctttgccttctaaaaagatttaggtagtttggccgggcgcgggggctcaggcctgtaataccagcactttgggaggctgaggc

SEQ ID NO: 23236 - DNA, 374 bp, Homo sapiens
tagaggggaaggaatcaagggactttaagctagatcaaaatctggggacaaattctcctgctaactgcaagttaaaataggcccttcttactgaatttccctgtttgtttctctgcagacaatgctttagccctactcttgggcccccaagttagcagagtaatcaaagcttcctaccgtttggcctactattccagactagtccctcgaggggttcccttccaaaatatgcagggctcaggctcccaattccgggcctgtctgctttgcttgtgtttctcctgtccctgttctcccggagggcccaggtggaactcacgacagggagggagacgctttcccaaaaacctgcagggctatttcccagaatttgg

SEQ ID NO: 23237 - DNA, 377 bp, Homo sapiens
taatatctgtatcctggaacaatattttatggttatgtttttctgtgtgtcagttttcatagtatccatattttattactgtttattacttccatgaattttaaaatctgagggaaatgttttataaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatctttaatgttcctcaaaagcttggattaaatacatatgggatggtacctctcttgcac

SEQ ID NO: 23238 - DNA, 374 bp, Homo sapiens
  misc_feature 15: n = A,T,C or G
ccttatggccggggnatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgtaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcc

SEQ ID NO: 23239 - DNA, 374 bp, Homo sapiens
  misc_feature 11: n = A,T,C or G
aatttaaaatnttcatatctgacagttactcttcagttttaggcttaccttggtcatgcttcagttgtacttccagtgcgtctcttttgttcctggctttgacatgaaaagataggtttgagttcaaattttgcattgtgtgagcttctacagattttagacaaggaccgtttttactaagtaaaagggtggagaggttcctggggtggattcctaagcagtgcttgtaaaccatcgcgtgcaatgagccagatggagtaccatgagggttgctatttgttgcttttaacaactaatcaagagtgagtgaacaactatttataaactagatctcctatttttcagaatgctcttctacgtataaatatgaaatg

SEQ ID NO: 23240 - DNA, 381 bp, Homo sapiens
ggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcccgggaggaatcgtgggtggtgctggtgttcacagggtttgtgtgggcagcccacaataaagacgtccttcgccggatgaagaagcgctaccccacgacgttcgttttggtggtcatgttggcgggctatttccttatctccatgtttggagg

SEQ ID NO: 23241 - DNA, 365 bp, Homo sapiens
gggtgtattctttgatacctagttaaccagttggtgcttaacaggagaatttttcattggagaattgctaccaggtaacattttggtgagtgaaaaggaggccctttggtacaggtatttgactagagacattgcttctacaatttcttagtcattgtgaaaaatcacatatttaaatgggattatttaaatttttaaatactgtatagtatttgtaggcaggtatagtttttatctttatttggtgttttatatgcagttattttaagttctgaaaatgaccatataatttgaagacaacttatttgacggaatgtttgaatgaagtttgttgaggggcttttgtttgatttagcgaatgggat

SEQ ID NO: 23242 - DNA, 381 bp, Homo sapiens
  misc_feature 21: n = A,T,C or G
gatggtagtaaatggcaaggnatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagag

SEQ ID NO: 23243 - DNA, 372 bp, Homo sapiens
aactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaaaaaatgtctttccttttttcaatgtacatagttcaactctttctttgttacatttaaactatatccatggatatcagtctgctttggactcctctgctagtgttacagatggaaataaaaccat

SEQ ID NO: 23244 - DNA, 382 bp, Homo sapiens
gtatgaagcatatgtagcacttcacagcatggttattcactgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttataccccagaagttatttctacattgttctacagcaagaatattc

SEQ ID NO: 23245 - DNA, 378 bp, Homo sapiens
ctgctaaggctttggttaactttctcaaaacactttcataatagggagatattattttatggccttccagaaagtcagcaagcaaaatgccttgagtgtccaaaagaactgtgatcatgtcttttgctgttgaccggtctgcttttgctgtgactcgacctcttctacttcttggtagccattgctctgattgtgctttttctgggaaaaagcgttgtactgggaaagccgtgttttgtttcctgttacagttcttcaaggaaatgcttcaggatcttgatcctacttgttgaaaatttccgttgagatctctgctcttgtctgaagctgagctgagctcagtggttttggcgcccatagagtggaaagtttactcag

SEQ ID NO: 23246 - DNA, 380 bp, Homo sapiens
ggacatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacg

SEQ ID NO: 23247 - DNA, 359 bp, Homo sapiens
  misc_feature 1, 6: n = A,T,C or G
nagaanttgctttatgaagaagcactttctaatgggtaaccagaaaagggcttcacccatttgtttttgacttctatgatagtcactgcatatgatccctttaagtgtctttaaaaaaatgacttatgaatttgatagcatttggggaaaaaaagccttatatgattaacaatttgtaagttttcaagatcggatggaatttaattttgctcctagaatttttgtcttcagaatatctagttaagataaattaggcctttgactattataggtattcataaatgctactttagccatgtaagttaaaaagttaaaatacttaaactttagtgtatttatttatctcattactttttttc

SEQ ID NO: 23248 - DNA, 385 bp, Homo sapiens
  misc_feature 359: n = A,T,C or G
gggagggtaccagcagaaggttagtatcatcagatagcatcttatacgagtaatatgcctgctatttgaagtgtaattgagaaggaaaattttagcgtgctcactgacctgcctgtagccccagtgacagttaggatgtgcattctccagccatcaagagactgggtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtatatatatatatgnacagttatctaagttaatttaaaggt

SEQ ID NO: 23249 - DNA, 384 bp, Homo sapiens
  misc_feature 12, 13: n = A,T,C or G
caaagagtaaanntcggtcctaggagagatcagattctagagaaagatgctgccttgtgtgtcctaattgatgagatgaatgaaagaccatgaaagatgtttctttttctttttttccttttgataatagcatcatatattagttcattttcttttggacagtcttaagagaagtttcactaaaaatgtaaacagctttaatcttgactccaaatttttcaattatgagatgtcataggcagtaatttcgctgtataacaagcatagacaaatgagtgtccctgcactaagaagaatcactttaaaaagcaaagtgttagctgctgttgtatgggacattcctatgttttagagttgcagtaaaactttgatgataacctcaaa

SEQ ID NO: 23250 - DNA, 380 bp, Homo sapiens
  misc_feature 15, 370: n = A,T,C or G
tatttttaaaaagantatatgttctgtagttgttagacgtagtgttccataagtgttaattaggttaaattggttgatagtgttgttcaaatcttctgtatccttgatgagtttttgtctactggttacatcaattactgagaaagaagtgttaaagtttctaattactgtgattttgtctatatctctctttagttctgtcaattttgctttattttgaagttctgtcatcacatgtgtaaacacttagaattgttgaccctcttattattatgaaatgtccctttttgcctaggaatactccttttccagaagtccactttgcgtgatataatatatgcctccaatgttcttttaattattggtttgnacggaatagc

SEQ ID NO: 23251 - DNA, 380 bp, Homo sapiens
  misc_feature 10: n = A,T,C or G
gaaacatggnttggtttgagcagcaataaaattccagtttcctttgaatggtctaatgactcttcagtcatctttactaattggcacacacttgagccccacatttttccaaatagaagccagctgtgtgtctcagcagagcagtctgagggacactggaaagtcaaaaattgtgaagaaagacttttttacatttgtaaaaaagcaggccatgtcctctctgatgctgaatcaggatgtcaagagggatgggagagacatggtggattctgttacaaaattgacacagtccttcgaagctttgaccaagcttccagcggttattactgtcctcctgcacttgtaaccattacaaacaggtttgaacaggcttttattac

SEQ ID NO: 23252 - DNA, 386 bp, Homo sapiens
  misc_feature 166: n = A,T,C or G
gaggcattgaggcagccagcgcaggggcttctgctgagggggcaggcggagcttgaggagaccgcagataagtttttttctctttgaaagatagagattaatacaactacttaaaaaatatagtcaataggttactaagatattgcttagcgttaagtttttaacntaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgact

SEQ ID NO: 23253 - DNA, 366 bp, Homo sapiens
ggaaggaaagataaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaat

SEQ ID NO: 23254 - DNA, 382 bp, Homo sapiens
  misc_feature 27, 377: n = A,T,C or G
ggagcgaggaggagttgagagaacggngcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcncaaaa

SEQ ID NO: 23255 - DNA, 377 bp, Homo sapiens
  misc_feature 36: n = A,T,C or G
acaaaagagtaggtactcttgagagcaattcaaatntgctgacacggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaa

SEQ ID NO: 23256 - DNA, 376 bp, Homo sapiens
  misc_feature 19, 321: n = A,T,C or G
agagtcaatatgctgtatntattaatgatagctcttgggcatcgatctctgaaagctcaaatggatggaatttagtttgcgggaaagaggctttgctttgcgcatatcaggcttaggactgtgggaggcttaagttgcagatgcttcttttattgtactcttgttctgcccttgttttttgaaggctctgacttataactgctgtatcagaagaaacattttgacagtgtcttggttggagatgaacatccctaattgacatgtgatgactatttcttattccattcatctaagagtcattgaaatttttgttttgcttgntttgtttagcttcaaggtctttggtaaagtcacatgttaaggatgactgaaataa

SEQ ID NO: 23257 - DNA, 364 bp, Homo sapiens
acttttttgatgtgatgcttgacgtgaggcccgacactaggattctcaatgcaagaatccagtaccttgcacatagaagtagcaacccatcccttgcctattttcatcttgctgttttcttttttttaaaaaaatggatgtgacttgttttgaatgttttgtattatacttgtttttgtgtgtgcataaattcattctgtaggatcttaagaaaaagagtcccagaatgttgcttctattattgtgcacaaccattgagaggtgttacaagaatgcagttaattttaacatgtgtgatgtgccatggtggaaaagtactatcggaataactctgcagtgacagatttgaagtttggctagcatc

SEQ ID NO: 23258 - DNA, 373 bp, Homo sapiens
  misc_feature 19, 25, 83, 146, 171, 178, 206: n = A,T,C or G
gactgacactgttcaggantcggantcctgtcgattagactggacagcttgtggcaagtgaatttgcctgtaacaagccagantttttaaaatttctacttgtaaatattgtgtgtgtgtgtgtgtgtgtgtatatatatatatgnacagttatctaagttaatttaaagntgtgtgngcctttttatttttgtttttaatgcttngatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcag

SEQ ID NO: 23259 - DNA, 387 bp, Homo sapiens
  misc_feature 55: n = A,T,C or G
gaatttaatgattatctcctccactataatcctctttagggtgattttttaaatnaaaacccagtgaatctcattactcctaagaaacgaaagattccttcaaagccttttcaggcacatggtttcaacaaagcctggctttgacattccttgtcctgaggagcactttccaggcatagttacagcttccccactgtatttacaagccagaattgtgcaactcttctggatcattaataaagtagcaagatcctcaaaaaacccaaaaacaccattctctaatagtcatgacaaatggcttcagtatggcttgtttttttattttccagatggctttttctcttattttttgaagccccagtctttgattttacaggtaactttcaa

SEQ ID NO: 23260 - DNA, 373 bp, Homo sapiens
ggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaagccaagctggcccaaggtgtcctgcaggctgtaatgcagtttaatcagagtgccattttttttttt

SEQ ID NO: 23261 - DNA, 150 bp, Homo sapiens
  misc_feature 21, 29, 32, 44, 136: n = A,T,C or G
atggccgggggaaacaaatcngggcacanacntgctaatttcanaaactaccagttctttattggagacaacatgactccactatggcatggtatgctctattggactaccgggaggatggcgtgaccccatctangatcttctttatgg

SEQ ID NO: 23262 - DNA, 385 bp, Homo sapiens
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaacttttgtaagatgcaaagaggttggatcaagtttaaatgactgtgctgcccctttcacatcaaagaactactgacaacgaaggccgcgcctgcctttc

SEQ ID NO: 23263 - DNA, 260 bp, Homo sapiens
taataattaaatccatttgatattgatggactataaggaactttgctaaaagaatatagacaggactctggggaatttctacaagggaaatagcggattttaatatttgctcataagatagcccaactttacaaggagttcattagaagatgattagcagtgcatttaaaatgcttgatagggtctggtttttaaaaaggagcagtaaggttttcttactgctgtaatacttaataaaatgcatttcatttacacaacac

SEQ ID NO: 23264 - DNA, 383 bp, Homo sapiens
gaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtgggaagagcatgttcaactgtggaggggaagtggcagcagaggctgaagaacccaaaggaaaaaggccacagtgagggccgactccttagtttcttggaacagtctgagcacaaga

SEQ ID NO: 23265 - DNA, 300 bp, Homo sapiens
  misc_feature 10, 15, 31: n = A,T,C or G
gacttctgantctanaaataaatagcaaatnctattgacagtataacacagtatcaattgataatcctgtgaggatacagattgcctataggttttaaaacacattaatcgtgaaagccaccttatatgtgcattgcaacatgcagttttaaaagaattttgcgtatctttgctatctgataatcacatcagccctgagctctgtgctgagcaaggctttctctctccatttaatggatgagctaacagatgaagacaagtgctgcaaaatccctatgcttgtaaatcttatacaactat

SEQ ID NO: 23266 - DNA, 398 bp, Homo sapiens
acatatatactgtaataggatttatgacattatactgtttaatctttagggtgttacaaacacatcaaggacagttggcagtaactgaagtttgcttgcattttaagaatgcattagtattgctgagtatcatgtactttcctaaaaataaagaaaattatactcttagaatatttacagattcaaatatttttttttccttgcgggccaagaataaaatctttatgaactaacaagatgaattaaagatggaatgattcatttctatggttaggttttaattaatacatgggggatgattttggcactttttcaaagaatttgtttctgtgtatctgaatttgcacctactctgtaacctaactgcgatttataaaatgaaacaatctcttctaatt

SEQ ID NO: 23267 - DNA, 376 bp, Homo sapiens
ggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatgga

SEQ ID NO: 23268 - DNA, 400 bp, Homo sapiens
  misc_feature 330: n = A,T,C or G
cattatggcccgggggaaagccaggtcacctttcaaggaacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcacctggagtctgatggaaagagataggcgcatctctggagttgatcgttactatgtgtcaaagggtttggagaacattgattaaggaagcattttcctgattgatgaaaaaaataactcagntatgaccatctacccctgctagaaggttacagtgtattatgtagcatgcaatgtgttattgtagtgctta

SEQ ID NO: 23269 - DNA, 100 bp, Homo sapiens
  misc_feature 7, 23, 30, 41, 46, 48, 54, 55, 60, 63, 82, 96, 98: n = A,T,C or G
aaaaggncttctttgtttcttantcccttngctctggaggnagatntnacagcnncagcncanctcacagcttctccaagcntgaccctgggagtncnct

SEQ ID NO: 23270 - DNA, 188 bp, Homo sapiens
  misc_feature 99, 172: n = A,T,C or G
caagttgacttctaaatcaggattttcataatagtacagattatctgcgtaagacagttcagacttttttttttacttttttaactgaaaagcaaaaangctttatatatattataatataggaaaccatacttctttagcagaactagtaataattatggttctaaagatngacttgtaggctttca

SEQ ID NO: 23271 - DNA, 181 bp, Homo sapiens
gacacagtggtctatagaccggaagaggagtttagattttattccatgtggctgggtgtggtggctcacacccataatcctagcactttgggaggatgaggtggggggattgtttgaggccaggagttcaggagcagcctgggcaacgtagcaagacccccgtcttgaaaaaagctaaaaa

SEQ ID NO: 23272 - DNA, 242 bp, Homo sapiens
gtaatggaggaagaaaataaataacacggggttggttcttgtcttcaaggagctcacaatgaagtagttaagactgacaaatggaatcatacaaaataataattgcaagactattactttagctctgttaagcaacttaaatggcaatgtccctgtaggaccaaaaataaaatattacattaattattctttcagtatgaaggagtctccctgtgcagagatttgagagataaattatttga

SEQ ID NO: 23273 - DNA, 140 bp, Homo sapiens
  misc_feature 19, 28, 29, 30, 33, 36, 65, 68, 119, 124: n = A,T,C or G
attttttcccaaaaaaaanggcccaggnnnaanatnccaaaaaaaaaggggggggaaacccctcnaanagggggggggaaaaaagggggaaaaaaaaaaaaaaaaaaggggggggaaanccccngagggggggggaaaaa

SEQ ID NO: 23274 - DNA, 205 bp, Homo sapiens
ttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgcaaaaaa

SEQ ID NO: 23275 - DNA, 194 bp, Homo sapiens
  misc_feature 46: n = A,T,C or G
ggggagccaggatgggactggtcgtgtttgtgcttttctccaagtnagcacccaaaggtcaatgcacagagaccccgggtgggtgagcgctggcttctcaaacggccgaagttgcctcttttaggaatctctttggaattgggagcacgatgactctgagtttgagctattaaagtacttcttccaaaaaaaaa

SEQ ID NO: 23276 - DNA, 388 bp, Homo sapiens
  misc_feature 197, 208, 289: n = A,T,C or G
catcttggttccgcgttccctgcacaaaatgcccggcgaagccacagtaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcngctgaaattgntgaagaaccagtcagtaaagcaaaacagagtcggagtgaaaagaaggcccggaaggctttgtccaaactgggtcttcggcnggttacaggagttactagagtcactatccggaaatctaagaatatcctctttgtcatcacaaaaccagatgtctacaagagcccctgcttcagatactt

SEQ ID NO: 23277 - DNA, 380 bp, Homo sapiens
gtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaa

SEQ ID NO: 23278 - DNA, 388 bp, Homo sapiens
  misc_feature 1, 2, 17: n = A,T,C or G
nntcatgaaggagcagnaaatgcttggatttgcctcttagctcttggagctggagagtggatgacttcctgcaaggcacgatttttggattggcttctcaattattacaggaatcctcaacttttagaattgccagcctatccatctgatcttgaaagtgtacaaacttaccttcaaacagtgtagaatatatgcaattctggacctagacagaggcaataacctaaagacatttgcagctcatttcttgtcagaacccattgagaatagtggtattgatggaagactgtcaagcccatccagttctctagtctaaatagtctcagtttatccatgacttgagccatctaaaagttgcataacaaattagccgggcgtggtggcgcat

SEQ ID NO: 23279 - DNA, 369 bp, Homo sapiens
ggacaaagtatggcggcagggaccagcagttactgggaagtatctcaggaaacaggctcgacagctggaaaatgaacttgacctgaaactagtttccttcagcaaactatgtacaagttacagtcatagcagtacccgagatggaagacgcgacagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaatt

SEQ ID NO: 23280 - DNA, 366 bp, Homo sapiens
atgcgaaggtgacttaagagattaaaattaatttggttgctgttggttctgaacaaataatgagttcttttatttgaggtatgccattttgaagactgagacgttggagttttatcctagaggataaaggaaatctttgggaaagtcagtattttatatagcaaaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttct

SEQ ID NO: 23281 - DNA, 370 bp, Homo sapiens
  misc_feature 22, 40, 41, 47, 56, 57, 91, 103, 121, 166, 174, 198, 227,262, 292: n = A,T,C or G
gtgctgaaatttaattaaaatngtcttatatgaaggatgnnccaaanccatgtggnnacttgactctctcatctgtctaaagagtactggncgatataaaaanatatattttttaaacaangtgatctcaaatttaaagactgctccagatagcctgcatttgcantggaatanctgacaaatcacaagtggtttagnatgggcagggctttgatcattcaaaagtnactaaagtagctccagaatgccaagtgttcgtgtnaattacggttaccatgttatcatttgctgngtcttacataagcactcatgaaaatatggcattctgtaacttgaattccatccattttccagacctctactcatgtct

SEQ ID NO: 23282 - DNA, 140 bp, Homo sapiens
  misc_feature 9, 24, 28, 124: n = A,T,C or G
gggggcacnttatagggcccagcngctngggaggctgaggcagaagaattgcttgaacccgggaggcagaggttgcagtgaactgacaccgcaccattggattccagcctgggcaacaaggagngaaactccatctcgaa

SEQ ID NO: 23283 - DNA, 116 bp, Homo sapiens
  misc_feature 25: n = A,T,C or G
ggggaatcagggttcgattccgganaggagcctgagaaacggctaccacatccaaggaaggcagcaggcgcgcaaattacccgctcccgacccggggaggtagtgacaaaaaaaaa

SEQ ID NO: 23284 - DNA, 185 bp, Homo sapiens
  misc_feature 26: n = A,T,C or G
gcagacagtatgattctatatctagnaaaaccccatagcctcagcccaaaaggtccttcatctgataatttcagcaaagtttcaggagacaaaatcagtgtacaaaaatcactaacattcctatacacagtcgccaagccaagagccaaatcaggagcacaatcccattcataattgccaaaaaa

SEQ ID NO: 23285 - DNA, 388 bp, Homo sapiens
  misc_feature 6: n = A,T,C or G
ggaatnaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttg

SEQ ID NO: 23286 - DNA, 365 bp, Homo sapiens
  misc_feature 8: n = A,T,C or G
aataaagnattaaccctaaggagagtcatgatctggttccaggaatacattgttagatgactgaaaaattgtattacttcaatgaaaatactataaataataacattttcatatattagttggttctcatgcatacataatctaattttatttgatcctcacaactgtttaagttttattaaatatacattatccctatttgtataaatagaatcatacaatacctgcctgctttcattcaacaaaattatcatgagatttttccatgttgtgtacatcaatagttcatctattttattgctcagtaatattccattgtgtggatgtatcactatttgtttacacattcaccactgatatataag

SEQ ID NO: 23287 - DNA, 372 bp, Homo sapiens
attgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatt

SEQ ID NO: 23288 - DNA, 272 bp, Homo sapiens
aacgcagtaaaggctgatccgtccttggccccagaggagggctcaggtccattttagagggaggtgcctgtggactggacccacagatctgatctgtacaacctcaggtggctgtccccagggtgtttgaggtgggatgtaggaggctgcattagtttcccagggccactgtagcaaatgaggtggccctttctatccatgggtttcacctctttggactcaatccatcatgagttgaaaatattcagaaaaaacccaacagtgaaaaaaaa

SEQ ID NO: 23289 - DNA, 371 bp, Homo sapiens
  misc_feature 8, 44, 356: n = A,T,C or G
accaaagnaacatccaagtcaataaagtggaagactaaccaagnatttggacattggaatgtttactgttattctttaagaaacagctacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagngtcatgatttaaaaa

SEQ ID NO: 23290 - DNA, 371 bp, Homo sapiens
tatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctc

SEQ ID NO: 23291 - DNA, 400 bp, Homo sapiens
  misc_feature 12: n = A,T,C or G
tttacccgggcnttcttttcttatggccgggggggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacgtgacggaggttgagatgaagcttcttcatggagtaaaaaatgtatttaaaagaaaattgagagaaaggactacagagccccgaattaataccaatagaagggcaatgcttttaga

SEQ ID NO: 23292 - DNA, 233 bp, Homo sapiens
gaatcagagtaaaaagtctttaactccaccattagcacccaaagctaagattctaatttaaactattctctgttctttcatggggaagcagatttgggtaccacccaagtattgactcacccatcaacaaccgctatgtatttcgtacattactgccagccaccatgaatattgtacggtaccataaatacttgaccacctgtagtacataaaaacccaatccacatctaaaa

SEQ ID NO: 23293 - DNA, 369 bp, Homo sapiens
gaggtggcaggagggagaagtgctgagtgaaggagggagagccccttataaaaccatcagatctcatgacaactcactcactatcacaagaacagcatgggggaagcaagccccatgattcaattacctccacctggtctcccctttgacacgcagggattctggggattacaattcaagatgagatttgggtggggacacactgcctaaccatatcagagttggttaatgataatcttgtaatacaattttaaaaagttgttttaaacagtacattcaaagtgattccaagtgatgccagaagcagaggaagaagcatcaggaattttctatcaggaaactaaaacccagactgtgttcaagtttgag

SEQ ID NO: 23294 - DNA, 370 bp, Homo sapiens
  misc_feature 327, 357: n = A,T,C or G
gatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggtaaatgaccttgtatataaatattgccatatcatggtacctataatggtgatatatttgtttctatgaaaaatgtattgtgctttgatactaaaaatctgtaaaatgttagttttggtaatttttttttctgctggnggatttacatattaaattttttctgctggnggataaacattaa

SEQ ID NO: 23295 - DNA, 381 bp, Homo sapiens
  misc_feature 26: n = A,T,C or G
gtgttgccataacagaataccacagnactgggtaatgtataaagaaaaatttattgctcactgttctcgaggctgtgaagccctataaaagggtgttgggcatctagtgagggccttttttctgtatcccaacgtggtagaaggcatcacatggtgaaagagctcatcaaatggggagcaagaaagagccaaacttgcttttataacaaagctactgctgtgataacattaatccattcaagagtgtggagccctcatgacctaatcatctctcaaaagtcccacctttcaacactgttgcattggagattgagtttccaacacatgaactttgaggggatacattcaaatcacagtaaatacctagtcgtctcaggaaga

SEQ ID NO: 23296 - DNA, 390 bp, Homo sapiens
  misc_feature 6: n = A,T,C or G
ataatnaattaactagaaataactttgcaaggagagccaaagctaagacccccgaaaccagacgagctacctaagaacagctaaaagagcgcacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacat

SEQ ID NO: 23297 - DNA, 390 bp, Homo sapiens
gtgttacgatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagagtttggccatctattggatgaaaatatgggatccaagtttgataacattggcatgaatgccatggctaacaaagataatgcaagtctcaaacagcttagatgggaggctgaacgtgatgactggctacacaacagagatgcaaaaagtatcatcaagaaaaagaaacattttaaaaagaagaggattaaaaccactcaaaaaactaaaaaacaaag

SEQ ID NO: 23298 - DNA, 376 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatga

SEQ ID NO: 23299 - DNA, 377 bp, Homo sapiens
  misc_feature 11: n = A,T,C or G
tctgttcgaanataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgg

SEQ ID NO: 23300 - DNA, 372 bp, Homo sapiens
  misc_feature 27: n = A,T,C or G
ggagcacggttcgtttttcctttagtnggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagcctttgcataagtttcgtgtggctgatcaaagaaagaaggcatacgcagatttctacagaaactacgatgtcatgaaagattttgagggagatgaaggaaggctggtatctttcagagtgtaaagtaatcttggaatataaagaatttcttcaggttgaattacctagaagtttgtcactgacttgtgttc

SEQ ID NO: 23301 - DNA, 366 bp, Homo sapiens
aacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggtaaagtgaaatcgtccatttatagtcataccaaaagcataatgatcttaaaatatatttgaatgtttgctgaacttctagttttagtcattatcagacttacttgatga

SEQ ID NO: 23302 - DNA, 388 bp, Homo sapiens
  misc_feature 6: n = A,T,C or G
cgctgngtttcatttggtatagtatggcttatccatatttaattggatttatttaattattagtataataaaaatttgtttcctgtacattcattctgggcagaggagatacgtaattacatttcacttaaggtcttagttttgtgaacgcaatagctcacaactatgtacttccaaaagaagcaactctcaggacacacctgggaattaaacagtcttttctagaatatgacgtaaaaacctcaaaatgtgatgggactgtcattgttaatccagtggcttttaaattcttttggccacaaccctcggtaagcatacattttacatcatgatccagtaaacagacatcttcacataaaaatataaacttaaatagatatttcctgaa

SEQ ID NO: 23303 - DNA, 147 bp, Homo sapiens
  misc_feature 8: n = A,T,C or G
gaaaacantttggagaagatagaagtttgaagtggaaaactggaagacagaagtacgggaaggcgaagaaaagaatagagaagatagggaaattagaagataaaaacatacttttagaagaaaaaagataaatttaaacctgaaaaa

SEQ ID NO: 23304 - DNA, 108 bp, Homo sapiens
  misc_feature 32, 73, 74, 80, 97: n = A,T,C or G
aaaaaaaaaaaaaaaaaaaaaaaaaaaaaaanaaaaaaaaaaaaaaaaaaaaaaaaaaaaaaaaaaaaaaaanntttttntggggccgccgcggggnccgcgcctttt

SEQ ID NO: 23305 - DNA, 370 bp, Homo sapiens
  misc_feature 348: n = A,T,C or G
gacgtggagaggccggaggagactgtcgggcagtgctcaggcaggtcagagagagccaagtggaactttgaaaccacggctattaaataaagcattaataaacatataatgatggctttcttttctgtcttttagtgctgtgtttaccctggacaaatttgttggtggttgtggttgagctggatgggtcggaacaagaagccttggacctggttcccttggtgaccaacgtggtcctggaggagcactacctgatcgtcggagtggtggtccgtggtggacatcggcgtcatccccatcaactcccgtggggagaagcagcgcatgcacctgcgagacgggtttttnggcagaccagctagaccccatc

SEQ ID NO: 23306 - DNA, 235 bp, Homo sapiens
acgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcacccccctccccaaaaaa

SEQ ID NO: 23307 - DNA, 381 bp, Homo sapiens
  misc_feature 374: n = A,T,C or G
tgaacccatgttaattttggaccctataactaatttcctttctgtatcccatggtggtcaaagcagtaaaggagtttagagatacttagcaaatgccattcatatagtattgttagccaaactattattccttccttagaagttgatgtatcagaaaatttataagttatttgtatttatatataagtacatcagaacttgcccacatgataactcatgtttgctttaataaggaaaatatgttatttgaggttaattatatgatagtgaggaacattttacaattatttacagtgtttgacattaattgctgtcctatgatacagtagtaatgttaacagagagtttaatatgtttagcattatctttatggnatttata

SEQ ID NO: 23308 - DNA, 271 bp, Homo sapiens
gtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgc

SEQ ID NO: 23309 - DNA, 372 bp, Homo sapiens
gctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatc

SEQ ID NO: 23310 - DNA, 389 bp, Homo sapiens
gaatgccaaagtcaaatttcctgaattgctatgtgtctgggtttcatccatccgacattgaagttgacttactgaagaatggagagagaattgaaaaagtggagtattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtaagggttataataatgttaac

SEQ ID NO: 23311 - DNA, 251 bp, Homo sapiens
gtccctaacagcagcctggagctacccccaatccctcacagcctgaccctcctcattccatcagatgcatttgtagaatcggggcaaatttccttatttatttatggcccatgcctttccccctcttcatcctgatcccgttttgctttgaagagtccccagtaaccaaaaaacagcctccagaagccaaaaccatgcctggatctcccatagcttctcctttgcttccaggagaaagttcactgaaaaaa

SEQ ID NO: 23312 - DNA, 368 bp, Homo sapiens
actggggaatggagcaaaacagtctttgaatatcgaacacgcaaggctgtgagactacctattgtagatattgcaccctatgacattggtggtcctgatcaagaatttggtgtggactttggccctgtttgcttttataaaccaaactctatctgaaatcccaacaaaaaaaatttaactccatatgtgttcctcttgttctaatcttgtcaaccagtgcaagtgaccgacaaaattccagttatttatttccaaatgtttggaaacagtataatttgacaaagaaaaatgatacttctctttttttgctgttccaccaaatacaattcaaatgctttttgttttatttttttaccaattccaatttc

SEQ ID NO: 23313 - DNA, 371 bp, Homo sapiens
gaggagctggaagtcttagtaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatattttggtagacagaatccatgtacctttgctaaggtta

SEQ ID NO: 23314 - DNA, 369 bp, Homo sapiens
gaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattcctttgcaacaatcaatgagaatcttcatgtattctggagaacaccattcctgattt

SEQ ID NO: 23315 - DNA, 180 bp, Homo sapiens
gggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcaca

SEQ ID NO: 23316 - DNA, 344 bp, Homo sapiens
taacagctaaggactgcaaaaccccactctgcatcaactgaacgcaaatcagccactttaattaagctaagcccttactagaccaatgggacttaaacccacaaacacttagttaacagctaagcaccctaatcaactggcttcaatctacttctcccgccgccgggaaaaaggcgggagaagccccggcaggtttgaagctgcttcttcgaatttgcaattcaatatgaaaatcacctcggagctggtaaaaagaggcctaacccctgtctttagattttacagtccaatgcttcactcagccattttacctcacccccactgatgttcgccgaccgttgact

SEQ ID NO: 23317 - DNA, 382 bp, Homo sapiens
gtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcag

SEQ ID NO: 23318 - DNA, 358 bp, Homo sapiens
  misc_feature 5: n = A,T,C or G
gaatnaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaac

SEQ ID NO: 23319 - DNA, 361 bp, Homo sapiens
  misc_feature 6: n = A,T,C or G
aagcangcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccat

SEQ ID NO: 23320 - DNA, 380 bp, Homo sapiens
  misc_feature 6: n = A,T,C or G
gaatcncgctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaag

SEQ ID NO: 23321 - DNA, 304 bp, Homo sapiens
aacataatgtgaggaggtggagagacagcccacccccgtgtccaccgtgacccctgttcccatgctgacttgtgtttcctccccagtcatctttcctgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaacctataaaaaa

SEQ ID NO: 23322 - DNA, 229 bp, Homo sapiens
cgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaattttatatacaagctttgattaaaactcgaaaaaa

SEQ ID NO: 23323 - DNA, 365 bp, Homo sapiens
  misc_feature 8: n = A,T,C or G
ataattcntactgtgacagttcaaatgactgttaaagtgaattctgaaatttacacagggaactgctcagtgaaaaccatcaatctgcttgacagccagcagtgccattgtccaagggacatgtggaggtgttgtaaatgatcaactccatctcatactcacataggtagtggtagttatacagaattgagatgaatggtattgaattcttgtgtgtgtgtatgtgtgtgtgtgtgttggtcttctgtaaaaatctttttcttttccttattgagaaacagtgcttataatagtttagggtctgtttagtttttgcagtgttagtatgaataaagaatgattttcttgaagaataaaaagtatgt

SEQ ID NO: 23324 - DNA, 370 bp, Homo sapiens
  misc_feature 2: n = A,T,C or G
anaggaagctgggagcaaggaaagggtcttagtcactgcctcccgaagttgcttgaaagcactcggggaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactggggaagatgcacaaccaaggggttacaggcatcgcccatgctcctcacctgtattttgtaatcagaaataaattgctt

SEQ ID NO: 23325 - DNA, 387 bp, Homo sapiens
  misc_feature 5, 15: n = A,T,C or G
aatgntataaaagangcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtgggagaggacttccaaatgt

SEQ ID NO: 23326 - DNA, 191 bp, Homo sapiens
  misc_feature 9: n = A,T,C or G
gggcccganttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaaa

SEQ ID NO: 23327 - DNA, 377 bp, Homo sapiens
attcatcatcataatgtctttttgcaatcctaaaatgatttacaaagtcaactcctcaccccccaatttctaaaacaatattaagacatcaaaaagtttcagatacaaacttcaaagggcagccaagtcagagatttctgcctaagacagtttagatcatttaatatcctctggttttcctaggataaaattacagcctatagaattcttggaatctggctaaggaagtattatgtaatagagcacagcaattttggggacactggcaaagactacacagagaaggagatgccatcttttcaatttatcaacctttcagtgagtgcttgtgaaatactagaggcataagaagttatccctgtgtaaatagcaagctc

SEQ ID NO: 23328 - DNA, 373 bp, Homo sapiens
ggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgc

SEQ ID NO: 23329 - DNA, 367 bp, Homo sapiens
atgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcggaaaatcaagtcttccaaaaattcagctgctaatagagaattacagaagaaactcaaagtaaaagataacaagaagaacagaactaaaaagaaacctacccccaaaccaccagttgtagatgaagc

SEQ ID NO: 23330 - DNA, 380 bp, Homo sapiens
  misc_feature 21, 26, 31: n = A,T,C or G
gaaggcaaaataacaaacagnacagnacagnaaaggaatagcacgtccacccagagtaccccatctgaaggtcaccatcatcaaaggtcaaaggtagataaatccacgaagatggggagaaaccagcacaaaaaggctgaacattccaaaaaccagcacgcctcttctcctccaaaggatcacaactcctcgccagcaagggaacaaaacaggacagagaatgagtttgataaattgacagatgtcagcttcagaacgtgggtaataacaaactcctccgagctaagggaccatgttactaatttaatgcaaggaagctaagtacctgaaaaaaaggttagaggaattgctaactagaataagcagtttagagaaaaaca

SEQ ID NO: 23331 - DNA, 382 bp, Homo sapiens
  misc_feature 5: n = A,T,C or G
ggtanagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtg

SEQ ID NO: 23332 - DNA, 364 bp, Homo sapiens
ggaaccaaaggtagttgtgtcaactaacatagcagagacgtctttgacaatagatggtgtggtgtttgtgattgatcctggatttgcgaaacagaaggtctacaatcctcgaatcagagttgagtcccttttggtgacagctattagtaaagcttcagctcagcaaagggctggtcgagctggacgtaccagacctggaaaatgcttcagactttacacagagaaagcttataaaacagaaatgcaggataacacctatcctgagattttgcgttctaatttaggatcaagttgtgttacaatttgaagaaacttggtattgatgacttggtacattttgattttatggatccaccagctcctg

SEQ ID NO: 23333 - DNA, 280 bp, Homo sapiens
cgcggtggctcacacctgtaattccagcactttgggaggccgaggcgggtggatcacctgaagtcaggagttcaagaccagcctggccaacatggtgaaacccatctctactaaaaatattttaaaaaattagctgggcgtggtggcacatgcctgtagtcccagctactcgggaggctgagacaggagaatcgcttaaacctgggaggcggagagtacagtgagccaagatcgcgccactgcactccggcctgatgacagagcgagattccgtcttaaa

SEQ ID NO: 23334 - DNA, 376 bp, Homo sapiens
ccttcaaaaaatagggaatccagaagctggttttttgaaaagatcaacaaaattgatagaccactagcaaaactaataaagaagcagagagagaagaatcaaatagacacaataaaaaatgataaaggggataccaccaccgatcccacagaaatacaaactaccatcagagactactataaacacctctatgcaaataaactagaaaatctagaagaaatggataaattcctggacactacaccctcccaagactaaaccagggaagaagttgaatctctgaatagaccaataacaggctctgaaattgaggcgataattaatagcttaccaaccaaaaaaagtccaggaccagatggattcacaaccgaattct

SEQ ID NO: 23335 - DNA, 371 bp, Homo sapiens
  misc_feature 17: n = A,T,C or G
ggcaggtgcgatgcttnagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcccaaatgacatcacagcaaaagagaggttctctcccctcactaccaacctgatcaatttgcttgctgaaaatggtcgattaagcaatacccaaggagtcgtttctgccttttctaccatgatgagtgtc

SEQ ID NO: 23336 - DNA, 377 bp, Homo sapiens
gagaagaaacctatttccaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtg

SEQ ID NO: 23337 - DNA, 263 bp, Homo sapiens
  misc_feature 2, 10, 247, 248: n = A,T,C or G
anttaagaangcgttcaagctcaacacccactacctaaaaaatcccaaacatataactgaactcctcacacccaattggaccaatctatcaccctatagaagaactaatgttagtataagtaacatgaaaacattctcctctgcataagcctgcgtcagattaaaacactgaactgacaattaacagcccaatatctacaatcaaccaacaagtcattattacccccactgtcaacccaacacaggnntgctataaggaaagg

SEQ ID NO: 23338 - DNA, 400 bp, Homo sapiens
  misc_feature 11, 175, 176: n = A,T,C or G
ttagctacccnttcttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgnnttgccaggatggttagatacacagcatgttgatttggtcactaaaaagaagaaaaggactaacaagcttcacttttatgaacaactattttgagaacatgcacaatagtatgtttttattactgggttaatggagtaatggacttttattctttcttgatagaaacctgcttacatttaaccaagcttctattatgcctttttctaacacagactttcttcact

SEQ ID NO: 23339 - DNA, 361 bp, Homo sapiens
  misc_feature 2, 33: n = A,T,C or G
gnctttctcacttgagaaaaagtctaaccaccntcttatttaatgtagttttggcccctaatgacgttttcttttctcagttctatttgttgatatttgtggcatcagaagtagatgagctaattgtcagagtcatcccaaggtggattttggcatagcagtgcttcatgtttaaactgaaagggggttatcttttactttttcttgcatgtggtttggaaaaatattaagagaggaacactcctatcccctgtgtttttagaatttgacacttggtgaagaataaatagatctaggtttcaaggcaagctttgtcattgattggctgtataaccttggttagaacatgtttcctctttgg

SEQ ID NO: 23340 - DNA, 370 bp, Homo sapiens
tcagtgacattttggagaacaaagtgaatttacttcgacttcttaaatttttgtaaaagactataagtttagacatctttctcattcaaatttaaagatatctttctcctcttgatcaatctatcaatattgatagaagtcacactagtatataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttg

SEQ ID NO: 23341 - DNA, 278 bp, Homo sapiens
tgcagtggctcacgcctataatctccgcactttgggaggccgaggtgggtggatcacctgaggtcaggagtttgagactagcctggtcaacatggtgaaaccccttctgtactaaaaatacaaaaaaaattagctgggtgcggtggcaggtgcctgtaatcccagctactcaggaggctgaggcaggagaatcgcttgaacctgggaggtggaggttgcagtgagccaagattgtggcattgcactccaacctgggtgacagagcaagactccatctc

SEQ ID NO: 23342 - DNA, 155 bp, Homo sapiens
  misc_feature 149, 150: n = A,T,C or G
tgcataagcctgcgtcagattaaaacactgaactgacaattaacagcccaatatctacaatcaaccaacaagtcattattacccccactgtcaacccaacacaggcatgctcataaggaaaggttaaaaaaagtaaaaggaactcggcnnaaaaa

SEQ ID NO: 23343 - DNA, 382 bp, Homo sapiens
tatggccgggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaat

SEQ ID NO: 23344 - DNA, 400 bp, Homo sapiens
  misc_feature 15, 19: n = A,T,C or G
tattggccgggacantatnaacagataattttaatggccctataattattaaggagatgaatttgtaatttaaaatctctgaactaatctccaggcccagtttcactggagaattcttaccagaattaacaccagttgtacacagactcttccagaaaatagaagaggaaggaacatttcactcattttatgtggttattaacctgctaccaaaaccagataaagacagtattaacaaaaaagataggctgggcacggtggcttatgcctgtggtctcagcactttgggaggccaaggcgggtgggtcacctgaggtcaggagtttggagaccagcctggccaacatggtgaaacaccatctctactaaaaatacaaaaattagccaagcctggtggcgg

SEQ ID NO: 23345 - DNA, 383 bp, Homo sapiens
  misc_feature 3: n = A,T,C or G
ganctcatctatcctttacggcaagggtacctacggtacctgaaaacaacgatggcatggaaaacacttcccatttacctgttgttgctgctgtctgttttcgtgactcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagg

SEQ ID NO: 23346 - DNA, 381 bp, Homo sapiens
  misc_feature 8: n = A,T,C or G
agaaagangaaaggcaggcctatttcctcacaagaaacacacacctacacacgaatagacctcaaactcaatgctttactttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttcta

SEQ ID NO: 23347 - DNA, 227 bp, Homo sapiens
  misc_feature 11, 16, 17, 42, 214: n = A,T,C or G
gtctcaatttntagannaacctttgatagtgtctaatatttnaaatatttcgaggtagctagaagagaggatttgaaatgttaccaatacgtagaaatgataagcatgcaaggtgatgacaccccaaattccctgacttgattgttacacaaatctgtatgtgtaaaaaaatactcacatgtaccccataaatatgtaaaatattatgtatcantgaaaaaaaaaaa

SEQ ID NO: 23348 - DNA, 370 bp, Homo sapiens
tattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatgggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacaca

SEQ ID NO: 23349 - DNA, 378 bp, Homo sapiens
  misc_feature 11, 35, 70, 112: n = A,T,C or G
gaataaaaccnactagtagtgaggaagagaggctngggagggaaattataaattacttgaaggaactttngggagtgatagaaatatttactatattgattgttatgatggnttcatggatatatacatatgcaaaaacatatctacacttcaaatatgtggaatttttgtaggttatttatacagcaataagcctgctcaaaaaagtaaatcgagcaatggagggtaccaagattttacttgcatatgactgttctctatctagcctgcaaacaggtgcacacaaaatctgcaactttaactggagcttgcaggcaacacctctgcaacattatgcaaatcactgtgagaaagagacaataattatgtcaaaaacca

SEQ ID NO: 23350 - DNA, 400 bp, Homo sapiens
  misc_feature 4, 16, 30, 34, 37, 54, 56: n = A,T,C or G
aaancaaccctgaggnagccaaggactgtntgancgngctgaacaagagcaacntngggaaagaattactcgacccactgacgagttctatgtatgtccctgggaagctgcatgatgtggaacaccgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtgcttcctggt

SEQ ID NO: 23351 - DNA, 298 bp, Homo sapiens
  misc_feature 4, 5, 36, 42, 76, 272, 275, 297: n = A,T,C or G
aggnnacttggcaaccatattgtcacctgtacctgncacacntgttgaaaaataaaacgataatagaactagtgantaattttcccttacagttcctgcttggtcccacccactgaagtagctcatcgtagtgcggccgtattagaggcagtggggtacgttagactcagatggaaaagtatactaggtgccagtgttaggatgtcagttttacaaaataatgaagcaattagctatgtgattgagagttattgtttggggatgtgtgttgnggntttgcttttttttttagactgna

SEQ ID NO: 23352 - DNA, 350 bp, Homo sapiens
aaattttgcctgcattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgcattattttgaaaaaataaatttaaaaatacattc

SEQ ID NO: 23353 - DNA, 400 bp, Homo sapiens
  misc_feature 7, 20, 39, 129, 136, 214: n = A,T,C or G
aaaaganccgaaaaaaaagntgtgtagaggagccgccanttcatctgtcctctttctctgcgcctttcgcagagcttccagcagcgagatgttgggccagagcatccggaggttcacaacctctgtggnccgtagnagccactatgaggagggccctgggaagaatttgccattttcagtggaaaacaagtggtcgttactagctaagatgtgnttgtactttggatctgcatttgctacacccttccttgtagtaagacaccaactgcttaaaacataaggatgtttcaagttcctccatttaacagatatgaagagcattttaagaggtgcagcctctggaagtggatcaaactagaactcatatgccatactagatatgtttgcaataaacttatga

SEQ ID NO: 23354 - DNA, 126 bp, Homo sapiens
  misc_feature 2, 38, 40, 43, 45, 62, 84, 86, 88, 120, 121: n = A,T,C or G
cngctggcaagcagaaaggttcgctcccgagcggagcnangananctctttgacaagaaganagacagatggagataggagatngnangagaaggagagaaagagacggcggagcgaganngcaag

SEQ ID NO: 23355 - DNA, 350 bp, Homo sapiens
  misc_feature 3, 10, 33, 54, 55, 75: n = A,T,C or G
aantaggccntgactagacatacaaaaaaagcnggaaaattggcaatagaaatnnactaaaaatgacaggataanggaattagcagacaaggactataaaacagttgccataaatagattcaaacatttaaagggagaaaaatgaacataatgacggaataattggaaattcttagtgtaaaaatgacaaccctaaaaaaagcagcttcacatacacacaattgtagtctcaaaagagaggagaaaaaaatgggacagaaaaatattttgaagagataatggtaggaaaattctcaaatttgataaaaaagataacatcaccaattcaggaagctcaatgaacttcaagc

SEQ ID NO: 23356 - DNA, 400 bp, Homo sapiens
  misc_feature 2, 3, 45, 46: n = A,T,C or G
anngtacatttagttactttaatcaaggcagaaaaacagtaatanncttataatatttgcagtacaaagtttggattaaaaaaaaatccaaaaaaaactccctcatttatttccatctgattatatacaatttctcaaataactgatgtgaaagtatgtggacaactaaagcgtacaatacatacttgagggattacttatatgttaaaattgtaaaacctcaaattatatagattttaaaaaatgcatagacatcctatttactccagagatgatacctaataacgaactcttaaaattaataacatattatgttagagaaagcagcttttgtcttgatttggaaatgtctgctttgacatgactgatctaaaattgctctcttgagccatctgtaatc

SEQ ID NO: 23357 - DNA, 397 bp, Homo sapiens
  misc_feature 14, 57, 59, 374: n = A,T,C or G
gaaatctacccggncttagcgccatttttttggaaacctctgcgccatgagagccantnggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgcctctgatcgccgaccacctctgagacccaccttgctcataaacaaaatgcccatgttggcctctgcctggacctgtgacattctggactatttctgggttatttgtggccgagtgnaacaaccatataataaatcacct

SEQ ID NO: 23358 - DNA, 228 bp, Homo sapiens
  misc_feature 4, 54, 88: n = A,T,C or G
aatntacccggggcgctggctcacgaggttggctggaagtaccaggcagtgatngccaccctggaggagaagaggaaagagaaagccnagatccactaccggaagaagaaacagctcatgaggctacggaatcaggccgagaagaacgtggagaagaaaattgacaaatacacagaggtcctcaagacccacggactcctggtctgagcccaataaagactgttaatt

SEQ ID NO: 23359 - DNA, 113 bp, Homo sapiens
  misc_feature 9, 10, 34, 48, 54, 64, 99, 110: n = A,T,C or G
agtacccanngcgggtcaggcatagcatcccganagagacagaggcangccctngtgacccatnaagggctgggccgcctccatgggcggtcacttggntgagagaggcngtt

SEQ ID NO: 23360 - DNA, 399 bp, Homo sapiens
  misc_feature 15, 32, 54, 56, 61, 66: n = A,T,C or G
agaaaaccctagaanaaaccttactacgcatnaaaagttaaaagttcttactantngtagngaagntagatgggccaaaccatcaaacttatttttatagcagttattgagaataatctttcttaaaaaatatatgcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgtatgtaagttatttatatacaaggaaatctattttatgtcgttgtttaagagaattgtgtgaaatcatgtaggttgcaaataaaaaatagt

SEQ ID NO: 23361 - DNA, 369 bp, Homo sapiens
  misc_feature 18, 27, 32, 33, 47, 60, 61, 62, 66: n = A,T,C or G
aaggacaattatgtaaanattataaanatagnnaatattaatagttnatatagggaatannnatanatttatgaaatgcatacacagttcagctgggtggagtggctcatgcctataatcccagcactttgggaggctgaggcgggaggactgcttgagcccaggagttcgagaccagcctgggcaacataacaagaccttgtctgtatacaaaatttaagaattagcctggcatgttggagcccacctgtggtcccagctacttgggagactgaggtgggaggattcttgagcctgggaggtcgaggctgtagtgagctgcatttgcaccactgcactccggctgggtgacagaacaaaccctgcaca

SEQ ID NO: 23362 - DNA, 400 bp, Homo sapiens
  misc_feature 6, 23, 35, 42, 71, 89, 93, 111, 198: n = A,T,C or G
ctgtancagagaaccaagaaccntctgaaggaacnttttacnaaatatataactcttactaacaatgtagnacaatttggggaagaagnatgnaatctcaaagaaagtgcnaactactcatttgttaacttgtgtagaaacttctgttattcaacgtagtccttttattccgaaatggataagcattaaaagagattngtcttaatttactttcaaaaacttctttaattagcataaagaaaggaaagaagaataagagtttctggctttaagttaatttttcacatggagaatatatgtataaatacagtatcatgttaatagatactggtaaagtgtctgaggtttcatcaaaagggaaagaaagcaattgtgctagatataaatcagggaaggattc

SEQ ID NO: 23363 - DNA, 244 bp, Homo sapiens
  misc_feature 25, 31, 33, 45, 47, 50, 53: n = A,T,C or G
aatcacctttcttaccccacatatncatggngnatgagctacccntntgnggntactcaggagctgtctcggttctcacatccactgttgccgtatcacagtgcttatgttcaggtagcctttatttcacttaacattgtccccaaagtgcaagagtagcgatgctggcaatttggatatgccaaagagaagctgtaaagtgcttcctttaagtgaaaaaggggaaagtattgaacctaatagg

SEQ ID NO: 23364 - DNA, 387 bp, Homo sapiens
  misc_feature 9, 18, 37, 43: n = A,T,C or G
aagaccctnactactgtncaagggatcgctggatganttcganaaaaagaaactagtgaaggcgttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgcacaggtttaaaaacctcacagcttgtataatgtaaccatttggggccgcttttaacttggactagtgtaactccttcatgcaataaactgaaaagag

SEQ ID NO: 23365 - DNA, 238 bp, Homo sapiens
  misc_feature 22: n = A,T,C or G
gaaaaattcccagtatgaaaanggaagaaatcaataaaattatacgtagacctgtgttgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaagggaaatttcacagtat

SEQ ID NO: 23366 - DNA, 397 bp, Homo sapiens
  misc_feature 1, 55, 57, 58, 63, 156, 184: n = A,T,C or G
naaggcatcccggcagccagcgcaggggcttctgctgagggggcaggcggagctntnnggaancccgcagacaagatgttttctctttgaaagatagagattaatacaactacttaaaaaatatagtcaataggttactaagatattgcttagcgntaagtttttaacgtaattttaatagctnaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagc

SEQ ID NO: 23367 - DNA, 397 bp, Homo sapiens
  misc_feature 21, 55, 63, 70: n = A,T,C or G
gaaataaaccccacagccttngtcaagtactgaaaactctcatgctgcgcaaagngcttgaanaccatcngacgacaaggtatataatcttactcatctgaatccatcaactgagtataaaatttgtattgatattcccaccatctatcagaaaaacagaaaaaaatgtgtaaatgtcaccaccaaaggtttgcaccctgatcaaaaagagtatgaaaagaataataccacaacacttatggcctgtcttggaggccttctggggattattggtgtgatatgtcttatcagctgcctctctccagaaatgaactgtgatggtggcacagctatgtgaggaattacttacagaaaccaacctttgcattaggtgagctttatcctcctctgataaatc

SEQ ID NO: 23368 - DNA, 189 bp, Homo sapiens
  misc_feature 8, 17, 28, 41, 54, 56, 67, 154, 155: n = A,T,C or G
gcggattncgagaaatngacgagctaanaaaaaattaaacnaaaggcaaaggcncnttggaagtacncaggctgaaagatgtagaagaaggagatgagaaatttgaatgacacccatcaatctcttcacctctaaaacactaaagtgtttccgnntccgacggcactgtttcatgtctgtggctgccaa

SEQ ID NO: 23369 - DNA, 203 bp, Homo sapiens
  misc_feature 9, 21, 27, 43, 46, 49, 50, 52, 58, 66, 71, 198, 199: n = A,T,C or G
aatatgaanttgagatggtantccgcncgtgcaataccatggnganctnngncgacgnggaatcanggatnagattccggagagggagcctgagaaacggctaccacatccaaggaaggcagcaggcgcgcaaattacccactcccgacccggggaggtagtgacgaataaaaaaaaaaaaaaaaaaaaaaaaaaccnngggg

SEQ ID NO: 23370 - DNA, 397 bp, Homo sapiens
  misc_feature 3, 55: n = A,T,C or G
gantaaccctcttaaagaaaagaattttcaacccagaattacatatccagccaanttaagcttcataagtgaaggagaaataaaatacttcacagacaagcaaatactgagagattttgtcaccaccaggcctgccctaaaagagctcctgaaggaaacactaaacatggaaaggaacaactggtaccagctgctgcaaaatcatgccaaaatgtaaagaccatcgagactaggaagaaactgcatcaactaacgagcaaaatcaccagctaacatcatcatgacaggatcaaattcacacataacaatattaactttaaatgtaaatggactaaatactccaattaaaagacacagactggcaaattggataaagagtcaagacccatcagtgtgc

SEQ ID NO: 23371 - DNA, 101 bp, Homo sapiens
  misc_feature 8, 17, 24, 29, 45, 52, 57, 58, 59, 62, 63, 68, 73, 83: n = A,T,C or G
gaaataancccaaatgnagggcantgtgntagggcaggacttgangaacagngtgtnnntannagaanagacnacatgtctgnaaaataagagacacaaca

SEQ ID NO: 23372 - DNA, 400 bp, Homo sapiens
  misc_feature 3, 6: n = A,T,C or G
atnttncctaggaaacccaatacatttaacaagaaattatattgacttattatacaggattgtacagaattacactgacgaaatctcactgaagaaaatgaaagaagacttgaatgatagactgaacaattatttatctggataaaaagactcaataaagtacaaatacacactatctttttattattctatgaagttaatgcaattccaattaaaatcaaaacaagtttttattgacataattattttcaagtatctgaagaatgaatgcatggaaatatcccaaaagtttttttaaaaaactataatagtctgctagaggctatcaattttgttgatcctttcaaaaaaacagctcctggattcattaatgttttgaagggttttttgtgtctctatt

SEQ ID NO: 23373 - DNA, 163 bp, Homo sapiens
  misc_feature 7, 11, 32, 70: n = A,T,C or G
aaaagangccnccaagcacggtggcacatgcntataatccgagctactcaggaagttgaggcaggagaancgcttgaacccgggagcagaagttgtagtgagccgagatcacaccattgcacccccacctcagcgacaagagcgaaactcccccttaaaaaaa

SEQ ID NO: 23374 - DNA, 176 bp, Homo sapiens
  misc_feature 66, 72, 97, 103, 113, 115: n = A,T,C or G
aaatcgcccccacctctgagacccaccttgctcataaacaaaatgcccatgttgtgcctctgcccnggaccngtgacattctggactatttctgtgnttattngtggccgagngnaacaaccatataataaatcacctcttccgctgttttagctgaagaattaaatcaaaaaaaa

SEQ ID NO: 23375 - DNA, 171 bp, Homo sapiens
  misc_feature 3, 4, 59: n = A,T,C or G
acnncctaggcggcaaggatgactagtttatttgcttggaatggagttgcaattctttnagcacaaatttattttacgtttagatttttaaatgactgtggatgaaggcagagttgtccctgtatcgtaagattctgtaggagagaaccagtactcttctctgaaatgttg

SEQ ID NO: 23376 - DNA, 114 bp, Homo sapiens
  misc_feature 8, 12, 35, 38: n = A,T,C or G
taaacganaacncactatccggcgcacgactgacnatngatgcttggagagagtaacaccgagacagatacaaatggaaggagggaactggagagcttcggtgatgcgtatgtg

SEQ ID NO: 23377 - DNA, 119 bp, Homo sapiens
  misc_feature 17, 21, 22, 23, 28, 29, 31, 35, 39, 40, 41, 45, 50, 52, 54,55, 56, 57, 61, 63, 71, 79, 80, 87, 88, 89, 90, 91, 92,93, 110, 111, 112: n = A,T,C or G
cagacgattttaaagangggnnnaacannancccngggnnngggnttggngncnnnngggncnaacccccnaaaagggnngggaaannnnnnnaaagggggggccccccnnnaaaaaaa

SEQ ID NO: 23378 - DNA, 400 bp, Homo sapiens
  misc_feature 7, 90, 91: n = A,T,C or G
gaaaganacccgttgatgcctgaagttactcccgacatggattacttaccgagagttcccaatcaaggcattatcatcaatcccatgctnnccgacgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcaagtactggcgttttaccaatgatataaaagatgcagggtaccccaaaccaattttcaaaggatttggaggctaactggcaaat

SEQ ID NO: 23379 - DNA, 397 bp, Homo sapiens
  misc_feature 89, 90: n = A,T,C or G
gaaagagacccatgaagacttagaagagtagcatgaggaaggaaaagataaaaggtttctaaaacatgacggaggttgagatgaagctnnttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggggattaaaagaccttgaaatccatgacgcagggagaattgcgtcatttaaagcctagttaacgcatttactaaacgcagacgaaaatggaaagattaattgggagtggaaggatg

SEQ ID NO: 23380 - DNA, 310 bp, Homo sapiens
  misc_feature 10, 19, 68, 69, 70, 73, 76, 200: n = A,T,C or G
ggaaaagaancccatatanagaataaatgggaactatacagtagaagaaggtagctcttattgccatnnnctnacngagttgtagtaccagattgagtcccaagtcatattcttactgatttttaggctgtagtatacaaaatttaaaactttaatgaacagccaagcacggtcactcatgcctgtaatcccagggcttngggaggcagaagggggaggatctcctgagcccaggagttccaggctgcagtaagccctgatcatacaactgcactccagcctgggtgaaagagctagaccttgtctctaa

SEQ ID NO: 23381 - DNA, 400 bp, Homo sapiens
  misc_feature 13, 33: n = A,T,C or G
tggggaagaaatncccacattacggcaaatggnctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagcaccacgaaaagctggagcttcatgcatcctggga

SEQ ID NO: 23382 - DNA, 400 bp, Homo sapiens
  misc_feature 6, 24, 41, 50: n = A,T,C or G
gaaagnacacccagaactagcttngcatgattctctgacangcacaaatntcagtttccacagtttaattaaaaaaaccagctcccaacaacatagttcaaatttcatttaccaagatatattaactgtgagtaattgcgtaaagtacaaactttgctgctagctcatcagtccacaaatcactgtgcaaatagcaagtgcaagttatggtcagtgaccaattgcatcatttctttcaaaatctgccagtgattagcccataggcatcttttagtcagttcatgcacagacagcaaaagcatgtagttgtgttgttgctttgctctcagaggtaaacctatatgacgttttcaaaaagtggataattgaaaaagtgaatgaactgatgaagaatgaaagt

SEQ ID NO: 23383 - DNA, 238 bp, Homo sapiens
  misc_feature 8, 9, 36, 45, 46, 51, 58, 65, 70, 79: n = A,T,C or G
gaaaggtnncccggacctgcttgaggccacgagttnaagaccagnntgganaacatgntgaagcnctacnaaaaacacnaaaaaattagccgggtatgatggtgtgagcctctagtcccagctacttgggaggctgaggtcagaggatggcttgagcccaagaggcagaggttgcagggtcaagatcgcaccacttgcactgcagcctgagagagagagagccagaccttgtcaaaaa

SEQ ID NO: 23384 - DNA, 400 bp, Homo sapiens
  misc_feature 32, 39, 46, 74, 77, 92, 148, 153, 165, 295: n = A,T,C or G
aaagttaaatattggttgaagccatgtgaagntgttagnatttgtnagcttttgagctacagaaatgacgtttnctnatgggtcaacctaanatatcctccaaattaatttttggtagatgataccctaaatggtcagcagtcctttngggcnctctcacagctntcaagaagctcctgtgttttagatgttacatttgttccaactgctgctgcttatttcctaagaagggctttctgcttcttggagctgtgcagtggctacccggctctttagacctgaaaagagcttttgnttattagaagctgtggctgagatccagccagcctagccggcctatggttgccaaatgctgctttggtggtttcttcagcatgagcagagacacacttgatctcag

SEQ ID NO: 23385 - DNA, 397 bp, Homo sapiens
  misc_feature 2, 75, 91: n = A,T,C or G
gnaactgaccccgaactgagaattctacaactataaaacattaatttttgaaggtattttagttttgtggctggncattcagtgaagtctnaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgtgccag

SEQ ID NO: 23386 - DNA, 398 bp, Homo sapiens
  misc_feature 2, 25, 32, 33, 37, 39, 46, 57, 60: n = A,T,C or G
tntgaggcacacaggacagaggagncagaggnnctgncnactgttntcttcactttnttngaccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggtgtgactccaagagcagagtgaggaagacccccaagcatagactcgggtactgtgatgatggctgcagccagttttatgattctgcttttatgtgcccttgataacagtgacttaacaatatacattcctcataaataaaaaaaaacaaga

SEQ ID NO: 23387 - DNA, 321 bp, Homo sapiens
  misc_feature 3, 23, 28, 46, 256: n = A,T,C or G
tcntgacaactccagttataaangtcangtctaaaggctgcttatncagtaaacggacccagtaaggtttttaatgtgctcgatctattaaaacagcttaagaaactttagtttttctctgttcctttaatatattgaaatcagtgcagcatacttaaaagctttctataaactgtaaaggtgattatggtttgaactcatttttaaattgacaagacaaacattgaagtaggactgtaaagactgacttgctgtnttttttttaaacgaagcacttagttctttgagcctttattttccaaaataagttaggtatttgaa

SEQ ID NO: 23388 - DNA, 400 bp, Homo sapiens
  misc_feature 4, 47, 101: n = A,T,C or G
cggntacagagcaacccaaggagacaaaatgctgctgaattcccatnagcctatcagggagggaatgttttctgtgactcatttaagtggcctcacttggnggattatattctgttattggcccctccagcccttcccccttttaagaagaggatgtttgtaaattagaagcaacaggaacaagaaagtcatttgaagagcccgaggaggattaaacataagtattcgttatgtaatatttgtaattccctgcaatcagcctgttcctttccccatagggggcaaggagatcaggatctggtgaggtgtgaatcttgggaggtatgaggaagttggctgagaaagtgaactttctcctggctttcctgagggtgtgctcttagaggctccccccttaagg

SEQ ID NO: 23389 - DNA, 164 bp, Homo sapiens
  misc_feature 4, 21, 28, 34, 42, 53, 59, 153: n = A,T,C or G
attnaaatagactaacaaagnaggaggnagtatnccttctantttcaaagctnactacnaagcaacagtaatcaagacagagtggtactggcactaggatagacatacaaatcaatggaatagaattctgagttcataaatagacctgtgtgnctgtgatcaac

SEQ ID NO: 23390 - DNA, 397 bp, Homo sapiens
  misc_feature 7, 50, 73, 90: n = A,T,C or G
gaaaccntcccgaagggattgatgctgctctcaaaagggctatttggagngggttctctatcttctgcccctntttaatgaacagccttnctccccactaaaggaagcagtgttcaaggcatcatcttgaaagcagagactgggcccataccagacaccagatactggtacattgatcttggacctctcagtctccagaactgtgagaaaataaatttctgttcttcgtaaagtatgcagtcttagatattttgttatagcagcacaaaatgtactgagatcgtttccattcagcacatttcttttaataatgtgaggaattcagtgcaatcaatttactgcacataattgctagtctgtgaattatggaaacactctggagatcaatgattcattt

SEQ ID NO: 23391 - DNA, 397 bp, Homo sapiens
  misc_feature 57: n = A,T,C or G
gaaagacccccagggaaagaaaaggtggcaaggtgtctagccactccgtgtggagcntttctgagggtgctaccagcacagggtgagcacattgctccatgagagggatgtgagaccttgaatagaggagtcactgttgggaatgtgaaattttttcaacaagagatcaatactggaagtgatagaggcccagaactataactggctacacacccaggaaatcccattttgaccagttactagccatgtttgggaacccaacaattaatgcagagaaggtgagtgtgtacaggtgttcctccgggttggggattaacaatgcagatttgacaaaaagttgcaattcttgggaagtaaacatgtcgctcagaaggcccataatgacagaaaatgatgg

SEQ ID NO: 23392 - DNA, 395 bp, Homo sapiens
  misc_feature 13, 17, 37, 53, 76: n = A,T,C or G
gaaattaccccgnattnttttcaccgaagtcattttngcacttaaggccagangatttcagctggccttggagatntattatagtaagaaaaatttagtctagaaataggaaggagcttctcaaatgaagtatatttaaatactgggtcagattaataagataaagagacagtactttgaaatagttaataattaaggctttgggagctcagataaggattttttagtagagtaatttcaatgaactatcccattaatttgcattcacttagaaaaagaattatttcacacacaaaaagtaagatcataggattttcctgggtaatatttgcatccttgaagttacccaatttctcttatttgaaatgtaaaaaagccatacatggtggctcaca

SEQ ID NO: 23393 - DNA, 261 bp, Homo sapiens
  misc_feature 17: n = A,T,C or G
gaaaattcaacctatgnatactagatccttccagtttgatggtttggtcattcttcttcatgattataccatggagaattttctgtgacaagggtggtcatggaagtaagtgagtgatcccctggtttctcattccttaaagcagtggttcgcaaagtatggcacaagaccagcagcatcagcagcctttgggaacttgttagaaacgaaaattctcaatcccatcccagatctgctgaatcagaaactctaatgagagga

SEQ ID NO: 23394 - DNA, 100 bp, Homo sapiens
  misc_feature 13, 15, 37, 42, 44, 45, 50, 57, 58, 59, 70, 74, 80: n = A,T,C or G
gatcagacaagancntggtccacagcgggacgagagntctcnannctgcnggggagnnnccaagtacgcnagcnctgaanctaaagcaagcaagaaaaag

SEQ ID NO: 23395 - DNA, 400 bp, Homo sapiens
  misc_feature 61, 62, 79: n = A,T,C or G
tggggaagttaaccccttatttttaaggtcttcttggccaaccacagatatcttcggaaanntttacttgctatccctntaaaacatcaatgcattattttgaggccgtatcattgtcatgttgaagatctagtggacttggtggtttttgtctcatattggttattcctttttctccctctggcatggctgtgtgatagccctagttttctcacagtctgctgtctgcaaaagggagatactaccagcaaagaatctcaaaacaacattttcacctttgcattgggaaaaataatttaacttccagtaaagacaaagttgcagtaaacaatttgttattctttatgagtaatctttaaaaccgcaagtggaagataactggtgaactgaattagcttta

SEQ ID NO: 23396 - DNA, 164 bp, Homo sapiens
  misc_feature 5, 11, 140: n = A,T,C or G
ccgcngacaanatgttttctctttgaaagatagagattaatacaactacttaaaaaatatagtcaataggttactaagatattgcttagcgttaagtttttaacgtaattttaatagcttaagattttaagagaaaatangaagacttagaagagtagcatgag

SEQ ID NO: 23397 - DNA, 397 bp, Homo sapiens
  misc_feature 14, 59, 69, 71, 88, 89, 322, 327: n = A,T,C or G
gaaagcttccctgncgcttaactatgttaagcatctagactaaaagccaaaatattatnattgctgccntnctaaaaacccaaaatgnngggtctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggantaagnggataatacttaattttggcatttgactcttaagattatgtaacctagctactttgggatgggccttaag

SEQ ID NO: 23398 - DNA, 100 bp, Homo sapiens
  misc_feature 10, 24, 32, 33, 37, 38, 41, 43, 45, 54, 58, 60, 64, 69, 71,79, 90: n = A,T,C or G
gactttcaancgaatagtacaccnaaacaaannttannggnanantatccacanaacntntacnatgananatgtaaanaggaatggcanattttggatt

SEQ ID NO: 23399 - DNA, 400 bp, Homo sapiens
  misc_feature 11, 17, 38, 40: n = A,T,C or G
cttattcgggngtgagncttttcagcaacccggtccantnctgggagatacagccatccaccttcagatgtgtctacgtgcgctctgcattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgcattttcagaatcatcttttgaagctttctgttgatgttaactgagctactagagatattcttatttcactaaatgtaaaatttggagtaaatatatatgcaa

SEQ ID NO: 23400 - DNA, 400 bp, Homo sapiens
  misc_feature 9, 52, 61, 70, 74, 76, 94, 294, 336: n = A,T,C or G
gaaaaatancccagttcggaaagactggggaagtacttctgaaggaggaggnagagagttnaaaactttncatngnaactgtgacctctccctncttcagcttaagctaaatttagtgatacatagaaaaagtttggggcttatgatattgaattcatttcccaagcatactcattgttttgtaagaaatgcaacaaagttttcattttttaataactcggcaaaggtactgggtacaggggacccctttgccctttcattgagaccatttacataagtttttgtagtttctgnaacttttattattttatgttctctctcatagaagtgtatgtntctggaaggaaggcgatttgttaatacaaatcctaaagatagattgtttacccttgaaaagaaa

SEQ ID NO: 23401 - DNA, 248 bp, Homo sapiens
  misc_feature 12, 17, 39: n = A,T,C or G
aggttttggaanccgcngacaagatgttttctctttganagatagagattaatacaactacttaaaaaatatagtcaataggttactaagatattgcttagcgttaagtttttaaccgtaattttaatagcttaagattttaagagaaaatatgaagacttagaagagtagcatgaggaaggaaaagataaaaggtttctaaaacatgacggaggttgagatgaagcttcttcatggagtaaaaaatg

SEQ ID NO: 23402 - DNA, 100 bp, Homo sapiens
  misc_feature 6, 46, 79, 80, 86, 97: n = A,T,C or G
aaatcnacctcacggggctgacaccagccaaggcacaccattgcantccagcctgggtgacaagagcgaaactctgtcnnggattnaaaaaaaaaanaaa

SEQ ID NO: 23403 - DNA, 400 bp, Homo sapiens
  misc_feature 3, 4, 41, 48, 51, 58, 59, 73, 75, 76, 88: n = A,T,C or G
ccnnaagagaagtctgccgttactgccctgtgagagaaagnagaacgntgnatgaagnnggaggtgaggcccngnncaggctgctggnggtctacccttggacccagaggttctttgagtcctttggggatctgtccactcctgatgctgttatgggcaaccctaaggtgaaggctcatggcaagaaagtgctcggtgcctttagtgatggcctgctcacctggacaacctcaagggcacctttgccacactgagtgagctgcactgtgacaagctgcacgtggatcctgagaacttcaggctcctgggcaacgtgctggctgtgtgctgcccatcactttgcaaagaattcacccaccagtgcaggctgcctattagaaaggggggctggggtgctaat

SEQ ID NO: 23404 - DNA, 400 bp, Homo sapiens
  misc_feature 2, 18, 64, 82, 83, 182, 213, 245, 265, 270: n = A,T,C or G
cncccgaagctaaagctntgtctctgttgacaccagctaatgcagtggttgtctcctgcctggngatggactcctgcctacnnctaacccacttacccagattggcgctgttccactggctgctttgggggctcctactcttgatcctgcccttgctgcacttgggcttcctggagcaaacntgaactctcagtctcttgctgcagatcagtngctgaagcttatgagtactgatgatcccaaancccattccttgggtctgttncaggntgaatcatgtagctgctggctcgtttcaccaagtctgaaatcggatacctctagtaaagaaatagaggaagctatgaaaagagtacgagaagcacagtccctaatttctgctgctatggaccagataaga

SEQ ID NO: 23405 - DNA, 397 bp, Homo sapiens
  misc_feature 8, 11, 54: n = A,T,C or G
gaaaggcnccnaggcagccagcgcaggggcttctgctgagggggcaggcggagnttgaggaaaccgcagataagtgtttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagct

SEQ ID NO: 23406 - DNA, 400 bp, Homo sapiens
  misc_feature 9, 16, 27, 35, 56, 73, 77, 102, 109, 123, 225, 337: n = A,T,C or G
caaacctgnggacctnagaacgtcttncacagganggggaggctggagaggtttgngggggaggcgctgacgnattntgatcaagggtatgaagcccctggngtgcggnaagcggctgcagcnctggaggaggaggaaactcgcagataccgacctactaagaactacctgagctaccagacagccccggattattctgcctttgaaactgacataatgagaaangaatttgaaagactggctgctcgcaaccgattgaattgctcagtatgaaacgatatgagcttccagccccctctctggcaaaaaaatgacattactgcatggcaaggaatgngtaaacaattctatggcccagttaagagcatcaagcagtaagaattgagaatctgggactaat

SEQ ID NO: 23407 - DNA, 400 bp, Homo sapiens
  misc_feature 4, 10, 32, 100, 389: n = A,T,C or G
tttnaattanatagtctaattggatgttacanaagggacattatatagcatgtatacttttacatatactttcttttggcatcatatttgtaatattcancaatcctgctggagatatgtaagtactgagattacaggcatgagccaacgtgctcagcctaaaatattttaggaggttaaggtgggaggatcacttgtggctgggaattttagaccagcctgggcaatagagtgagaccctctctctacaaaaaaattaaaaattagccaggcaccggtggcatgtgcctgctattccagctactcagaagactgaggcagaaagatcagttgagcccataagtcaaggctacaggaagcaatgattgactcctgcactcccgctgggnaacagagcaag

SEQ ID NO: 23408 - DNA, 400 bp, Homo sapiens
  misc_feature 5, 11, 30, 44, 50, 51, 52, 53, 59, 321: n = A,T,C or G
aaggngagagnagatataaaagcttatgtnagactacaaacaanttcctnnnntctagntgaaatatacagcctcccaaacaccgaggagaatacttaaataagagaacgggaaatcctctgttgagaaatctcatatattctgtccagaaaataaatggagacattatatcgtgtataaatattcaatatcagaatgttggccaacagatttgttcatagaatagtacagtgtatatttgttttattcccatacgaggcttaaaagttccacacattacttacagataaataaattacatatatattttagctttctagntattctattttacattcacagtaaccttgcaaaggaagtagtgaaacttttagcattcccatttcaaggcaaggaacta

SEQ ID NO: 23409 - DNA, 400 bp, Homo sapiens
  misc_feature 7, 18, 57, 60, 372: n = A,T,C or G
aggcagncagcgcagggncttctgctgagggggcaggcggagctttgggaaaccgcnganaagatgttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaataggaagggcaatgcttttaagattaaaatganggtgacttaaacagcttaaagtttaagt

SEQ ID NO: 23410 - DNA, 398 bp, Homo sapiens
  misc_feature 13, 32, 43, 92, 112, 389: n = A,T,C or G
gaaactaaccccngagggacttcaccctcttntgccctcattngatgagacagccattgtgagactgatgcacaaactgtcacttggttaanttaagcacttctgttttcgngaatttgcttgtttgtttcttcatgcctttacttactttgtcccatgctactgattggcacgtggcccccacaatggcacaataaagcccctttgtgaaactgttctttaaatgaaacacaagaaattggcactggtaaaactctgcagcttcaactgtacttcatttaatgccattaatgcaaatatacttcctcttctttttgcatggtttgccacctctgcaatagtgataatctgatgctgaagatcaaataaccaatataaagcatattctngggcttgct

SEQ ID NO: 23411 - DNA, 397 bp, Homo sapiens
  misc_feature 11, 56, 330: n = A,T,C or G
gaatccatccnacattgaagttgacttactgaagaatggagagagaattgaaaaantggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggntataataatggtaacatggacatgatcttctttataattctactttgagtgctgtctccatgtttga

SEQ ID NO: 23412 - DNA, 384 bp, Homo sapiens
  misc_feature 9, 14, 41, 46, 65, 81: n = A,T,C or G
ccccagtgngtttnccattgtttatgcttgaggaatttgtngtganttagatcactgtgccaatngctttagatactgccngattgtcttaaggaagcagtgcaactggttaaggaagagtgtttattgaacagaagataagtataacttttttccctttcttcacttggtcagaaagatgttactcaatattttaaaagacaatccccagatcaggccttcctaagtgtgctgatgtcattgtcctggctgcagttggattgcttctcttattttcaaacaaataaaataataaagttactggataagcaagcagaagccaacattttccctagctttttctacgtcccagtgataccttatcctcagccaacccttgggaag

SEQ ID NO: 23413 - DNA, 354 bp, Homo sapiens
  misc_feature 26, 41, 58, 60, 65: n = A,T,C or G
aattgaccaagattgaaacaatatgnaattgaagacaagtntgtcagggaacctgtgngngcttntaagacgaatatactttaaaagagtttttatctaattttcccctgtagaaagtattggtgagttttgagtattgacatgtattgagctagttctacaggcaccttgctaggggaaagccttcagaggaagcaactgcataaggatttaataagcatttattgagcccttactactagtcaggcaaaatattaggtcatggggactaagatgaaaatggtagcattctcaccatgggacacgtttacctatgtaacagacttgcacatcctgaacatgtacccctgaact

SEQ ID NO: 23414 - DNA, 400 bp, Homo sapiens
  misc_feature 12, 20, 38, 44, 393: n = A,T,C or G
gtggcgctaggnagaaggcnaccttcactggatttganttcagngcctaagaaagcctgtgaaatgttcgtttttaggcaatataggatgtcttaggccctaattcaccatttcttttttaagatctgatatgctatcattgccttaataatggaacaaaatagaagcatatctaacactttttaaattgataattttgtaaaattgattacgttgaatgctttttaagagaagtgtgtaaagtttttatattttcacaattaacgtatgtaaaaccttgtatcagaaatttatcatgtttactgtttaaaatgattgtatttataaaattgcaatatcttaatgtatttaatgtagaatattgctttttaaaataatgtttttatttgctgnaggaaaa

SEQ ID NO: 23415 - DNA, 366 bp, Homo sapiens
  misc_feature 4, 5, 268: n = A,T,C or G
acanncggaacatgaatagcctttccaaagaaatgagggcatgattattgtacagtaagtacgtgactgatttaatttgatttacagagcggagtgtgttcttataaaaatatttaatgacattggttcttgtcttttgatcttttatttctgaaacactcaaacaccttacaaagtgctgagtaggtaatagtgacccaacttgtttgctaaatgattatttgtttaaatctgtacagttttaagtgttcacttatacaaagagtgnatatactttcaaataatttaaaatgctttatattatttggctagaaattgctgttttaataaatgtgaatttttaaaaataaagatttttgcttccta

SEQ ID NO: 23416 - DNA, 355 bp, Homo sapiens
  misc_feature 9, 13, 42, 46, 48, 51, 56, 57, 67, 83: n = A,T,C or G
agacatgcnattnagccaaataaagtataggcgatagaaatngaantntgncgcannagagatagtnaccgcaagggaaagangaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtaggaggcgacaaacctaccgagcctggtgatagctggtgccaagatagaatcttaagttcaactttaaatttgcccacagaaccctcg

SEQ ID NO: 23417 - DNA, 400 bp, Homo sapiens
  misc_feature 8, 15, 33, 43, 60: n = A,T,C or G
tggggaanattcccntagaaaatcaaaggtggntcaatacagnagaatcccaggactgcnttttaaaattgcctcacagatcacactcgctgggggcaaatatcatcatcgttgctaaaggacagaaaatactgatgtgtgttttaactaactggtatattgatccatgggaggctgcacagaagaccctgcggccaggaggggcattgtcagtggctgcttctcctgagctccacgccttcattgcagctgcatgttcaatacaatacacctgcttcacagccccatggacatccctacaggtactgtcatgtgaagccttgctagtagttctctccagggcaaatgaagctcacagttttgcaaggtggaaacctcttattcacatttgccttgattc

SEQ ID NO: 23418 - DNA, 397 bp, Homo sapiens
  misc_feature 9, 20, 47, 56, 57, 58, 59: n = A,T,C or G
ggaagagancccgcattagntctgttcgaaaagtgtgtgcaagatanatatttgcnnnnggaacatatcataaaaaagttaattaaagaaaataagaagcatcaggagctcttcgtagacatttgttcagaaaaagacaatttaagagaagaactaaagaaaagaacagaaactgagaagcagcatatgaacacaattaaacagttagaatcaagaatagaagaacttaataaagaagttaaagcttccagagatcaactaatagctcaagacgttacagctaaaaatgcagttcagcagttacacaaagagatggcccaacggatggaacaggccaacaagaaatgtgaagaggcacgccaagaaaaagaagcaatggtaatgaaatatgtaagag

SEQ ID NO: 23419 - DNA, 343 bp, Homo sapiens
  misc_feature 1, 16, 57, 60, 62, 65, 70: n = A,T,C or G
naaattgcccgaagtntgaggccccttaactcatctgttatactgctagctgtattnaangnatnctganaaacatgaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcaagaatttctttgtcattcaagcctgtgaataaaaaccctgtatggcacttattatgaggctattaaaagaatccaaatga

SEQ ID NO: 23420 - DNA, 177 bp, Homo sapiens
  misc_feature 4, 18, 27, 31, 50, 92: n = A,T,C or G
aaanttgcccacagaacnctctaaatncgantggaattttaactggtagnccaaagaggaacagctctttggacactaggaaaaaaccttgnacagagagtaaaaaatttaacacccatagtaggcctaaaagcagccaccaattaagaaagcgttcaagctcaacacccactaccg

SEQ ID NO: 23421 - DNA, 105 bp, Homo sapiens
  misc_feature 17, 40, 42, 63, 68, 71, 79, 82, 97: n = A,T,C or G
cagacaggcagcgcaangggcttctgctgagcggggcagncngagcttttggaagccgcgganaagangtnttctcttnganggataggagattaanacaactac

SEQ ID NO: 23422 - DNA, 400 bp, Homo sapiens
  misc_feature 16, 19, 30, 35, 359: n = A,T,C or G
taaaaattgccaacanagngagacaccagngctgnctgtagcgagacggggctgacctgagctgttaggagagtagatgcggggagggctggtgacctccgtgggtttatatgtcggaaactcttctctccaaatcccaggcctggcttccagcaccatccagctgtgcccaagaagccaccctggtctgttctccaactcttttaaatggtgcccaacttttctaagtgagcttagcaatgagaagaaaaaaaaacatgaattctttttctggaaaatcagggagacatgggtaataataggactaataaatatttatagatgagtgaatgaggaaataattacatcaaaaaggcagngacaattgataaatgcaaggaaatatttaattaggtaaaac

SEQ ID NO: 23423 - DNA, 140 bp, Homo sapiens
  misc_feature 5, 8, 13, 14, 15: n = A,T,C or G
aaagnagnttaannngcgggaaacatgcagtttatctgcagggctgttgtttccagcaagacccaaagctagaaaaggaggaggaagaaactgacccgatcagtgccagaagtcattgtattcaaagaagaataagcaag

SEQ ID NO: 23424 - DNA, 121 bp, Homo sapiens
  misc_feature 4, 21, 39, 46, 48, 49, 56, 65, 70, 77, 85, 89, 112: n = A,T,C or G
atangaggaggaggacatgtncataaaactagggggggnccattcnannggtgaanaccagaagnaactnaagggancccactgnacanaggacttattctgcttacatganaaaaaaatg

SEQ ID NO: 23425 - DNA, 195 bp, Homo sapiens
  misc_feature 26, 29, 44, 45, 48, 50, 52, 59, 60, 62, 83: n = A,T,C or G
gaagcggaagcaggacaaagacaganacntgaagaaaaaagcannttncnanagagacnncnagagagacaaaagcagtttanacaaaggcatcacaaattctgtctctggatacaatgtggaaggcagcctggcagagagtccataatcttatttaaataggttaggtaatagcctatgttgtttgcaatctcg

SEQ ID NO: 23426 - DNA, 246 bp, Homo sapiens
  misc_feature 129, 173, 184, 237: n = A,T,C or G
gaagatcagcactgcactgttagctgagagtgcgggcaagacataaactgtccagagtttgaaggttctcggaaagaccggaggcttctccccacagaaggcggagagagctggggctcagacatgggngtgcaccttaataaaccctgctgctgctcctgactctgcttctngggagcatggngagcagcctgggctcagcagccatacctatgggacacacactacgaaaaggangcctttagg

SEQ ID NO: 23427 - DNA, 212 bp, Homo sapiens
  misc_feature 2, 6, 38, 39: n = A,T,C or G
tntttngaagagaaaagaagggattcaagatcaagatnncgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaag

SEQ ID NO: 23428 - DNA, 100 bp, Homo sapiens
  misc_feature 14, 19, 33, 35, 37, 54, 58, 63, 64, 65, 67, 77, 91: n = A,T,C or G
tagtatggttgccngacanaagggtcggttggngnanacgaacaggatgaaacnaggnttggnnngntcagccctcnaaaagcatagggcntagcctgca

SEQ ID NO: 23429 - DNA, 292 bp, Homo sapiens
  misc_feature 8, 17, 35, 56: n = A,T,C or G
actgattntaagaaatngacagagcatcaggaaantatttttaatatggctaaaanttgtgtcattagggttccagaaagagagaaataaaaagagcatagttctaaaaaaaaacttttgaagaaatgatggctgaaaacttactaattttggcaaatacataaacttataggtccaattggttcaggaactgtaaacagaatagccccaaagaaagtaatgcctagacatatcataataaatgtagtgaacacaaaaaacaacaaaatcttgaaagcatccagaaaaaatg

SEQ ID NO: 23430 - DNA, 397 bp, Homo sapiens
  misc_feature 3, 4, 35, 40, 327: n = A,T,C or G
ggnnacagagatgtttcacagcattgagtagaatnttganaaccaggaaacaaatgtttaattaataacagattgcctataaattaataacatttatggtgcttgtacatgtgagaaatatgtgcaaccagtaaaaatgataatgtaaagaatgactggaaaagatatccatactaatattaagtgggaaaaataagattaagatatatagcattatcttgttttttgcaaaaagaaagtgaagtcagttataaagacaaaacctctgcaaatgtatatatgaatttaaaatacataaaaggatatacacaaaagagcttgagtggnagcatttgttttcttattcttgcttactaagacttctgtattgctgagtgtggaggtcctgctgaatctt

SEQ ID NO: 23431 - DNA, 286 bp, Homo sapiens
  misc_feature 16, 23, 29, 31, 38, 45, 46: n = A,T,C or G
aaggagatggagttgngagattnatcttngnagatatngaaattnntagtgattatgatataaatattgttggaaagactgacagccaagaaccaatactttcaaaaaacagggggaaataatctgcaggagagtagataattgcaataagaagggatatttgttagtgttgttgatgatgtaagatgtaaaggtgaatgctttcatgatgaagaaagagaaaatattaagtagaaatgaggaacgtgaagatcacctactccatattcaaggcccaagatacacg

SEQ ID NO: 23432 - DNA, 220 bp, Homo sapiens
  misc_feature 9, 33, 44, 47, 48, 49, 50, 51, 63, 64, 65, 66: n = A,T,C or G
gagctgatncagaagattctggttcaaaagttntttgttttttnggnnnnnttgagacggagnnnngttttgtcgcccaggttggagtgcaatggcgcgatctcggctcactgcaagctccgcctcccgggttcacgccattctcctgcatcagcctccctagtagctgggactacaggcccctgccaccacgcctggtaatttttttttttgggatttt

SEQ ID NO: 23433 - DNA, 100 bp, Homo sapiens
  misc_feature 2, 13, 30, 32, 36, 40, 42, 44, 49, 50, 51, 66, 69, 76, 89,92, 94: n = A,T,C or G
gnagaacggcgtnaaaactactgcaagatntnaganaagntngnaagannngcaaagagaaaaacnagnatactangaaaaccccaaanaancnataaac

SEQ ID NO: 23434 - DNA, 234 bp, Homo sapiens
  misc_feature 4, 19, 30, 35, 38, 53: n = A,T,C or G
agangcgtgcccgtaatgnctgaaacctanagctnatntttatgcagcacagnaagagcaacgggattctcttctgcggccgtttttcctctccgtgagacagggcagcttggtgtgcagccctctcctctctgtcccctgacactccacagtgtgcctgcaacccaagtggccttatccgtgcagtggtggcagttcagaaataaagggcccatttgtgggatgccgcattcg

SEQ ID NO: 23435 - DNA, 316 bp, Homo sapiens
  misc_feature 59, 86, 91, 106, 134, 161, 181, 220, 305, 307: n = A,T,C or G
ttatgtaatttattttaggctataatacatttcctattttcgcattttcaataaaatgnctctaatacaatacggtgattgcttgngtgcncaacatacctgcagntgaaacgtattgtatcaatgaacattgnaccttattggcagcagttttataaagnccgcatttgcatttgaatgnaaggctcagtaaatgacagaactatttttcattatgggnaactggggaataaatgggcactggagtaggaatagaagtgcaagctggaaaggcaaaaatgagaaagaaaaaggcagccctttgngnctaccggtt

SEQ ID NO: 23436 - DNA, 398 bp, Homo sapiens
  misc_feature 5, 15, 72, 375: n = A,T,C or G
agcanccctcctcanaagaagacatacaagtggtcaggaaacatgcaaaaatgttcaacatcactaatcatnagagaaatgcaaactaaaaccacaatgaggtatcatcttacaccagtcagaacggtattattaaaaagtcaaaaagcaacatatgttgtcaaggatgcagagaaaagggaacacttatatactgttggtgagaatgtaaattaagtacgacctctatgaaaaccagttgggagatttctcaaataattaaaaataaaactaccattccacccagcaatcccactactgggcttctacccaaaggagaagaaatcatataaaaagacacctgcgtacctgtgttattgcagcactagtcacagngggcaaagcaatggaatcaacct

SEQ ID NO: 23437 - DNA, 400 bp, Homo sapiens
  misc_feature 11, 30, 38, 44, 45, 48, 51, 55: n = A,T,C or G
agacagggatnccatgccttagaggatgangtgcaganagctannttnatnaggngatgaaaagtgttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttgccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagta

SEQ ID NO: 23438 - DNA, 398 bp, Homo sapiens
  misc_feature 9, 15, 33, 40, 62, 106, 190, 193: n = A,T,C or G
aaaggctgncattcnacagggcacgaatgatgnggaactngttgctgagggcaacagcaggntcacttacactgttcttgtagatggctgctctaaaaagacaaangaatggggaaagacaatcattgaatacaaaacaaataagccatcacgcctgcccttccttgatattgcacctttggacatcggnggngctgaccaggaattctttgtggacattggccagctgtttcaaataaatgaactcaatctaaattaaaaaagaaagaaatttgaaaaaactttctctttgccatttcttcttcttcttttttaactgaaagctgaatccttccatttcttctgcacatctacttgcttaaattggggggcaaaagagaaaaagaaggattgatcag

SEQ ID NO: 23439 - DNA, 257 bp, Homo sapiens
  misc_feature 46, 162, 237: n = A,T,C or G
cgcgtacttgctttgtaagtgatctgaagcgaggactaaaaatccntgcagcaaaatttaatattgatgggaataatgagcgccctccccacccccaaatgttgactatccattagatggagagaagattttacatatccttggatcaatcagagattcagntgtggaaattctttttgaacaagataatgaagagcaatcaagttgccactttaatattggattcccttatacagngccgatagacaccaggaagc

SEQ ID NO: 23440 - DNA, 271 bp, Homo sapiens
  misc_feature 3, 8, 27, 40, 44, 45, 49, 50, 63, 68: n = A,T,C or G
agnatggngtgaccccatatatgatgnttctagtaagganggcnnattnnatggaaaaatgcnaacanatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgctaaaaataaaatgcatttaaact

SEQ ID NO: 23441 - DNA, 179 bp, Homo sapiens
  misc_feature 6, 9, 30, 40, 44, 50, 51, 63, 71, 91, 111, 156, 163: n = A,T,C or G
attggnctngagctgagagtggaagtgttncggagcaggnacgntgctgnnggctctggaggncatttagntaaagcacatgtacactggngttggacagagcagcttggnttttcatgtgcccacctacttacctactacctgcgactttctttntccttgntctagctgactcttca

SEQ ID NO: 23442 - DNA, 244 bp, Homo sapiens
  misc_feature 4, 18, 34, 43, 88, 93, 94: n = A,T,C or G
tagnggcgacaaacctancgagagtggagagagntgtttgtcnaagagagaaacatagttcaactttaaatttgcccacagaaccctntaaanncccttggaaatttaactgttagtccaaagaggaacagctctttggacactagaaaaaaaccttgtagagagagtaaaaaatttaacacccatagtaggcctaaaagcagccaccaattaagaaagcgttcaagctcaacacccactacct

SEQ ID NO: 23443 - DNA, 400 bp, Homo sapiens
  misc_feature 2, 20, 36, 39, 40, 42, 49, 77, 100, 211, 322, 356, 380: n = A,T,C or G
gntcggccaagaccaaaagnaaagaagaaaaagggncanntnccaaaangaaacagatggtacttgttttcaccatngggctaactttgctgctaggagntcaagccatgcctgcaaatcgcctctcttgctacagaaagatactaaaagatcacaactgtcacaaccttccggaaggagtagctgacctgacacagattgatgtcaatgnccaggatcatttctgggatgggaagggatgtgagatgatctgttactgcaacttcagcgaattgctctgctgcccaaaagacgttttctttggaccaaagatctctttcgngattccttgcaacaatcaatgagaatcttcatgnattctggagaacaccattcctganttcccacaaactgcactaca

SEQ ID NO: 23444 - DNA, 177 bp, Homo sapiens
  misc_feature 5, 6, 37, 40, 45: n = A,T,C or G
aagcnnctagattccagtgaagctgagagtgacattnacngagcncaggacatgcagggctggttcagacaccattattgtgagcagcaaagcacttttctagtggtctgtttgtaagcctttcacttgtttgttccccacccccaaacctttgctgttaataaagtcaacttctct

SEQ ID NO: 23445 - DNA, 107 bp, Homo sapiens
  misc_feature 2, 11, 30, 34, 38, 42, 46, 51, 61, 62, 67, 71, 76, 85, 91: n = A,T,C or G
gnacagtaagntgaaacgagagaagaaagngacntttngganacgnagaanatgaagaagnnatatnccangggtncatatgagnagattnaggcaagataacgctt

SEQ ID NO: 23446 - DNA, 205 bp, Homo sapiens
  misc_feature 6, 10, 27, 35, 39, 40, 43, 53, 56, 58, 87, 134, 145: n = A,T,C or G
aggagncatntaaactggagtgatggnagcagaancagnnttnagcgagtcgntcnanatgaagccctttgctctggaggaagttcnccagcttcagctcaactcacagcttctccaagcatcaccctgggagnttcctgagggntttctcataaatgagggctgcacattgcctgttctgcttcgaagtattcaataccgctca

SEQ ID NO: 23447 - DNA, 400 bp, Homo sapiens
  misc_feature 3, 5, 45, 55, 80, 103, 106, 258, 348, 383: n = A,T,C or G
aanangaataagtgccaatcctttgaatggtccacggaaacactnttggacagantctagagctgagaagaaacacgttnggtttggagagtccatggatggnggntttcagtttagctacggcaatcctgaacttcctgaagatgtccttgatgtgcagctggcattccttcgacttccctccagccgagcttcccagaacatcacatatcactgcaaaaatagcattgcatacatggatcaggccagtggaaatgnaaagaaggccttgaagctgatggggcaaatgaaggtgaattcaaggctgaaggaaatagcaaattcacctacacagtcttggaggatggntgaccgaaacacactggggaatggagcaaaacagnctttgaatatcgaacac

SEQ ID NO: 23448 - DNA, 400 bp, Homo sapiens
  misc_feature 10, 19, 40, 41, 45, 55, 91, 121, 198, 233, 252, 271, 363,372, 373: n = A,T,C or G
caggcagcgnaggggcttntgctgagggggcaggcggagnncttnggaaaccgcngacaagatgttttctctttgaaagatagagattaanacaactacttaaaaaatatagtcaataggntactaagatattgcttagcgttaagtttttaacgtaattttaatagcttaagattttaagagaaaatatgaagactnagaagagtagcatgaggaaggaaaagataaaaggntctaaaacatgacggaggntgagatgaagcttcttcanggaggaaaaaatgtatttaaaagaaaattgagagaaaggactacagagccccgaattaataccaatagaaggcaatgcttttagattaaaangaaggggcnnaaacagcttaaaggttaggttaaaagg

SEQ ID NO: 23449 - DNA, 400 bp, Homo sapiens
  misc_feature 9, 11, 48, 49, 62: n = A,T,C or G
cacacaggntnctaacctcatgaacttaccatgtaacatgggaagacnngcactaagttctnatttgtttgtaattgtgataaggctcagagaacaaatacagattcctatgaacccatgtatagggggaaatatttaggttccatttaatactgacatggctaagtatctcagtatttaagctgagatctgaaggataattagaagattcctcaggcagagggaagagcaaaggctgtgtgtggggcaggaagaaatgtggtcgtttgaggaacttcgagatcagcgtgccactgatgtgctgcagtgtagcaaagagagcaaaagaaagagagaaacagggaggaatggaattcagctcacgggctctggaatcagagtttcaagttggaatcctgac

SEQ ID NO: 23450 - DNA, 100 bp, Homo sapiens
  misc_feature 4, 18, 27, 57, 60, 61, 65, 71, 81, 85, 96: n = A,T,C or G
tacnaaaagcagaaccgngccaggcanggcctgccaacaaaagaaaggggaaagccnaannggcngagggncgactacaanaacnggaaagactgngaag

SEQ ID NO: 23451 - DNA, 400 bp, Homo sapiens
  misc_feature 12, 17, 43, 58, 59, 60, 62, 93, 95, 389: n = A,T,C or G
attataaaaatnagctnattttctgagaacactttcaagtctnccttgcccctctagnnnanatggatttaccattttccccatatctctggngngattcccagagagtctgttttttgtacctctatgtaataggttattagcaaatattttctaaattgagtatctgccactaacaacaggccagcataaattatagaaattagtataatataatctaattttactttgtagtcaaataattaaaactaataaaagaagaggagttattaaacagataagtcagggaaaattaatcctgttacatatgtccacttagtaagtacattttaaaatcaattttattgaggcataatttacatacaatgaaatgtacccattttaagtgnaatctgatgat

SEQ ID NO: 23452 - DNA, 267 bp, Homo sapiens
  misc_feature 41, 45, 46, 47: n = A,T,C or G
cttataacaacaatatctctgtagttggatcaagtgacttntgcnnncctggacacaacaccaaaaaggcttcttattcgggtgtgagtcttttcagcaacccggtccagtactgggagatacagccatccaccttcagatgtgtctacgtgcgctctgcattcaactcggaaactataagtaattctcaagaaagccctcatttttataacctggcaaaatcttgttaatgtcattgctaaaaaataaataaaagctagatactgg

SEQ ID NO: 23453 - DNA, 400 bp, Homo sapiens
  misc_feature 46: n = A,T,C or G
ctttccaacttaaactgaaaaaaaaataaaaaggaagaggaatatntttgaaggatgctcaggagaaaaaggaactctgagttctatgagtacttagaaatgaagtaacgaagatctgcttcttctcagacattcattttctcttacccttcattggttttatttggttaggccagattgcttctagtctacttctttcctactccaaaacccaaaaccccaaactcctttactacaagatccaaaaaggtaaacatcctagatataactcttattggccaggtttggataacataccaacctctagaccaatcagtataagagattgggaattgtgattgaccaatcttcagtgacatgaccacagagaggcaaggtgaagattttggcagcccacaca

SEQ ID NO: 23454 - DNA, 393 bp, Homo sapiens
  misc_feature 21, 22, 37, 38, 43, 44: n = A,T,C or G
tgtattagcaaacgctgacgnngaagctacagcaatnnatgcnnaagatgcaagggaaacaggtgaagatggctggctattctgcacaaaagactttattagataagagagtcttctatcagaagaagatgacatctaagactgtcatagctaaagaggagaagtcaatgcctggcttcaaagcttcaaggcacaggttgacttttgttaggtgttaatgcagctggttaccttaagtgaatgctgtctcaaatcctaggtcccttaagaatgatgctaaatctactcggctgtgctctagaaatggaaaaccacagcccagatgacagcatatctgtttacagcatgatttattgaacattttaagcccactgttgagacttagtgctcaga

SEQ ID NO: 23455 - DNA, 290 bp, Homo sapiens
  misc_feature 3, 12, 31, 43, 45, 47, 59, 96, 99: n = A,T,C or G
agntcagaagtntgagaccagcctggccaanaaggagaaaccncntntctactaagaanacaaaaattagccggaaatcacttgaacccaggaggnggnggtgcagtgagctgagattgtgccactgcactccagcaacagagcgagactgtctcaaaaaaaagaaaaattaatggtggatgcagtgctcacacctgtaattccagcactttgataggatgaggtgggcagatcacttgagctcaggagtttgagaccagtctggacaacatagtgagacctcgctctac

SEQ ID NO: 23456 - DNA, 120 bp, Homo sapiens
  misc_feature 43, 45, 48, 58, 65, 83, 109: n = A,T,C or G
agaagcagaagaaaacgtacctgccatccagtttaggatcttntnatnactaatgagnaggaacntgagatctgtataaatangagcatgatttgaaaaaaagcatggnataattgaaac

SEQ ID NO: 23457 - DNA, 345 bp, Homo sapiens
  misc_feature 2, 25, 31, 37, 38, 42, 43, 48: n = A,T,C or G
anactcgtatgctgatttttctggncgccantgaagnnattnngtttngcaggaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggtcagtgcatgcttagttggcagttaccaccctgtgctagcatatttcttttgctagctatccatcatgtaaccctcatgaaaattatctttatacgtggactataataaaatattg

SEQ ID NO: 23458 - DNA, 316 bp, Homo sapiens
  misc_feature 16, 21, 39, 44, 45, 49, 52, 54, 56, 62, 66, 85, 102, 183: n = A,T,C or G
caagcgaggaaggtanaaaangactggtgagagcagagnggggnntttncgnangngatcgnaacnctttgggggggccgaggtnggcagatcacctgaggncaggagtttgagaccagcccggcaacatggtgaaaccccatctctactaaaacaatacaaaaattagctggacgtggtggngggcacttgtaatcctagctactcaggacggtaaggcaggagaatcgcttgaacccgggaggcggaagctgcagtgagcctagattgtgccactgcattccaggctgtgtgacaagagcaagactctatctcg

SEQ ID NO: 23459 - DNA, 366 bp, Homo sapiens
  misc_feature 4, 19, 37, 38, 43, 44, 46, 48, 53, 57, 83, 84, 123, 144,240, 249, 366: n = A,T,C or G
cggncgaagtggcccggtntgaggtggtcggacggannctcgnntntnccggngccncaagcggagagaccattcctcaaganntttgtatccaaggcccaaaagtttgttacccaagatgangaatgctgacatggatgcagntgatgctgaaaatcaagtggaactggaggaaaaaacaagacttattaatcaagtggtggaactccaacacacacttgaagatctctctgcaagagnagatgcagntaaggaagaaaatctgaagctaaaatcagaaaaccaaggtcttggcaatatataagaaaatctcatggcaagcttctaggggttttcaaacaactgacacaaaaagcaaaagaaagn

SEQ ID NO: 23460 - DNA, 322 bp, Homo sapiens
  misc_feature 93, 135, 204, 232, 255, 287, 290, 293: n = A,T,C or G
tacagagccccgaattaataccaatagaagggcaatgcttttagattaaaatgaaggtgacttaaacagcttaaagtttagtttaaaagttgnaggtgattaaaataatttgaaggcgatcttttaaaaagagantaaaccgaaggggattaaaagaccttgaaatccatgacgcagggagaattgcgcatttaaagcctagtnaacgcatttactaaacgcagacgaaaanggaaagattaattgggagggggnaggatgaaacaatttgggggaagatagaagtnggnagnggaaaactggaagacagaagtccgggagg

SEQ ID NO: 23461 - DNA, 400 bp, Homo sapiens
  misc_feature 5, 17, 29, 32, 36, 37, 38, 40, 41, 46, 49, 56, 58: n = A,T,C or G
gtacngctgctacacangaccctgagacnganctgnnntnngaaancangaagagncngatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgctataatcgctacttcaggaagcgccgagggaccaaatgagactgagggaagaaaaaaaatctctttttttctggaggctgg

SEQ ID NO: 23462 - DNA, 180 bp, Homo sapiens
  misc_feature 2, 6, 28, 37, 43, 72: n = A,T,C or G
gnagancttatccaaagtctggtacaantgtgctttnactgangagcaaaggaggagtcaactaatgaaganatgaataataaattttgacactgaaaaacattttattaataaagaatattgacatgagtataccagtttatatataaaaatgtttttaaacttgacaatcattacact

SEQ ID NO: 23463 - DNA, 400 bp, Homo sapiens
  misc_feature 2, 4, 52: n = A,T,C or G
gntnagcgttaagtttttaacgtaattgtaatagcttaagattttaagaganaacatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggggattaaaagaccttgaaatccatgacgcagggagaattgcgcatttaaagcctagttaacgcatttactaaac

SEQ ID NO: 23464 - DNA, 398 bp, Homo sapiens
  misc_feature 20, 37, 44, 48, 54: n = A,T,C or G
caaatgaggctggacaaccntgactaccagcaggacntagtttncttnggaagncaagccaaaaggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcag

SEQ ID NO: 23465 - DNA, 400 bp, Homo sapiens
  misc_feature 2, 38, 43, 45, 47, 95, 384: n = A,T,C or G
gnaataaataaagtggacattttaaaaaacagactagnttctngntngaaaacatgtttatgtacgtgttgtgaacatatatatgattgtgtttnaaaacagatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtggtatgcccaacaacatggaaaaaatttttgagctgattttttaaaaatttaagttttgtaagagctttaaaatattttcacagataaaaaattgcaaacaagtactctggntaataaatgctgcttc

SEQ ID NO: 23466 - DNA, 321 bp, Homo sapiens
  misc_feature 4, 5, 44: n = A,T,C or G
aacnnaggacatgcatagttctagtgcagctgaaattgaaaagntatttccctttagctgtgttattatagagcagaaattctgtttttaaaaattagcctaagatatacttgtttttgtaaagaaaaatatttaatgttgaacaaaataaattggagttggagtagaatgtagtttgaggaaagttgcagcttccaatgcctcttgtcttcctatttcaagaagtttaaatattaagcatgacagaaaatatgtattaacactactcaaagcaaaagtgctgcaggctttaaaattctcttccaaccatttatcttgaag

SEQ ID NO: 23467 - DNA, 305 bp, Homo sapiens
  misc_feature 2, 15, 30, 31, 35, 36, 43, 48, 53, 55, 100, 102: n = A,T,C or G
anagggaggccgagnacttaccattcacanngcannaaggaanatttngcganangaaaaacagacacagactgtatatctgcattcaaatgtcagccgntngtaaaatgctgtatcctaggaataagctgccctggtaaccagtctctagctagtgcctcttgccctctcctcacctcctcttctctcagtgactctggaacctgaatgcagcttacaagacaagcctgacttttttctctgattaccttggcctcctcttggaaccagtgctgaaaggttttgaatcctttacccaacaatgc

SEQ ID NO: 23468 - DNA, 400 bp, Homo sapiens
  misc_feature 6, 42, 43, 45, 46, 49, 50, 51, 370, 399: n = A,T,C or G
caaatntacccaacaatcttgtgaagttgataattaatatcnntnntgnnntaaaggtagagaactgaagttcagatatattgaaactttcttaggacatgtagcaagtaaacagtggagcccaggtcccctgactccatatcttacattcttttactaataacatgtcatgctgagattcagaaggcccatgcttataatttaaaaatgagactatttcagtatttctttgtgtttgttttctactattcctttctgagctatgttttagagaaaacaatttgatatgcttcaattttgtaaaatcaaattacatatatataaaaaaacctatctgtattagacaaaaactgtttttatttatttctgnaagatatccattaaataaatattttaggng

SEQ ID NO: 23469 - DNA, 313 bp, Homo sapiens
  misc_feature 11, 16, 26, 29, 30, 32, 36, 37, 100, 107, 275: n = A,T,C or G
gatacagttgncctgngcacactatngcnntnactnngttgtagcaaagattctgcactggaacgtagacagttggaaacagtactacctacctagaggntatgtgntttctctttctccccgctttcacctctttctttcccaattcaaaacagccaagtgagccctgttctggtattttgaatcattagagaaaagaaagggagtggctgttttgagttgcctttctttgcaggaaaggagaaaatgtgattgtgttttttttttaccagccnacttctaagggcactgcctggtttttctctttttcaag

SEQ ID NO: 23470 - DNA, 400 bp, Homo sapiens
  misc_feature 3, 6, 284: n = A,T,C or G
acnttngagagcagtttcttttcacattaggctgttggtcaaacttttgggagcacggactgcagttctctgggaagtggcagcgcatcctgcagggcttctcctcctctgcttttggagaaccagggctcttctcaggggctctagggactgcaggctgtttcagcaggaagccaaaatcaagagtgagatgtagaaagttgtaaaatagaaaaagtggagttggtgaatcggttgttctttcctcacatttggatgattgcataaggttttagcatgtcctncttttcttcaccctccccttttttcttctattaatcaagagaaacttcaaagtaatgggatggtcggatctcacagggctgagaactcggtcacctccaagcatttcatgaaaaag

SEQ ID NO: 23471 - DNA, 390 bp, Homo sapiens
  misc_feature 18, 37, 38, 53, 113, 340, 347: n = A,T,C or G
aaaatatagaaaaacttngatgggcacaatgagatanntattagaatattacnattccaatgattaaatgaggatcttgaaataaattctgaagtcttccaatttttacattnattggaggggtccctgagttctgtcaacttttttatttaagtctcttgctcttattttgtgcataaatgttaaaccttccaaaaatgaaatgttagctttctttcttttactttttattaaatttaatagaaaatatgacctgagtagttaaaaagtattttgcattatttgcaggaagatgctctagcactgctcaaagggcaaattttaaaacttcaggctgggngaaaganttgctaggtttacagaaaggattgctatctttaactcaagctg

SEQ ID NO: 23472 - DNA, 286 bp, Homo sapiens
  misc_feature 3, 15, 48, 58, 83: n = A,T,C or G
ganttgaaactatantacaaggctacagtaaccaaaacagcatgtttntggtaccaanacagagatatagaccaatggaacanaatagagccctcagaaataatgccgcatatctacaactatctgatctttggcaaacctgacaaaaacaagaaatggggaaaggattcccttgttaataaatggtgctgggaaaactggccagccatatgtagaaagctgaaactggatcccttccttacatcttatacaaaaattaattcaagatggattaaagacttaaatg

SEQ ID NO: 23473 - DNA, 203 bp, Homo sapiens
  misc_feature 2, 7, 30, 52: n = A,T,C or G
anagaanctaccatggctcccgaagttttngccaaaacctcggatgcggggncttctggccaggcgctgcgaaatcatatggctgtagcattcgtgctatccctgggggtgcagctttgtataagtttcgtgtggctgatcaaagaaagaaggcatacgcagatttctacagaaactatgatgcatgaaagattttgaggaga

SEQ ID NO: 23474 - DNA, 345 bp, Homo sapiens
  misc_feature 4, 13: n = A,T,C or G
tcangggagaaanactcgttgccctcaacctagacaggatccgtcattggattggctgcggggccacctctctaagcctatggaaaagcttctgggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgagctgactttagtgagcatagcagtgggaacaaggcaaggtccttttgaaacactgcagcgatcttaattttggtaagatttggagttcaataaatggagtatcctg

SEQ ID NO: 23475 - DNA, 147 bp, Homo sapiens
  misc_feature 3, 5, 30, 33, 38, 44, 54, 56, 61, 62, 64, 68, 75, 83, 100,109, 115, 131: n = A,T,C or G
agnangaagaattgatggaggcatgttggngtngcaantgcggntacataaacngnggctnncntagntacattnaaacaaangtagaaaaacaagggcntagtctgcngactcnaagaagtacactgagntaacattttgagatga

SEQ ID NO: 23476 - DNA, 373 bp, Homo sapiens
  misc_feature 10, 35, 39, 42, 45, 48, 49, 92: n = A,T,C or G
atagaaagtntttggtaaatgaatggaatttatanaatnagnttncannatgttgagaatatacttgcagaattatcattcttaatgctctncatgaaattgtattgctggctggcatgtggctcacacctgtaatcccagcaatttgggaggcctagtcctgcggatcacttgaggtcaggagttcaagaccaacctggcaacatggtgaaaccccgtctctactgaaaatacaagaattagtgggtatggtgatgcgcatctatggtcccagtttctccggagcttgaggcaagagaatcgcttgaacctgggaggcggagtttgcagtgagccgagatgcagctggggcgacagagtgagtgggaatcca

SEQ ID NO: 23477 - DNA, 399 bp, Homo sapiens
  misc_feature 2, 52: n = A,T,C or G
gnatgaggaaggaaaagataaaagggttctaaaacatgacggattttgagangaagctcctacatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggggattaaaagaccttgaaatccatgacgcagggagaattgcgtcatttaaagcctagttaacgcatttactaaacgcagaccgaaaatggaaagattaattgggagtggaaggatgaaacaattcggagaggatagaagtttgaagg

SEQ ID NO: 23478 - DNA, 250 bp, Homo sapiens
  misc_feature 11, 112: n = A,T,C or G
acacgcacaantttcacttggtttctgtagtgagtcaaaaatagctctttagaaattcacttaggattattaagttgtccatttttcagtaaattctgttaatatagtttgnttctatagtaatgataattgagaatatcttcttttgaatattatgagttacagatattagattccttttaaatattactgtttagaatggtaactatataatacattttgttttggggacttggaatcagtcggcaga

SEQ ID NO: 23479 - DNA, 171 bp, Homo sapiens
  misc_feature 5, 29, 37, 41, 55, 102, 106, 112: n = A,T,C or G
aaacngcggaaaaagatgtttttttcttngaaggttngagntaaaacaactactnaaaaaatatagtcaaaagggtactaagaaattgctgagcggtaaggntttnaacggnaattttaataggcttaagatttaagagaaactatgaagacttagaagagtagcatgagg

SEQ ID NO: 23480 - DNA, 251 bp, Homo sapiens
  misc_feature 7, 24, 26, 38, 84, 196: n = A,T,C or G
atgaatnacatgaaagcatggaancntatgaacttaancccttcattaacaggagaaatgcaaatacctttatatcccctcagnaagagatggagagctaaagcccaagagaggatccgagaacgctctaagcctgccacgagctcaatagggaagcctgtgatgactacagactttgcgaacgctacgccatggntatggatacaatgctgctataatcgctacttcaggaagcgccgagggaccaaatg

SEQ ID NO: 23481 - DNA, 357 bp, Homo sapiens
  misc_feature 9, 17, 229, 342: n = A,T,C or G
aagacaagnaaaacacnaactacatgttagaatgaataatttaaaggacatgctactgtttcagcataaaaaatggtaaagtctttataaatagaatacttatgatagccattaacgtattgaattgtttaattaacctagttgtgattttccgaatttaagacgttttcttactacatgtgttaaattgttacctataatatcttcctggaaaaatagaagtatttgnaaggttttataaatgcacaatttatgtataaatataattggaatctgggatgactcttagtaatctactattcttaattcaacgatggccaccagctacctgacacattttgnaaatttaagcatctg

SEQ ID NO: 23482 - DNA, 388 bp, Homo sapiens
  misc_feature 5, 11, 27, 28, 29, 37, 41, 54, 60, 121, 210, 254, 327, 367: n = A,T,C or G
aatgngagagntataaaatcttactannntttatganaccncatttctaaatcnttgaanaaggatctcagttaagagctatcaaaattctattaaaaatgctgttctggctgggcacagnggctcacgcctgtaatcccaccactttgggagaccgaggcaggtggatcacggaggtcaagaggttgagaccatcctggccaacatggngaaaccccgctctactaaaaatacaaaaattagctggatgtggnggcacacacctgtagtcccagctagtcaagaggcttgaggcagagaatcggcttgaacctgggaggtggaggntgcattgagccaagatcacgccactgcattccagcctggngacagagcgagactcagtctc

SEQ ID NO: 23483 - DNA, 174 bp, Homo sapiens
  misc_feature 5, 16, 32, 36, 44: n = A,T,C or G
aaggnaaagagtatanagggggattttcaccngagncaaaaaanaaattagaaaaaggccaggcatggtaggctcatgcctgtgattgcagcgctttggaaagccaaggtaggaggatcactttgtgcccaggggtttgagaccagcctgggcaacatagcaaaaccctgtctc

SEQ ID NO: 23484 - DNA, 162 bp, Homo sapiens
  misc_feature 4, 160: n = A,T,C or G
cgcngacaagatgttttctctttgaaagatagagattaatacaactacttaaaaaatatagtcaaatagggtactaagatattgcttagcgttaagtttttaacgtaattttaatagcttaagattttaagagaaaatatgaagacttagaagagtagcntg

SEQ ID NO: 23485 - DNA, 199 bp, Homo sapiens
  misc_feature 19, 32, 36, 38, 45, 48: n = A,T,C or G
gaaagatggagataaacanctacttaaaaaantagncntttggtnacnaagaaatagcttagcgttaagtttttaacgtaattttaatagcttaagattttaagagaaaatatgaagacttagaagagtagcatgaggaaggaaaggataaaaggtttctaaaacatgacggaggttgagatgaagcttcttcatgggg

SEQ ID NO: 23486 - DNA, 306 bp, Homo sapiens
  misc_feature 26, 36, 55, 281: n = A,T,C or G
caattgaaggatggattaaagacttngaacgtaganacctataaccttttcaagnctagaagaaaacgtaggcaataccattcaggacgtaggcatgggcaaagacttcatatctaaaacaccagaagcaatggcagcaaaagccaaaattgacacatgggatctaattaaactaaagagtttctgcacagcaaaaggcactatcatcagagtgaacaggcagcctacagaatgggagaaaattcttgcaatctatctgacaaagagctaatatccagaanctacaaagaacttaaatttacaaga

SEQ ID NO: 23487 - DNA, 114 bp, Homo sapiens
  misc_feature 2, 36, 37, 44, 52, 53, 62, 111: n = A,T,C or G
cnactgaggaggctgaggagggaggattgcatgagnnatgggangtgaaggnngcagcgagnaaagatcacaccactgcagtcaagcctgggtgacagggcaagaccctanatt

SEQ ID NO: 23488 - DNA, 197 bp, Homo sapiens
  misc_feature 6, 34, 40, 45, 56, 61, 68, 74, 89, 95, 115, 131, 153, 158,180: n = A,T,C or G
gttggnggaaataaccagctctataaggcacccncggagnagcanggacctctgantagcntgggttntgcagnctcattgccacatgnatatgnggagccaatggccatttggngctcagctgtttacgnctgactccttgacttctttggnacagngatggagcagatctcattaagngtgattctccatgatat

SEQ ID NO: 23489 - DNA, 277 bp, Homo sapiens
  misc_feature 5, 20, 27, 44, 47, 92, 116, 117, 125, 209, 265: n = A,T,C or G
tgatnagcaaaacgaggacnagggaanaaaaagagcactcactnagngcagcaatagtattaccagcaagaataaaaaagaaatccatatcntaaagaaacagctttcaagtgccnntctgcagnttttcaggagcgcaagatagatttggaataggaataagctctagttcttaacaaccgacactcctacaagatttagaaaaaagnttacaacataatctagtttacggaaaaatcttgtgctagaatactttttaaaaggnattttgaatact

SEQ ID NO: 23490 - DNA, 400 bp, Homo sapiens
  misc_feature 6, 17, 51, 60, 61, 71, 100, 101, 112, 152, 162, 211, 248,264, 398: n = A,T,C or G
aagtgncccaagatgcntctgtcttaactgtggtgggagagtaactacaantcttgtccnntcggggaagnagtagctttggatttgttgtgcaacttgnngctacagctgnggagcagtatgttccctctgagaagctgagtatctatggngacttggagnttatgaatgaacaaaagctaaacagatatccagcttcttctcttgtggntgtagatctaaaactgaagatcatgaagaagcagggnctctacctacaaaagngaatcttgctcattctgaaatttaagcatttttctttaaaagacaagtgtaataagacatctaaaattccactcctcataggagcttttaaaatggttcattgggatatagggcttaagaaatcactataaaangc

SEQ ID NO: 23491 - DNA, 209 bp, Homo sapiens
  misc_feature 4, 18, 83, 163, 170: n = A,T,C or G
aagntgacagcattcggnccgagatgtctcgctccgtggccttagcttgtgctcgcgctactctctctttctggcctggaggntatccagcggactccaaagattcagggttactcacgtcatccagcagagaatggaaagcaaatttcctgaattactatgngctgggnttcatccatccgacattgaagttgacttactgaagaatg

SEQ ID NO: 23492 - DNA, 400 bp, Homo sapiens
  misc_feature 13, 18, 27, 33, 74, 78, 107, 122, 125, 159, 199, 204, 271,293, 303, 304, 328, 360, 368, 379: n = A,T,C or G
tgagggtctttgngagcncccactgcngtgggngactcacttctgaggggctttgggaagtcccaccaactttnaggnattcatgcccttgaccatggggggtgctnggagacccgggggcntcngcagactgaagaagacacatttctaggaatattnggcccttttatcctctcaaaaaattaaacactggacctcntcagngggcagaagaaaggtggaaacttttcctacatattaggcggtaggatgaaggacatttggttgaaanataagaaaattgccccgagccngaaccggggnnggggtaacaccattgggaggagcnatgaatcccttcccaggtccaagagaaacganccggaagnccctatggcancacattgcctggggaggacat

SEQ ID NO: 23493 - DNA, 191 bp, Homo sapiens
  misc_feature 4, 20, 48: n = A,T,C or G
ctcnaaacgctttgaaccanagcatggcctattccactggctccctgnaagagatcaagccatcggagctgctagagttctgtctggactttccagagaccagtattcccttttgctgctctaaaaggcctgtcctgcagacatgagagacagcaggtctcatgggggtgacaagctttttttttttctta

SEQ ID NO: 23494 - DNA, 127 bp, Homo sapiens
  misc_feature 6, 7, 43: n = A,T,C or G
gttgannttgcgggccgtgcttgaccatcttgtttagaggtgnttcccttgagataaggagtaagccaacgggcgatatgtattagaaaacacacacacacacacacacacacacacacacacacac

SEQ ID NO: 23495 - DNA, 396 bp, Homo sapiens
  misc_feature 56, 90, 91, 384, 393: n = A,T,C or G
atggacaccgtatattctgctgccacaaagactgtaaagtgcttcatttcaacagntgaggcaagccaagtgatcattaataaagctttnnttggttccttcagtggtgttggaagtaaaatggaaggtgcttgctgcaggtaactaatgaagaagtggcaaccacagagtcttcaagaaataagaaattctgtaccatctgaaagtagttcttgttggtgccttcatttaaaaagcactctttaaaataaaagggaaatgttttctgataaaacaaacatttagttgaggtcttggatataaaacaattacaaaatgagtgttggttgtaaacagtaccatcaaattgctagagagataaatgtatcatgttttaaattaggntttgggagnagg

SEQ ID NO: 23496 - DNA, 123 bp, Homo sapiens
  misc_feature 3, 14, 72: n = A,T,C or G
canctacggcaatnctgaactttctggaagatgtccttgatgtgcaagctggcattccttcgacttctctgnagccgagcttcccagaacatcacatatcactgcaaaaatagcattgcatac

SEQ ID NO: 23497 - DNA, 346 bp, Homo sapiens
  misc_feature 4, 15, 30, 37, 41, 49, 69, 87, 96, 107, 123, 154, 159, 191,222, 267, 272, 285, 308, 321, 338: n = A,T,C or G
tggnaaaagaatatntggacatatgtgctnttaacanttcngccatatngactctacaattttgaatgngggggaaaattaatatangttaaatanttatgtttagngaaagtggtcataatngagaaaaggaacatatgcattttagctttgnatctngcaagttttgcaggcaagaaaatttttggacnagcttttgcttttgataacacttcgggttgnaaccacattcatatatatatacatatatatgggaagccccatatntctgngctttaaagaagnaaaaccctccatttaaataagangcatgcataaganaacaaagcctccttgantccctttc

SEQ ID NO: 23498 - DNA, 165 bp, Homo sapiens
  misc_feature 10, 58, 91, 92, 93: n = A,T,C or G
aaaggggccncaagagttcactgtacaaatttgacaactgtcaccaaaattcataatnaacaatagtactgtgcctctttcttctcaaacnnngggatgacacaaaactatgagagtgacaaaatgggacaggtagctgggacctaggctatcttaccatgaagg

SEQ ID NO: 23499 - DNA, 245 bp, Homo sapiens
  misc_feature 7, 14, 50, 86, 144: n = A,T,C or G
cccatcnagcgaanagatctggcagctatatgaaggctaggtgggaactngcaaggctggctgcaggaagacacatcgatgggggntttcaatctagacagggcctcgccagggctgcagtaatcttcatggaaagcaggctgngcatgaaatgatggtgatcatatgagcaaggcttcacagtgaatcagtttgggaatcttgggaacagggacttactgagtcagaaaatgcatcatgcaatg

SEQ ID NO: 23500 - DNA, 398 bp, Homo sapiens
  misc_feature 3, 4, 55, 140, 284, 303, 380, 394: n = A,T,C or G
agnnacccctaggcagtaggtctctgccctgcccttgagtcaggaataacacacnctcccgctgggacacaggacagctatcagggggagccacacactgtgggtggccccggcagaatctgcaaaaaggacattctggngagaaaggaactcaagtttcctgcatttgagcaaggcaagctgcctgtgcaaaccggtggccctagatttccagaaggcaaaactatcttcaagcattgcacactcactgaacttgcactgcccatttacctgagactatcctncaaggagaatgggtgctgnatgaagggccttacgaatctgcaaggctcatcttctgggctgactctcagacacaagcctgcctggctatttgtggnaaggcccgcaacangcag

SEQ ID NO: 23501 - DNA, 396 bp, Homo sapiens
  misc_feature 39, 54, 86, 108, 376: n = A,T,C or G
aaaagtcctagataaggcggagatggtgagaagccgggntttctctatgctaantgtgctactaagagcagcacttctactagctnggcacaatcatagccccaccgngatgagctgctagtctgaataacattccctgacttagggaaaggcacacaaaaacatataaagaatatgctattttcatatgtgtgatactgcagagccatggtattcctaaaatatagggttctcttttttcttggattcttagcaaattgcatttattcactacattacaaaccatcactgatgtatccaaaatagcacacatagtcagtatgaaaataagagaataaaatctgtataagcaagtgattaaggatttcttttgggntatgcattatctgactatat

SEQ ID NO: 23502 - DNA, 216 bp, Homo sapiens
  misc_feature 2, 6, 87, 156, 173: n = A,T,C or G
antagnccatagagtaccttcccacacttaagacaccagaatgtaaagagtgaagattcttaagtacctgaaggcataatacaggantatggagtaaacttaaaatatgaccacttccttacctctactaatatagagggtttaggtatattttgnaccaaaagataatcttntaactcaattagcccaatataagaaaagcaagctgcaataaat

SEQ ID NO: 23503 - DNA, 293 bp, Homo sapiens
  misc_feature 6, 11, 28, 47, 53, 76, 79, 263: n = A,T,C or G
tgcggnccgcngattccgcaaacagaancgcgataggctgttcttgnatgtgngaacctattgggtactgtacaanggnaagccttcgaaatcaagataggcccaccaacctcatttcctgtttcaccttgattttctgtgataccaaaatctcagcttcacaaagcattgaaagtgttggtcatgaagttttgccatcaattcaagtaatcataaatggcaaattctgcaaaagcagaagaatatgaaaaggatgctcttgnacaggcaaaagccgcagtgaattctgaaac

SEQ ID NO: 23504 - DNA, 149 bp, Homo sapiens
  misc_feature 4, 18, 87: n = A,T,C or G
actncctgaaaagcgagngggtggaaagagagagcttaagtacaagtgtttctctttcaaataccatatgaacagaacagtaactgnagaaaaaagaaatgggaaaaggaaacataataatcccatcaggctaacagggacagcatata

SEQ ID NO: 23505 - DNA, 109 bp, Homo sapiens
  misc_feature 1, 36, 53, 57, 58, 91: n = A,T,C or G
naggagaccgaggcatgagaatcacttgaacctggnaggcagaggttgcaagngagnngagattgccccactatactcctgcctaaatganagactgagactctatcgc

SEQ ID NO: 23506 - DNA, 345 bp, Homo sapiens
  misc_feature 6, 12, 84: n = A,T,C or G
ccgtgnttgttntagatgaaatacatgagatatgtctttgggatccattcagacatgcaggtggacactgcagtaagtcatctnaaacaattctttcttctctctgaactagttcaatgtgaaaatatatagctttccatgccctgttaatgtcttaatgaaacctgcttccttaagagtgcctgcaccaagaatacagacatgattagtcctaaggtccactacaatccatagagcgcgtggcactaagagagaaatctcaatgccaggtaaatttctcaagttctctgaggaactaaggatatttacacttaaagagtatattccaaccacatttaaaaacac

SEQ ID NO: 23507 - DNA, 398 bp, Homo sapiens
  misc_feature 8, 10, 90, 91, 139, 386: n = A,T,C or G
aattgtancntagattgtattctacactcgtcttgacatgctacaaggctttgggttagtaaaaaatgtgctaatagttttaaaactatnntctgcttaaatgtaacaccttccagatctagcaaagcaaggattttgnttgctgtttagaattagtttaactaactgtctctcagaccacattgcaatcaaactagatctcaggattaagaaactcactcaaaactgctcaactacacggaaactaaacacctgctgctgaatgactactgggtacataacgaaatgaaggccgaaataaagatgtctttgaaaccaacgagaacagagacacaacatagcagaatctctgggcacatttaaagcagtgggatgtagagggaaanttatagcactta

SEQ ID NO: 23508 - DNA, 256 bp, Homo sapiens
  misc_feature 4, 65, 99, 100: n = A,T,C or G
aaanaactccctcgcttgagcacaagctgcacaagtgcttgtcaagaacggccagatctccagtncaagatgattccagcagtgggtcttgctcttacnncttttggttgaacaaagcagcggccctgggaagacctcagctctgctatatcctggatgccatcctgtttctgtatggaattgcctcaccctcctctactgcgactgaagatcaagtgcgaaaggcagctataaccagctatgagaaatcagatgg

SEQ ID NO: 23509 - DNA, 257 bp, Homo sapiens
  misc_feature 8, 13, 69: n = A,T,C or G
ggatactnccctnagtgaatgattagtagaacaagatcaaaatagaagaaaataagatatttaaaaganagtaatgaaataggaaacccaggggaatcaataaacccaaaagctgctctttaaaaaacttaataaaccttgggtaaatttgatcaagaaaaacaaaagcagaaaaaggcaaaataaggttaagggatggtaaaaagcagttgagaatgtgataaactaggaaaatttaagaaaaaatggataattag

SEQ ID NO: 23510 - DNA, 330 bp, Homo sapiens
  misc_feature 2, 7, 31, 37, 44, 49, 83, 145: n = A,T,C or G
anccggnagaagagattttatcttaggctcnatcttntgagtgnatttngcccactgaacccatccactgtctgagataatanggaagaataagggtaaagggatcactggtgtagcagacatggcttcagtgacagaacgaacnattctggtgctaatttagctgtagctgcttagtctgatactcatctactcccaacagagctctttatctctttttctctactatgggttggtcttcacactatagccagaaagctcttatattttaaatgaaatatagtagacactcaaaacatttatgaaaaaaagctacaactctgcttctgc

SEQ ID NO: 23511 - DNA, 347 bp, Homo sapiens
  misc_feature 9, 88, 90, 102, 105, 179, 338: n = A,T,C or G
aaagtaccnggcttatttgctcttgaggtagaagaacctctcagattcatttattctagtttggaagtattttaaagctttttttttngntcattctttcgntcncagatttttatattaaataaatggaaagttacagtttaattcaggcactatggttttcatgttgtgatgaagtncagccagaatttttggtgaagtggattggcagtgaggttaactgactccatggaaagattaactgcaaagtcctagttttctgatctttgctacaaacataaaacttctgaggttcagcaaaaagggctatatttctttgagaggacagagggcactgncattccatg

SEQ ID NO: 23512 - DNA, 115 bp, Homo sapiens
  misc_feature 11, 17, 34, 43, 62, 64, 67, 89: n = A,T,C or G
acccgtaactngaaganttgaatacagaagaacntggctaccngggggttaactgcagcggngncanatgaatttgatccgggcttttngggctaaacgagggcatccatcaagg

SEQ ID NO: 23513 - DNA, 332 bp, Homo sapiens
  misc_feature 15, 16, 61, 62, 63, 64, 69, 73, 78, 82, 83, 129, 260, 308: n = A,T,C or G
atgacatatgattgnntccgctccgctcatagctttttttggcgcgaaagatgccgggatnnnngtgangggngaccntgcnncgactgagtctcaggagaagaagccgctgaagccctgctgcgcttnccggagaccaagaaggcgcgcgatgcgttgtatcatcgagaaaggagaagaacactgtggacatctaattgaggcccacaaggaatgcatgagagccctaggaattaaaatatgaaatgggggtctgctgngtgaataaaataattcctgaagaatgaagaagattaatttttgggagntctttgacgaactttgatatgtgg

SEQ ID NO: 23514 - DNA, 261 bp, Homo sapiens
  misc_feature 8, 13, 16, 18, 26, 41, 43, 48, 51, 53, 73, 83, 90, 92, 98,136, 197, 255: n = A,T,C or G
agcagaanagtgnggngnaaccatangtaagaagcgagaancntaccntgncnagtgccaatcaggttgagcnagatagaaanatagaananctgtanagttgcccacagaaccctctaaatccccttgtaaattnaactgttaggccaaagaggaacagctctttggacactaggaaaaaaccttggagagagagnaaaaaatttaacacccatagtaggcctaaaagcagccaccaattaagaaagcgtcaantcaaca

SEQ ID NO: 23515 - DNA, 225 bp, Homo sapiens
  misc_feature 3, 6, 53, 86: n = A,T,C or G
canccnaggcagccagcgcaggggcttctgctgagggggcaggcgggagcttnaggaaaccgcagataagtttttttctctttganggatagagattaatacaactacttaaaaaaatatagtcaataggttactaagatattgctcagcgttaagtttttaacgtaattttaatagcttaagattttaagagaaaatatgaagacttagaagagtagcatgggg

SEQ ID NO: 23516 - DNA, 337 bp, Homo sapiens
  misc_feature 33, 88, 91, 300: n = A,T,C or G
aaatcacccgttagttcttggtaggaattcagntgggcaatgataacttttatgggcaaaaacattctattatagtgaacaaatgaanagnaacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactggtacagataaatggggcctttaaaaatatgaaaaacaaacttgngaaaatgtataaaagatgcatctggtggttcaaatgg

SEQ ID NO: 23517 - DNA, 260 bp, Homo sapiens
  misc_feature 15, 24, 37: n = A,T,C or G
ctccagacatgatgnaggagatgnattagaaagctcntgctgctatacgagagaatccagtctatgaaaagaagcccaagaaagaagttaaaaagaagaggtggaacccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcaactg

SEQ ID NO: 23518 - DNA, 198 bp, Homo sapiens
  misc_feature 2, 90, 91: n = A,T,C or G
gnattgtgccccttaataggaaatgcatcattggactgtttttgtaacatcctgtttattgcaaatagctagtatcgttcaaaaactgtnnaaaatacttttgtacatattagcaatgtctaatttgtatacacttcagttaaatttccctaaaacttgaaaggggaccttgtagaaattaaaatatatacttagtct

SEQ ID NO: 23519 - DNA, 396 bp, Homo sapiens
  misc_feature 30, 42, 43, 50, 58, 61, 70, 77, 344: n = A,T,C or G
tgggaaactctcccctgctgcacatgttanagtcccccgagnntctccgntccaaggngtntgaagctgnagcaganctacaggctcatcatgccaagaaagaagctgcccagaaggtgggccgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggcattttgtatcaaaaggcaattatgaagcacctagaatttttcaattatacgaatatgttctttgggtctgctgnggccagacagtgtaactttttttttattggggggtttgaatttttcccccag

SEQ ID NO: 23520 - DNA, 164 bp, Homo sapiens
  misc_feature 4, 6, 40, 45, 48, 74, 98: n = A,T,C or G
gaananacagttgaggaatctacagctgaaaaagatgaantgtanagnatactctcaccatttggatcctgtgnggagagggaatgagaaatttacancatttctttttgggagagacttgcgtggatgccccctaatccccttctcccctgcactgtaaaatg

SEQ ID NO: 23521 - DNA, 121 bp, Homo sapiens
  misc_feature 2, 7, 8, 13, 14, 15, 16, 20, 21, 22, 37, 38, 42, 57, 59,60, 80, 90, 91, 107: n = A,T,C or G
gngaagnngacannnngagnnnggggagacctgtgcnncacngcccgtatcggcagncnntaagccacatgaggataggnatattagtanntatattcactcttttngaagaaagatgatc

SEQ ID NO: 23522 - DNA, 311 bp, Homo sapiens
  misc_feature 5, 14, 40: n = A,T,C or G
tggtnacttgcatnactccatttggcagacagagcaaagncacaacgctttctctgctggattaaagacggcccacagaccagaacttccactatactacttaaaattacataggtggcttgtcaaattcaattgattagtattgtaaaaggaaaaagaagttccttcttacagcttggattcaacggtccaaaacaaaaatgcagctgccattaaagcacagatgaacaaacttctacactgatttttaaaatcaagaataagggcagcaaggttctggattcactgaatcaacagacacaaaaagctgg

SEQ ID NO: 23523 - DNA, 334 bp, Homo sapiens
  misc_feature 6, 9, 42, 56: n = A,T,C or G
aatttnccncggagacgacctacgcacacgagaacatgcctntcgcaaaggatctncttcatccctctccagaagaggagaagaggaaacacaagaagaaacgcctggtgcagagcccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacac

SEQ ID NO: 23524 - DNA, 317 bp, Homo sapiens
  misc_feature 2, 4, 35, 37, 58, 59, 62, 67, 72, 79, 99, 105, 120, 317: n = A,T,C or G
gntntttatagctgtatacattgaaaataactacngnagaagaaaatagataagctgnngcngaganggctntacgatngctggaaaaaaaacaaaagnccgacnttctatggccaaagntccttgttgacaagctgtgatgttctaatatgatttggggaatatgtcagtctacagaacctgcatcctgtaaaaacacctttggggtagacgataaaagcatttttaaggcaaatacttaccatgtgactttttattaccaaatgcatcagaggtggagctggtatgttggttcataggatggaaacattagaagn

SEQ ID NO: 23525 - DNA, 221 bp, Homo sapiens
  misc_feature 19, 21, 66, 70, 75, 92, 100: n = A,T,C or G
gattgactcctggaaacgngngcgcagtgagtctgccttccggaacataaagaccattgctgagangccnggcanatgagctcatcaatgcngccaaggnctcctcgaactcctatgccattaagaagaaggacgagctggagcgtgtggccaagtccaaccgctgattttcccagctgctgccaataaacctgtctgccctttggggcagtcccaggccg

SEQ ID NO: 23526 - DNA, 270 bp, Homo sapiens
  misc_feature 9, 36, 90: n = A,T,C or G
ataggaccngaagtttccttaacttggcaaaggatntgtgtaggagatgcatagttaatattgtacttaatgatgaaacgtgaaaagcantcctgttatattcaggagctagactctgactataaggatgtctgttatcacctttactattcaacattactctggacttcttgttacatataataagatgaaaagataacatgaatagtataaagtatcagaaaggaaaaatattaaactgtcatttacagacaatataaatgtcttttg

SEQ ID NO: 23527 - DNA, 352 bp, Homo sapiens
  misc_feature 2, 9: n = A,T,C or G
cnaagtgtnatcaagtaaaagaagactaacactggttgggcacaacctgtaatcccagcactttgagaggctgaggcaggaggattgcttgaacccaagagtccaagaccagcctgggcaacacagtgagaccctgtctctgccaaaaaaaatatatatatatattagccaagtatggtggcacccacctgtggtcccagctacttgggaggctgaggtaagaggaatcacttgagtctgggaggtggaggttgcagtgaattgcttgagcccaggagacggaggttgcagtgagctgtgatcgtgccactgcacttcagcccaggtgacagagtgagaccctgtctcaaac

SEQ ID NO: 23528 - DNA, 399 bp, Homo sapiens
  misc_feature 2, 96, 321, 386: n = A,T,C or G
gnggggaggcacccgaggcagccagcgcaggggcttctgctgagggggcaggcgggagcttgaggaaaccgcagataagtttttttctctttgaangatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgngagaaaggactacagagccccgaattaataccaatagaaggccatgctttagattaaatgaaggngacttaaacagct

SEQ ID NO: 23529 - DNA, 290 bp, Homo sapiens
  misc_feature 2, 7, 48, 53, 54, 89, 104, 111, 114, 288: n = A,T,C or G
anatganccaacgaagggatctgtattaattttaaacctccctttgantgggnnaacctgtctccgttttagtatgacattgttgccanggggtcattgcctgntgcgggngtnccatgaaacaaacaaatagaaaaaggcaccttctggcactttaagtctcactgccatctgactactacccttgtggccagaatgatgaaaagcagaagcttggagaaatcttcctatggttagattgggaaaaatgaagcatgatgatcacatgtactgggaagggcaggaganac

SEQ ID NO: 23530 - DNA, 262 bp, Homo sapiens
  misc_feature 4, 7, 52: n = A,T,C or G
gatnccnaggttaaaatacaagcttttgtaataattttacacatgcagaagnctgtttcatgctatacctctcagctgctctcctagcttagggaactaggaaaggacactgaggaaatggttgaggactcaggatgagaaagaatccagtatgtggagagtagaaaacagcatcctagacaaagtaagcagcatgtgtcaaagccgtgagcaaaatgagctggacctttttgaggaactaaaggaaaagtaatgtgatgtg

SEQ ID NO: 23531 - DNA, 282 bp, Homo sapiens
  misc_feature 11, 90: n = A,T,C or G
gaatatgaccngatattgtacagccattgacaagaataggctagccttccttagcttacatgaaaacagtctaatgttgttaaatgttanggggaaggcacagaacagtcaatatagtattattgtttttaactttattatgtgcttatgtatatgaaatgtactcataggaagaaatataaaaatatagcatagtataaatatttattatttctgagagtgagattggaaaagcttttgctttctaagttatacttttccaattttttaacaggaagcttg

SEQ ID NO: 23532 - DNA, 399 bp, Homo sapiens
  misc_feature 5, 78, 93, 165, 171, 175, 277, 305, 307, 359, 368: n = A,T,C or G
atttnaaagcttttctggtaattttagtgatcttatttgattagactttttcagaagtactaaataaggaattttaanggggtttttattaangcacagataaataaaagtacagtgaggtctatagccattttattaaaatagcttaaaagtttgtaaaaaaangaatcnttgngattacttaatatgttagttaagaacccgcaagcttatatttgctagacttacaaattattttaaatgcatttatcttttttgacactattcagtggaatgnggaagctagctaaatcttggtttctgantnaaagccttttaaatcttatcctgccccctaaaaacaaaaggtttgacacaanggggaaatntaagatggtaaccccggttttcagaagggca

SEQ ID NO: 23533 - DNA, 193 bp, Homo sapiens
  misc_feature 21, 73, 74, 174: n = A,T,C or G
tcaagtagagcaggaagaaangacataaaactttgtgcagaaatcaataaaattgaaaacatgaggtcaggcnngagaaagtcaataaacccaaaaggcaatgcctttaaaagatcaataaaatcgataaatccatagccaggctaaccaagtgaaaaagggagaagacacaanttataaatattgattccat

SEQ ID NO: 23534 - DNA, 388 bp, Homo sapiens
  misc_feature 7, 9, 350, 381: n = A,T,C or G
acagttncnattgtttacagaccatttaattaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtcaatctaaaagttatattggaaaacatggaaatattaaaattttacacttttactagctaaaacataatcacaaagctttatcgggtgnataaaaaaattaccatataatggccataggnggagatc

SEQ ID NO: 23535 - DNA, 396 bp, Homo sapiens
  misc_feature 243, 283, 286, 392: n = A,T,C or G
atatgacccaaacttgcttttaaggacaagtgtgaatgtgctttttaagcttaatttttgtcatgacaactaattttttttatctttggagaagtcagagttctttacaatcaacgtttattaactggagtacttagaataagctagtaattgaatttagttcaagggctaagcaacacatttttaaatccttatttattgtagagtattagtatactgcctacaaattatgtaaaatatggnttaatattagatgactttggattttgcaatgccttactgntgncattctagcataaatatccataacgaggtactcaagttgatctggaagctgagctgatcatacactgcctgaagcattcatgaaaagctgctttattgaataaagnctga

SEQ ID NO: 23536 - DNA, 397 bp, Homo sapiens
  misc_feature 11, 14, 90, 280, 372, 385: n = A,T,C or G
gaaagtgtccnatntgctacgattacgatctttgtgcatcttgttatgaaagtggtcaacaacaacaaggcatacaactgaccacccagngcagtgcatattaacaagggtagattttgatttatactatggtggggaagctttctctgtagagcagccacagtcttttacttgtccctattgtggaaaaatgggctatacggagacatctcttcaagaacatgttacttctgaacatgcagaaacatcaacagaagtgatttgtcaatatgtgcagcgntacctggaggcgatcctaatcatgtcacggatgactttgcagctcatcttacacttgaacacagagcccctagagatttagatgaatcgagnggggtcgacatgnacgtagaatgtt

SEQ ID NO: 23537 - DNA, 397 bp, Homo sapiens
  misc_feature 6, 9, 33, 44, 69, 75, 89, 230, 282, 353, 378: n = A,T,C or G
aattgnccnaactctacatctaacaagtgtatngatgccatttntccacagcatgtgctcactttgtgnctcatnttggtaattctcanaatatttcaaactttttcattatcattatatttgttacggtgttatgtgtgaccaatgatcttgttgttactatcataattgtgttagggtttcaaaaaccatgcctatataagattgtgaacttaagtgatagattgtgngttttctgactgctccaccaaccatccatttagccatttattatctctctgnctctcctcaaacctcctattctctgagacacaacaatattaaaattaggccagtaataatcctacaatggnctctacatgtcaagagtttcaatcnttttctttaaattaaaagc

SEQ ID NO: 23538 - DNA, 176 bp, Homo sapiens
  misc_feature 11, 19, 32, 34: n = A,T,C or G
gaaaccctgtntctacttnaaacacaagaatngnccagtcatggtggcgggggctgtcatcccagctattcgggaggctgaggcaggagaatcacttgagcccgggaggcggaggttgcagtgagccgagattactccactgcactccaacatgtgtgacaagtgcaagactctgt

SEQ ID NO: 23539 - DNA, 394 bp, Homo sapiens
  misc_feature 55, 89, 348, 384, 389: n = A,T,C or G
atttcacccactatgagagtgtacagggactgcctgcctttcggtataaagttcntgcagaaatactagccaatacgtcagacaatgcnggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggcattaatcctttgactggaataatcctaaaagcagccaagaggtccaaatcaacatttatgtcaaaaaaattagatgactttgntgaaacgggagacattagaaccatgggtttcccagngatgnacctc

SEQ ID NO: 23540 - DNA, 400 bp, Homo sapiens
  misc_feature 3, 23, 62, 353: n = A,T,C or G
tanttgctattgccttgtggttnattgagcttatgtatgtgtggagcacttgtagcacagcncatttgtgcgaaatggacaaggacagaggctgagggaagcaagaagtctttgtcttctgaagggcaccacatggatcttcctgatgttgcattacctcacttcctggtcaggagctgaaattctcaaacaacttttttcaacagtagtgattttctctacatcagggtcctacagcctacattgatattcctgaaactgagttggaaatcgactcatttgtagatgcttgtgaatggaaggggcagatatccgcagggggcattttcggttactccgaggctggttgcagncttaagtccaggacacaaaaatacatttgcaaaacatccatctgcat

SEQ ID NO: 23541 - DNA, 119 bp, Homo sapiens
  misc_feature 8, 13, 68, 86: n = A,T,C or G
caaccctnatatngttcaaagctgaggagcttgtcctgtgtatgtgaatgctcacatgtgcacttagntcaaatactaaaagtagnttttattaaatataatcagccaaaaacacacac

SEQ ID NO: 23542 - DNA, 285 bp, Homo sapiens
  misc_feature 4, 50, 57, 90: n = A,T,C or G
gaangtttccagtggtatgttgaagactcaagctatcattgtattgaggnctatatntctatatggctttgataatatttgttttatatntctgagtgctccagtgtttagtgcatatatgtttacaattgtcatatcccgccaggcgtggtagcaagcacctgtaatcccagctacttgggaggttgaggcgagagaatcacttgaacctggaaggtggtggttgtagtgagccaagatcgtgccactgcactccagcctgggcgacagagtaagattccacct

SEQ ID NO: 23543 - DNA, 247 bp, Homo sapiens
  misc_feature 21, 23, 90, 91: n = A,T,C or G
gaaatttcccttaagttgatntnttttctccttctgcaattgaactgaatacatttttcatgcatgttttccagaaaatagaagtattanngttattaaaaagattatttttttttattaaaggctatttatattatagaaactatcattaatatatattctttatttacatgatctgcccatagtcatgcattgttttgcaccccaaattttttattgtcatagcagcatggcagctttcttcttg

SEQ ID NO: 23544 - DNA, 214 bp, Homo sapiens
  misc_feature 4, 10, 41, 87: n = A,T,C or G
ccgnaagatngagaacagcctggccaacatggttgaaaccncatctctgcttaagatacagaaattagctgggcatggtggcggggnacctgtaatcccagctactcaagagactgaggcatgagaattgcttgaacccgggagcagaggtagtgatcccaagtggcaccactacactctagcctgggcaacaagagtgaaactccatctctga

SEQ ID NO: 23545 - DNA, 309 bp, Homo sapiens
  misc_feature 4, 7, 36, 69: n = A,T,C or G
agcngangttctttaaaattatcttatggatagctnaagtctctgccatttgtaattttggctctaagntccgattggagacgcttctccttgtgcatgtgagttgactgatgttgtgagtgtaaatgcatttggttatttctggtatcggtggccacttggatggatttttttacattctgttccccagttacaggaaggagccctttggtgtgtgaatatgtgtcctgtagagggtgggcaagggtggggtggggatggaaatgtgtgcatgcacatgaagttgaaattcttttatgcatttttttg

SEQ ID NO: 23546 - DNA, 334 bp, Homo sapiens
  misc_feature 1, 19, 38, 39, 53, 62, 68, 75, 77, 84, 89, 91, 138, 159,253, 321: n = A,T,C or G
natccgccttatttggganagtcccctgatgagtgtgnngctggattgttgtnaagcaatanaattgnttggtcncntggcaanagagngngctgctgtaagaaatctcccatgtgcataacaaattctgaatatttnttgaggctaaagaagaccggngtgacaagcagatactgctgtgtaatgggttacactaaccaaaagacaccagccactcagagtctatactgtaaagcgcagataacatttgtgngtataccttgattggggaattaaaagtcatttaactgaagatgttgagaacctggctctgggtttagnataccggaattac

SEQ ID NO: 23547 - DNA, 282 bp, Homo sapiens
  misc_feature 45, 51, 202, 208, 243: n = A,T,C or G
aaacttataatttatgatcagagattgcagtaaagacaggcattngaaatnataaaagtattaagtttggggaactaataaatgtccatgaaatcttcacagtttatgttcttctgccatggcttcaagctgggccctccgttcagggtccctgactttctgcaacagtaaacagtgctgcaatgaacattcacatgcaggnttctgnagaatgccttatattcctctgggtatatactcagnaataggattgctgagcaaatggaagtctggctttagtct

SEQ ID NO: 23548 - DNA, 327 bp, Homo sapiens
  misc_feature 56, 262: n = A,T,C or G
gaaagttcccgaaattaatttgttttatactttaggtgtagtgtcttatagttttnctatgagttaggtggcttttcctttgaaaatgggtacagattaaaaaacaaagtaaagcaaaatctcatttgtatagttcatatttagataattaatttgggtagatagcagcctaatatgtagaaatgaagaagttattttaataaatactagtaaatctgtatggtgtttttcatttattactgataatttctttttctgttgntagaataccagaatatagaccattaaaaatggaaaaacatcagttttaaaaattgacattttcag

SEQ ID NO: 23549 - DNA, 259 bp, Homo sapiens
  misc_feature 27, 47: n = A,T,C or G
cggagactctgtttcaaaaaaacaganaagaaaatatagtttgattnttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaattac

SEQ ID NO: 23550 - DNA, 279 bp, Homo sapiens
  misc_feature 41, 256: n = A,T,C or G
acataagtatatagtgcaatctgtgaatatactatagtttnttcaatcttttcttatagcatctaggatgattgcagtattttgctattataaataatgctataaagaacacctgtgtgtatgttttcttttttcttattattggaatgtgcctctgtaaattactcaaaggaggcagcagataccacattatgttaataagcaattaaaactagtgctatattttcattttaggagacttggcacagttgcaggntggaaaaagaactgagtaatgcc

SEQ ID NO: 23551 - DNA, 126 bp, Homo sapiens
  misc_feature 1, 11, 32, 36, 60, 65, 68, 70, 71, 77, 82, 90, 102, 119, 122: n = A,T,C or G
naagaaggatntgtatccatacagcgaagacnaganggaatgacaaagcaaatcaggctnaaacngcntnntctgcnaagantgccagangcagcgatttangcagaagcttctgctcntangcgt

SEQ ID NO: 23552 - DNA, 397 bp, Homo sapiens
  misc_feature 54, 327, 380: n = A,T,C or G
aaaccgccctctaaagactggccttgaattatgactgggattcggacgatgatncagaggtgaggctatcctcaattcaggtgctaggggttattccgcccttaagtagatctgaggcagacccttgggggtgtaaaagagagtcacaggtaccccaaggagtagatgccagggcctaagttgaaaatgatgtcgattgggggcgggggacactgtatttgatatttgtgatcagtgatcattgtcaactgcgaaatagagtgtttgcttttgataatggaaaattgtattcggtttaaaattccgttggtgagaataacaatatgnttaaaaatataattgaacaaattttttctttgtttcctgcattgacatttagnataacagttttgctaac

SEQ ID NO: 23553 - DNA, 397 bp, Homo sapiens
  misc_feature 2, 9, 54, 56: n = A,T,C or G
antcccccnaaagaaaacccatactggagagaaaccctacaaatgtgacgaatntngaaaaaactttacccagtcctcaaaccttattgtacataagagaattcatactggagagaaaccctacaagtgtgaaaagtgtggcaaagccttcacccagttctcacacctgactgtacatgaaagcattcatacttgagaaaaaaataaacaaatataaaaataggcaaagcgttagtatctgctcgcatcccactttacatcagagttcagacttaataaagttatcataaatgtaattactattgaaagacctttcatgaaatataagtctccagagcacacaagagtatttcttctgaaaaaaatgttacaattatactaggatggaagacttgca

SEQ ID NO: 23554 - DNA, 380 bp, Homo sapiens
  misc_feature 55: n = A,T,C or G
aatgaacccatatagtaccgaaggaaaagatgaaaaattataaccaggcatattntagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggtgtccaagatagaatcttagttcaactttaaatttgcccacagaaccctctaaatccccttgtaaatttaactgttagtccaaagaggaacagctctttggacactaggaaaaaaccttgtagagagag

SEQ ID NO: 23555 - DNA, 125 bp, Homo sapiens
  misc_feature 4, 20, 27, 31, 32, 54, 61, 64, 78: n = A,T,C or G
tgcncttcactgcttaatgnccagtgncttnnaaaccactgttacatatatttngtctgtnttngtattattattatnatcataggggggagggtaaatccaggcactgttaccctgtcttggcc

SEQ ID NO: 23556 - DNA, 148 bp, Homo sapiens
  misc_feature 45, 145: n = A,T,C or G
attgaaaaggcatatctcatagctgataaaattagcccagaatgntcaatgctgagacatatactaataaaagtattgaacttctctccattgctcttaatcacaggaaaaaaaattactgaactttttgacctttgggcaaganctt

SEQ ID NO: 23557 - DNA, 377 bp, Homo sapiens
  misc_feature 17, 25, 85, 214: n = A,T,C or G
cccaccaaataactgcnggagatcncgcccactttcaccatcccaagttttgggagtacattttttttcaagcacacatagaacnttagccaagctagattatatctgggccataagataagtctcaatatatttctaaagattaaaatcattgcttaaggccagaaattcaagaccaacctgggcaacatattaaatagatagaccccatctncataaaaagtaaaaaacttagctgagcatggtagcacgtgctatagcccagctacttgggagactgaagtgggaagattgagcctaaggagttggacgctgcagtgagtatgattgtgccactgcctccagcctgggtaaagagtgagaccctgtctctattt

SEQ ID NO: 23558 - DNA, 400 bp, Homo sapiens
  misc_feature 4, 13, 40, 55, 58, 92, 124, 356: n = A,T,C or G
gaanatgacccantaaagttttgtgaaactgaagggaagngaccatccagagtcnttnaacaaggtcatggtccaggatcacagccatgatncggcccctccccctccactgtgctgggccggnggactcatctgcttcatacacatctgctgaacagttatttccaagcactgaatagaaaccatcagcctcgcatgttttccatagctgttgattgtgctcctactcttcgtcatcttgtggataataaatccatccatttaaagacaagaagaattcagtgtcagctatggctgctacacacatgtcactttccttacattttctttgaacagaacacagtaaaatctattgnacagctcaccggcgtgataccgctttgataagacaccgagtgac

SEQ ID NO: 23559 - DNA, 345 bp, Homo sapiens
  misc_feature 44: n = A,T,C or G
gctaggaaacaaaaagctaagggcaaaatgtacaaacttagaantttttggaagataggaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttaccgtagaccagaaccaatttagaagaatacttgaagctagaaggggaagttg

SEQ ID NO: 23560 - DNA, 107 bp, Homo sapiens
  misc_feature 31, 45, 75, 77, 89, 93: n = A,T,C or G
gatccataaagcataaaggatccattttggnatgtctgtgaaatnttctctgatgcaatcttttttttttttaananggttgcccattngctnagcagaactaatgg

SEQ ID NO: 23561 - DNA, 260 bp, Homo sapiens
  misc_feature 6, 8, 27, 35, 38, 39, 45, 53, 70, 76: n = A,T,C or G
gcagangnatgatgcgggtcagtagtngatttagnctnnaatttnccaaattntttttaagctacttttnatttgngggtcctatttatcatgctgatgttaggaagcagcagtcatccagccacagagggagctaaagttaactaaccagaactgtagaaatcattatacatgcctttgacaacaaaggaagttcataagaaaagccatgtcgggcttttcctctactagatacagattggaggtagatgaatatttgc

SEQ ID NO: 23562 - DNA, 196 bp, Homo sapiens
  misc_feature 2, 38, 46, 48: n = A,T,C or G
gntaccctagggataacagcgcaatcctattctagagnccatatcntnaatagggtttacagacctcgatgttggatcaggacatcccgatggtgcagccgctattaaaggttcgtttgttcaacgattaaagtcctacgtgatctgagttcagaccggagtaatccaggtcggtttctatctacttcaaattcct

SEQ ID NO: 23563 - DNA, 186 bp, Homo sapiens
  misc_feature 6, 25, 41, 64: n = A,T,C or G
gaaccngagctcttatactaggatncttaatcatttgtatngcctttctaacctgctcggactnctgcctcactcatttacaccaaccacccaactatctataaacctagccatggccatccccttatgagcgggcgcacgtgattataggctttcgctctaagattaaaaatgccctagcccact

SEQ ID NO: 23564 - DNA, 355 bp, Homo sapiens
  misc_feature 258, 263, 273, 301: n = A,T,C or G
ctgtgtttgctataaattgggagcattgtgttaagaatgctgaaaaataagaaaaaagaactgctataaggcagcatttgagtacattattcaatttttaagaagtagaaaggattttcagtagcttaaacatttttaaaaagttcatatctgatcagtagtgtatcaggtttttgttgtcttgttgatatcattttaagcttcctctgtatttcatcaatgctgccttaatttaattcatgtattaaatacagatgntttgntttcctcagngaaagggagatttttctttgcaagcagngataaaatgtaaaataagataagtgacaactgttttatagaacccattggggat

SEQ ID NO: 23565 - DNA, 396 bp, Homo sapiens
  misc_feature 3, 46, 47: n = A,T,C or G
agnttctgaggatcagcactgccagtggagatgggcgtcactactnntaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggcacaaaagtccctctcactttcagt

SEQ ID NO: 23566 - DNA, 353 bp, Homo sapiens
  misc_feature 258: n = A,T,C or G
cccgacatttgtaatatgaagactattttaaaaataaccagccttttgtttaactattttgaagtccagagtttccttattgttttttaatgttgggcatttgtttatatcatttttattgatttgaaattaatccagtggtgtatatgcatgagggtagttgctaggctcggttttggagaaagatcttcactagaggaaaaggaaaacctaaagctctgtttaagtgagggaggaattttggcaggcatcctcagngatctagtattttggtaagagatgggaaagagatatatttttatcctggagcattctgagcttatgctcatcagaaattcccatgcttaagttgg

SEQ ID NO: 23567 - DNA, 397 bp, Homo sapiens
  misc_feature 3, 7, 348, 382: n = A,T,C or G
tgnctgntagtcgctaacttagtaagtgcttttcttatagatcccttctgactgagcaatatgcctccttgtattataaaatctttctgataatgcattagaaggtttttttgtcgattagtaaaagtgctttccatgttactttattcagagctaataagtgctttccttagttttctagtaactagggtgtaaaaatcatgtgttgcaggctttatagtttttaaaatattttagataattcttaaactatgaaccttcttaacatcactgtcttgcagattaccgacactgcacttgaccaatactgaccctctttacctcgccacgcggacacacgcctcctgnaggccgctttgctattgatggtccttggggctgngaggtctgtaaactg

SEQ ID NO: 23568 - DNA, 248 bp, Homo sapiens
  misc_feature 176, 194, 214, 216, 230: n = A,T,C or G
tctgtacacaggcattcctcctgcaataatgttgtatctttgagaccgttgcagtgcacacaactcacatccttcatattgaaggtgactcatttttctgcacactaggattctcaatgcaagaatccagtaccttgcacatagaagtagcaacccatcccttgcctattttcatnttgctgttttcttttttntaaaaaaatggatgtgactngntttgaatgttttgnattatacttggttgtgag

SEQ ID NO: 23569 - DNA, 104 bp, Homo sapiens
  misc_feature 3, 43, 75, 80: n = A,T,C or G
ctntaaatggggtaagaagcccgctcgctggcgtggagccgtncgtggaatgcgaagagcctagtgggccacttnggggnaagcagaactggcgctgcgggatg

SEQ ID NO: 23570 - DNA, 392 bp, Homo sapiens
  misc_feature 2, 9, 28, 52, 78, 80, 112, 137, 144, 219, 262, 300, 335: n = A,T,C or G
ancatacantattgaattcaatcctggngattcttctcttatctctttttanaaaagagaagacagaggtttaagaangnaaatataatttgcccaagatcacacaacttgnaagtaggagagaaggaattcaaagngcaacgngactttggagctcttatttccaacgattagggcagaacaccacactgccttctaaaggtaattaccttgaaattntaaatccagagtaaaacatcatttcctagaatcctagaatggngaagccggaagagaaattaaaataatatctagcctggngggttataaattgcttcctagccatgaaactcttnccttatataaaaaatcttaccgggggaagcctaaagctataaaacatgccaatttgg

SEQ ID NO: 23571 - DNA, 395 bp, Homo sapiens
  misc_feature 12, 57, 219, 391: n = A,T,C or G
gaaggattcccnccgtgtcaacaatggtaaaggggatgtatggcattgagaatgatntcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgnagaaatttaaaaactacaatgtgattaactcgagcctttagttttcatccatgtcatggatcacaggttgctttgatcttcttcaatatgtgaatttgggctcacagaatcaaagcctatgcttggttaatgcttgcaatctgagctcttgaacaaataaaaataactatgnaggg

SEQ ID NO: 23572 - DNA, 394 bp, Homo sapiens
  misc_feature 1, 57, 277, 377: n = A,T,C or G
natcacaccctaatgtacatgggcccgcaccataatgagatgtgagccttgtgcatnttgggggaggagggagagagatgtactttttaaatcatgttccccctaaacatggctattaacccactgcatgcagaaacttggatgcactgctgacattcacttcagagaggacctatcccaaatgtggaattgactgctatgccaagtccctggaaaaggagcttcagtattgtgggctcataaaacatgaatcaagcaatccagcctcatgggaagncctgcacagttttgtaaagcccttgcacagctggagaaatggcatcattataagctatgagttgaaatgtctgcaaatgtgtctcacatctacccgtggnttggaggctttatgggg

SEQ ID NO: 23573 - DNA, 398 bp, Homo sapiens
  misc_feature 2, 4, 27, 31, 228, 309, 358, 368, 375: n = A,T,C or G
cnangatgcatttattagaaaaatggnaagnaagtgagccaaaggaactccctccactacaagacaaacccaaagcagaaagaagaaaacttttttcctctgttttcagttaagaacatttgttcattgtgctgaaattttgtattttttaaccagtatctcctcaatccctccaaaagaaaaaaaattgatctctctctctcttttttttttgagatggagctcacncagtccccaggctggagtgtagtgcacgatactggtcactgcaacctccctccagctcccgggttcaagcgattctcttgncatagcctcccgagtagctgggattacaggccccaccatcatgcccggntaatttttgnattttgnaagagacggggttcaccatgtgg

SEQ ID NO: 23574 - DNA, 286 bp, Homo sapiens
  misc_feature 1, 30, 56, 57, 90, 230: n = A,T,C or G
naatcttcccttgcctaacgcagccatggntcgtggtcccaagaagcatctgaagnnggtggcagctccgaagcattggatgctggatanattgaccggtgtgtttgctcctcgtccatccaccggtccccacaagttgagagagtgtctccccctcatcattttcctgaggaacagacttaagtatgccctgacaggagatgaagtaaagaagatttgcatgcagcggntcattaaaatcgatggcaaggccgaactgatataacctaccctgctgggatcatgg

SEQ ID NO: 23575 - DNA, 292 bp, Homo sapiens
  misc_feature 10, 57, 91, 249: n = A,T,C or G
gattcatccnttcacaaaatatttatgatgtatttactctgcaccaggtcccatgcnaagcactggggacacagttatggcaaagtagacngaagcatttgttcatttggagcttagagtccaggaggaatacattagataatgacacaatcaaatataaattgcaagatgtcacaggtgtgatgaagggagagtaggagagaccatgagtatgtgtaacaggaggacacagcattattctagtgctgnactgtccgtacggcagccactacccacatgtaactttttaaga

SEQ ID NO: 23576 - DNA, 175 bp, Homo sapiens
  misc_feature 2, 8, 13, 35, 36: n = A,T,C or G
tntggaanccgcngacaagatgttttctctttganngatagagattaatacaactacttaaaaaatatagtcaataggttactaagatattgcttagcgttaagtttttaacgtaattttaatagcttaagattttaagagaaaaagataaatttaaacctgaaaagtaggaagc

SEQ ID NO: 23577 - DNA, 398 bp, Homo sapiens
  misc_feature 7, 26, 30, 72, 92, 328, 377: n = A,T,C or G
tgggaantatcccaaagggactctgngcancatttcctttaataaaatcacccttgattcctccataccagncaggagatgccaaggcacanaacaacctgcagaaatcaggccttgcagagctcagtgagtgtagactctagagctttgcatcacccagatatttgcccttcacttaaactccactcagatcacttatgtagcctggtatatgtattattcactctttggttttgcacagattaagatgaaatgacttttagaagatactggaatctccttgctacaggcatgtgttgcctaataaaagctttctgcacgacgtagnctaataaaagatgatgaggctttctaatagccattgctttggttggagngctgattttattaagcaccca

SEQ ID NO: 23578 - DNA, 395 bp, Homo sapiens
  misc_feature 6, 7, 89, 90, 325: n = A,T,C or G
aacgtnnctgcactctagcctgggcaacagagtaagacaaaaaaatatatatatattgaaaatcaaaggaggcaaaattttgacagggnnggaagtaactgcaaaacactaggctttagtaggtacttatataaaatctagtccagttctctcatttaaaaaaatgaagacactgaagtacagacttaaatagctcagatagctaattaggaaatttcaagttgccaataatagcattctctctgacatttaaaaataatttctattcaaaatacatgcataattgattttacacctcattactgggggataatttatgtgatgnggattgctggggtccagcatgacccataacagggcagaagaatgatggaatggtttaagaataaactccg

SEQ ID NO: 23579 - DNA, 279 bp, Homo sapiens
  misc_feature 5, 11, 55: n = A,T,C or G
aacancccganaaataaggaaataggggacttgaaccaattggacctaacacacntatatacataacatttccactcaacaatagcagagtgcacattttcctcaagtgcatgtggattattatccaggataaactatgtcttaggccacagaagaagtcataatgttaaaatattgaaactagaattcaatagcataagtaaaactgtaaaatccacaagtatatgaaaactaagcacactctaaactagtggatcaaagaagaaatcaaaacaaatg

SEQ ID NO: 23580 - DNA, 261 bp, Homo sapiens
  misc_feature 8, 54: n = A,T,C or G
aaatgccnatacacttacactttatgcacaaaatgtagggttataataatgttnacatggacatgatcttctttataattctactttgagtgctgtctccatgtttgatgtatctgagcaggttgctccacaggtagctctaggagggctggcaacttagaggtggggagcagagaattctcttatccaacatcaacatcttggcagatttgaactcttcaatctcttgcctcaaagcttggtaagatagttagggcgtgc

SEQ ID NO: 23581 - DNA, 315 bp, Homo sapiens
  misc_feature 5, 11, 245, 287: n = A,T,C or G
gaatntttccntacccaaaatccatcagtatcttgaatcatgctggattttgaagaattcttaacaagccatgtaaagggggctctctgggcttgaaatagtgatgttttttatacagaaaggagaatgccgaatgttcagactaccatgcactgttaaatttgatttcaagaaattacaggaaaactttctaaagttccgctcacagaatttatttttacaaagaattccaagataagtttagntttatgaaagatttttatgtggttttactcactcttcatctnagacatcaaccgatgattacatcactta

SEQ ID NO: 23582 - DNA, 183 bp, Homo sapiens
  misc_feature 11, 57: n = A,T,C or G
gaaatgacccnaaactatgagagtgacaaaatggtgacaggtagctgggacctaggntatcttaccatgaaggttgttttgcttattgtaggatttgtgtatgtagtgtaactattttgtacaatagaggactgtaactactatttaggttgtacagattgaaatttagttgtttcattgctg

SEQ ID NO: 23583 - DNA, 490 bp, Homo sapiens
  misc_feature 374: n = A,T,C or G
gagagaaaggcagacaaaggctcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcnagcgaattgctctgctgcccaaaagacgttttctttggaccaaagatctctttcgtgattccttgcaacaatcaatgagaatcttcatgtattctggagaacaccattcctgattt

SEQ ID NO: 23584 - DNA, 480 bp, Homo sapiens
  misc_feature 72, 152, 472, 474: n = A,T,C or G
ccgttccttgggtggagcagtggctattcatttggcttctgaaaattcacataggatttcagccattatggnggagaacacatttttaagcataccacatatggccagcactttattttcattctttccgatgcgttaccttcctttatggngctacaaaaataaatttttgtcctacggaaaaatctctcagtgtagaatgccttcacttttcatctctggactctcagatcaattaattccaccagtaatgatgaaacaactttatgaactctccccatctcggactaagagattagccatttttccagatgggactcacaatgacacatggcagtgccaaggctatttcactgcacttgaacagttcatcaaagaagtcgtaaagagccattctcctgaagaaatggcaaaaacttcatctaatgtaacaattttattaaatgtttccctttttggattattggcattngnatttta

SEQ ID NO: 23585 - DNA, 490 bp, Homo sapiens
  misc_feature 183: n = A,T,C or G
gattcctgagctgacagcattcgggccgagtatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcntccatccgacattgaagttgacttactgaagaatggagagagaattgaaaaagtggagcattcagacttgtctttcagcaaggactggtccttctatctcttgtactacactgaattcacccccactgaaaaagatgagtatgcctgccgtgtgaaccctgtgactttgtcacagcccaagatagttaagtgggatcgagacatgtaagcagcatcatggaggtttgaagatgccgcatttggattggatgaattccaaattctgcttgcttgctttttaatattgatatgcttatacacttacact

SEQ ID NO: 23586 - DNA, 225 bp, Homo sapiens
gttccctccccgatatctttcctgttccagagaagtgggctggatgtctccatctctgtctcaacttcatggtgcgctgagctgcaacttcttacttccctaatgaagttaagaacctgaatataaatttgttttctcaaatatttgctatgaagggttgatggattaattaaataagtcaattcctggaagttgagagagcaaataaagacctgagaaccttcc

SEQ ID NO: 23587 - DNA, 237 bp, Homo sapiens
  misc_feature 23, 125, 199: n = A,T,C or G
gtgcgttagtttttaatcatcancgactatctcaccctcccactcctgtttttaaaactcagaattctttcctaagagcccttcgagcaaagcgtgccgaagttagttgtcttctctgtgctggncctttcttatgtcctcataaaagctcagatgatggtatctgtgagtatgttttgcaaaattcaaaatatagttnggaatttttttttccaggtgattttaaaaaagaacggc

SEQ ID NO: 23588 - DNA, 266 bp, Homo sapiens
  misc_feature 7, 28, 155, 240, 258, 263: n = A,T,C or G
ttcgggnatgtgcccttggaaagagggnctgtgttcacaattacgtgaagggaggacccttggggaccgccattctaaatatcatgtaggaatttaaaaagccaaaatactaattatttctttgtagtgtgtaaaggaatgtttttaaaagacanaaacccaactctttgtggatttttatcaactctttactcagagccactctccaatgcaagtcacactccaattatgatggaagancttttttatacttaattngcagnagg

SEQ ID NO: 23589 - DNA, 318 bp, Homo sapiens
  misc_feature 2, 12, 86, 296: n = A,T,C or G
anccggggaacnccggccctttatggccggagcatcccatttggaaaaaaatgtgaattttttactactggaactgcacaaactgnccactgacaaaaatgacccccatttgtgtgacttcattgagacacattacctgaatgagcaggtgaaagccatcaaagaattgggtgaccacgtgaccaacttgcgcaagatgggagcgccccgaatctggcttggcggaatatctctttgacaagcacaccctgggagacagtgataatgaaagctaagcctcgggctaatttccccanagccggggggggactttccctg

SEQ ID NO: 23590 - DNA, 212 bp, Homo sapiens
  misc_feature 23, 109, 145, 151, 163: n = A,T,C or G
gacggtaacggggcagagaggcncctcgcagaacctgcggaagatgaatgccagaggacttggatctgagctaaaggacagtattccagttactgaactttcagcaagnggaccttttgaaagtcatgatcttcttcggaaaggntttttnttgtgtgaaaantgaaacttttgcgtggggggtcccccttgaattatcaaaaaaaaaattt

SEQ ID NO: 23591 - DNA, 254 bp, Homo sapiens
  misc_feature 100, 175, 230, 235: n = A,T,C or G
gccttgagtcgaaagctcaatccctgatgttctccacatgtgtacttaacgtttttacttatgtcgtttccatctgtctttactgttctaggattgcggnggtctcctgtctgaaggagataaccaaggctgctaccccttggatgggcacatcctctgcaagacctgcaactgntgcccgcatcagggtgttgaccgccaaggcgagcactgacctttagattcagtcncctgnccagccggcactgagaaga

SEQ ID NO: 23592 - DNA, 119 bp, Homo sapiens
cttcagggactggagctgcttttatccttggaagagtattcccagttgaagctgaaaagtacagcacagtgcagctttggttcatattcagtcatctcaggagaacttcagaagagctt

SEQ ID NO: 23593 - DNA, 317 bp, Homo sapiens
ataggtttggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctcccc

SEQ ID NO: 23594 - DNA, 342 bp, Homo sapiens
gcaggacagataggggttttctgctggaaactgcgatacctaccctcggtacatggggatagctcacataagtgacttggtcacttggcaagatttcttcgcttctcggatagctgcaggaattaaaacatagtgtatagaatttaggtgttttacactaaaaatgataatgtcttgttccaattaagaatagtaaacaggtccaagtatagacaataaatgagattgggattctgttctcatttctcaatgtgaacagttactcccatatcagcattattttctatttggccttcttaaatacagagaaaaaataggatatattaattagtaggtcactcg

SEQ ID NO: 23595 - DNA, 462 bp, Homo sapiens
  misc_feature 20: n = A,T,C or G
gcttcacaccccgcaaaaangctaatgactccttgggaagaatcgaatgtcatgcaggacaaagatgcaccctctccaaagccaaggctgagccccagagagacaatatttgggaaatctgaacaccagaattcttcacccacttgtcaggaggacgaggaagatgtcagatataatatcgttcattccctgcctccagacataaatgatacagaaccggtgacaatgattttcatggggtatcagcaggcagaagacagtgaagaagataagaagtttctgacaggatatgatgggatcatccatgctgagctggttgtgattgatgatgaggaggaggaggatgaaggagaagcagagaaaccgtcctaccaccccatagctccccatagtcaggtgtaccagccagccaaaccaacaccacttcctagaaaaagatcagaagctagtcctcatgaaaac

SEQ ID NO: 23596 - DNA, 398 bp, Homo sapiens
  misc_feature 43: n = A,T,C or G
atttggaggactaactggacaaatagtggcagcgctttcattngctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgccttcataatgaagttaaagtgagtatctgtggagaggcttccaaatgtggttacctcagctatatcactgccaacatcagaaaacctgacggctatgattactatgc

SEQ ID NO: 23597 - DNA, 298 bp, Homo sapiens
  misc_feature 12, 14, 40, 64: n = A,T,C or G
ctgagggtaaananatgaaattatataatgtatgatacanttttatcaaatatctaataattgntgaaattagctcttgtttttggtttttttgttgatgtttttacagatttcaggttacaaactgcaaagtttatgcataattaagtatggtatggttgccagaaaagcctaaaattactacttagaaaatttaagactgtttacccccattgtcttgtacttgcgagctaacttgtctattcttgtgaaagcactgcatcttttagtaagcaaattttgataatgtttctcgtgg

SEQ ID NO: 23598 - DNA, 398 bp, Homo sapiens
  misc_feature 38, 41: n = A,T,C or G
gaggcagccagcgcaggggcttctgctgagggggcagnttnagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaaggttagt

SEQ ID NO: 23599 - DNA, 372 bp, Homo sapiens
  misc_feature 41: n = A,T,C or G
aagtattttgacttttgagattgagtgtaaaatattttaantttgggatcatcgcctgttctgaaaactagatgcaccaaccgtatcattatttgtttgaggagaaaagaaatctgcattttaattcacgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctcaacttgcctaaaacatt

SEQ ID NO: 23600 - DNA, 397 bp, Homo sapiens
  misc_feature 1, 3, 386: n = A,T,C or G
nantagtcccaggaaaggatgctgcaggaccttctaagtgatcgaaataatttagtgctggaacatgaaatggagattcaaggcctgcttcagtctgtgagcaccagggagcaggaaagccaagctgctgcagagaagttggtgcaagccttaatggaaagaaattcagaattacaggccctgcaccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcaagcatacccagatccacattaggagacttggcacagntgcagggctgg

SEQ ID NO: 23601 - DNA, 450 bp, Homo sapiens
agcccggcggttcggggcgacggaactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgg

SEQ ID NO: 23602 - DNA, 481 bp, Homo sapiens
attaggaggtgttttttgactctttaaaaatgtatgtcatgatcttttattattttattcattgcagattcaaatttccttaatttaaggaacctgaaattatttgttttgtccttcctactaaagtgactaacaactacttaaaatgaaaggatttttaaatattcttaaataaactcatactttggataatttttgttatgaaaaattatgagtcagtaatgtaacaaaacatgtttttatatgtgcacgagattacaagaaattacgctcactgtgttatattttgttaataatttgggtacaatcctaaaaagaactggattgtttatattgttactataatgtttaaaagttagtcactctgtacatttaaaatattttatattttgtttagttaaccttagattcctttaggccatagtctaatattatcaaagcaccatattctcttcaaatccctaaagtaaacagcaaattg

SEQ ID NO: 23603 - DNA, 478 bp, Homo sapiens
  misc_feature 437, 452: n = A,T,C or G
gcagccgacctttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggccggaactacagtattctttcccctgctagcaaccatgtgcctcccatcctgactgtggnagttggggatgtggnaagtggggcttggaacaaagcttctg

SEQ ID NO: 23604 - DNA, 482 bp, Homo sapiens
  misc_feature 1, 14, 427, 481: n = A,T,C or G
nagtaaattttagnaataaagtgattatatataattttggtgttcattactagaatctagacatacagttaattttatgtttatcttgtattctgtgacattgctggactcagttctaggagtatttttggatagattgtcatttttttaatgtggacaatcatcttcaaatatggaggttttatttatctgcagatacggagagttttatttctcccttttctatctgtatgccttttatctccttttcttgctatatttcactggctgcaacttccgcactgtgttgaataagagtagtgagagtggacatccttgccttgtttcccattttaagggaaaagtatctgttgtttcatcattaagtataatgttaactgtaaatttttggtagatgatctttgtcaagttatgaaagtcctgttgnattcctattttctgaaattttttatcattaactttcaatataaccttttgtcana

SEQ ID NO: 23605 - DNA, 464 bp, Homo sapiens
tacagctgtttgttttacttgcacatttgtacatatacttaatgttttcaagtgccttaattgtttaaaatctctggcttcaaagtttcttggggaaaggtcggtttatctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacacaacaatttgaagcttctgtaattttgagcactgctctaacaacaagcataatataaaattagtttagaattttgcaagtctacaaatgagctcttgcaacagaactcacagcctttttactttt

SEQ ID NO: 23606 - DNA, 456 bp, Homo sapiens
tcttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaacctttgatgcctgaaagaactggaaattatgaagataggattccagaagtcaaatatgttaactaactgcattgaagagtagaagaaaacaatagcctagtaggtttttactgggattagtgaaacaactgctatgttctcagcaacccactccaaagccaaagtc

SEQ ID NO: 23607 - DNA, 465 bp, Homo sapiens
agttcagaaaaggctcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgc

SEQ ID NO: 23608 - DNA, 465 bp, Homo sapiens
gaccctatggagctttaatttattaatgcaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgaccctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctc

SEQ ID NO: 23609 - DNA, 478 bp, Homo sapiens
taacatagtcaaatccacaacctcatactaaagaatgtttttggaaagcacttgatgtccctctctgggctgacagtctactgactgtctaaatgagactcagaaatctgaaagcttggttttcattagctccaaactatcagttcctaaaaaggcttagaggacatggaagacaaaagtggctatcctttgctaggaattatcagaataagtacctaaattaatctctccaggattttttgttttctcttcagcatatgcccaaggtatgtatgatgtgagcagcctgaagctattctgaatgacaaggactagttttaggtaacctccaattgaattgtttttatttttcctatggagatccagagacgtttgttttcaaatggagcaaacagcactgtgatactgactttgtttattaaaaaataattgtttccaaattaatttcaactcataatgagttaaagcgattagaaat

SEQ ID NO: 23610 - DNA, 358 bp, Homo sapiens
  misc_feature 6, 12: n = A,T,C or G
atcttncagtanttcgccaaaatgactttcacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatg

SEQ ID NO: 23611 - DNA, 400 bp, Homo sapiens
  misc_feature 7, 11: n = A,T,C or G
atgtggntgcntacaagaaggggtacttcatccttttttgggcatcagaaaaggattcacaatggaagagatgtctaagctacggtggatggaatcatcagtgttaactaataacacgtgggttccaggcaggagcggcaagtacaaagagtgagaaataagctgggtgtgatggctcacgcctgtaatcccagcactttgagaggctgaggcaggcagatcacttgaggtcaggagttcaagaccaccctggccaatatggtgaaaccccatctctactacagatgcaaaaattagctggcgttgtggcaccgcacctgctacttgggagattgaggcaggagaattgcttgagccccgggagcggaggttgcagtgagctgagatcggcgccactgca

SEQ ID NO: 23612 - DNA, 199 bp, Homo sapiens
  misc_feature 2, 5, 33: n = A,T,C or G
cngangacagttcagggaaacagactcaaatgntgataggaatttagtatgtatgaaaggtggcattacaaatcactggagaaaagatagattattcaataaatgggcttggagcaattgaagaaccacctggaaaatattaagttggattgcagcacactcctttctccagaattaattccagatggatccaaaattt

SEQ ID NO: 23613 - DNA, 400 bp, Homo sapiens
  misc_feature 3, 7, 41, 371, 375: n = A,T,C or G
aanaagnttttaccccaccctgaatgcttgtaaacactacnatttgtttcccactctgtttaatatttgcatcctagagtggtgacatggggacagactgttgcaggatcaagtatctataagaataatgtaagtcatcctagttataagtctctcttctggttatctctgtgagctagatctgggaaaatagctaaagttgaggccctggactgccagggaggaggaagagaggaaggccaagtacgttgaatcccaggcaggatatcaaacactggattttgtgcatcatacactgaattcttggtggctatctaagttatttcccctctgcctaatttttcctgggctttgcgattaacttaaatggngacnggatagggcaatggtgattcaacat

SEQ ID NO: 23614 - DNA, 345 bp, Homo sapiens
accacatacatttacacctactacccaactatccataaatctaagtatagccattccactatgagctggagccgtaattacaggcttccgacacaaactaaaaagctcacttgcccacttccttccacaaggaactccaatttcactaattccaatacttattattattgaaacaattagcctatttattcaaccaatgacattagcagtccggcttacagctaacattactgcaggacacttattaatacacctaatcggaggagctactctagtattaataaatattagcccaccaacagctaccattacatttattattttacttctactcacaattctaga

SEQ ID NO: 23615 - DNA, 352 bp, Homo sapiens
gtgctctgagtatttaattgctatttagttcaggccttattaataagaatacaaaaataattattttaagccttactgaagagaaatatactgacttatctagttagctgcattgtattttagagagtgaagatcttgatagccatatattttaggacagccatcacctaatgaagtagaaagtataaaaaatactctcagtgggaaaccagcatcagtttacaagatttctatttactgtgagaagctcagtcctagagtgtacaaagcttgaaccagaactgttgaggtagaaatggacagaatacttgaggaattattcactcactctttaaacttttgtctttaattg

SEQ ID NO: 23616 - DNA, 447 bp, Homo sapiens
ggaaggcgaggagagcaggatttccctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactg

SEQ ID NO: 23617 - DNA, 348 bp, Homo sapiens
gagacggaagtgagcgacacactctgcgtcctcgcctcaccaggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaac

SEQ ID NO: 23618 - DNA, 419 bp, Homo sapiens
atagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgagg

SEQ ID NO: 23619 - DNA, 286 bp, Homo sapiens
ggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaat

SEQ ID NO: 23620 - DNA, 392 bp, Homo sapiens
  misc_feature 19: n = A,T,C or G
acccgggtgtttgagaagnaaaacatatgctttactcaggttccaataattaagccaatgcacttgatttaagttatacatttagctcattcttaaagtgtaataaagactttaagcctcctggctcccaaatcagtgcttttttctactaaacattctttctgtcttgctaaaaaaatccaattttcagaatcaagttagttgctaagcaaatatgcataaaaccatacatttatctgaattgtttctaatttaaggagtagtatataaaagtttcaacagaaatcattgattagtaaaagtgatggcaaatcagcaaaataaaaatagaattagagtaggctaaaaggcccttctttagggtaatcggaaaactgagttcaaatataggg

SEQ ID NO: 23621 - DNA, 371 bp, Homo sapiens
  misc_feature 3, 16: n = A,T,C or G
tcnggggaattcggcnttatggccggacctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 23622 - DNA, 401 bp, Homo sapiens
ggctgtagtggcttcgtcttctgtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttg

SEQ ID NO: 23623 - DNA, 429 bp, Homo sapiens
  misc_feature 20: n = A,T,C or G
agacaaagaaactttaaagncacagcagttaaaagcaacaaagagggatagtacataatggtaaaaggccttatccaacaggaaaatatcacaatcgtaaacgtatatgcacctaacactggagcccccagatttataaaacaattactaataggacctaagaaatgaaataacaacacaataatagtgggggacttcagtaatccactgacagcactagacaggttattaagacagaaagtcaacaaagaaacaatagatttaaactataccttggaaaaaatggacttaacagatatatacagaacaattcatccaacaaccacagaatacacattctattaaacagtgcatggaactttctcctagatagaccatatgatagcccataaaatgactctccataaatttgagaaatttgaattatat

SEQ ID NO: 23624 - DNA, 422 bp, Homo sapiens
tattcacaatagcaaagacaacgaatcaacctaattgcccatcagtggtagatggagtaaagaaaatgtggttcatatataccatgaaatactatgcagccataaaaggaacaagatcatgtcctttgcagtaacatggatggagctggaggccattatccttagtagaccagcaaaggaacggaaaactaaatgtcacatgttctcacttataagtgggagctgaatgatgagaacacatggatacatagaagggaacaatagacactcaggcctatcagaagatggaggatgggaggagggaaagcctcaggaaaaaataactaatgggtcccaggcttagtatgtggatgatgaaataatctgtaaaacaaacccccatgacacaagtttacctagataacaaacctcaacatgcacct

SEQ ID NO: 23625 - DNA, 187 bp, Homo sapiens
  misc_feature 6: n = A,T,C or G
aaaganaaaatttgaaatctggttaggctggtgttagggttctttgtttttggggtttggcagagatgtgtttaagtgctgtggccagaagcggggggaggggggggtttggtggaaattttgttatgatgtctgtgtggaaagcggctgtgcagacatcaattgttattattatgtcctacaagcc

SEQ ID NO: 23626 - DNA, 182 bp, Homo sapiens
  misc_feature 26, 163: n = A,T,C or G
taattggtgtttgtggtgtggtctanggttcctaccaccatttaaagcatttttgggaggaagtgtcttctatatgattgagtcaaacaaaataaatttaaaatgtagacaaagtagctattcacttttcaaatcatacttaaataaatagtatttaaaatanagcaaaggatgaggaaatc

SEQ ID NO: 23627 - DNA, 182 bp, Homo sapiens
  misc_feature 5, 12, 27, 100, 121, 127, 165, 170: n = A,T,C or G
atggnccgggcnttgaactaatcaagnaataaatcctaatgttctgggactttattttcacatgttaaatgctggaatatattatgaaaatgttttcaanaaatcacttaagtgttcatanaccagnatttctgacaggtaaaatgctaaaataagctacctgtnataantgtggattatat

SEQ ID NO: 23628 - DNA, 317 bp, Homo sapiens
  misc_feature 1: n = A,T,C or G
naggcattgaggcagccgcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagaga

SEQ ID NO: 23629 - DNA, 417 bp, Homo sapiens
  misc_feature 13, 18: n = A,T,C or G
ctaataaagtagnaaagnagaatcaaatagtatgcaataaaaaatgataaaggggatatcaccaccgatcctacagaaatacagactaccatcagagaatactataaatacctctaagcaaataaactagaaaatctaaaagaaatggataaatgcccggacacatacaccctcccaagactaaaccagaaagaagttgaatctctgaatagaccaataacaggctccggaattgaggcaataattaatagcctaccaaccaaaagaagtccaggaccagactgattcacagccgaattctaccagagctacaaagaggagctggtaccattccttctgaaacttttccaatcaatagagagggaactctccccaactcattttatgaggccagcatcatcctgataccaaagcctg

SEQ ID NO: 23630 - DNA, 276 bp, Homo sapiens
ggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagc

SEQ ID NO: 23631 - DNA, 294 bp, Homo sapiens
caatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatactta

SEQ ID NO: 23632 - DNA, 304 bp, Homo sapiens
  misc_feature 202: n = A,T,C or G
tccaaaaataggtcattcttttattttctaaagtatctaaactgtactaacattcagtgttgtgtttcattctaaatttgcagctgaaataaatttatttgcgatagcagaaatatcttattattcatcctcagaaataaaggatttgaagggatagagattatatgataaatttatagaagactttcagaatttgaatgcnttttgtttagtgctatgaaatgacaatagaaaaaagtctcgacttcaattaaaagttacacaaacaaacaaatctacaggcatgtctttatataccatcagg

SEQ ID NO: 23633 - DNA, 347 bp, Homo sapiens
  misc_feature 6, 29: n = A,T,C or G
cagggnaattcggctcttatggcccgggnatagtgaagctgactttgaatgtcattgagaatgaacagatggaaaatacccagagggcagagcatgaggaggggaaggtcaaggatctattggctgagtcacggttgagatacaaagactacatccaaatccttagcagcccaaacttcagcctcgaccagtactgcgaacagatgtggcacagggagaagcggagacagagaaacaaggggggcccaaagtggaagcacatgcaggaaatgaagaagaaacgaaatcgaagacatcacagagacctggatgagctccctagagctgtagccacgtagttttctact

SEQ ID NO: 23634 - DNA, 330 bp, Homo sapiens
gaatcccatgtagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaac

SEQ ID NO: 23635 - DNA, 314 bp, Homo sapiens
  misc_feature 229: n = A,T,C or G
gaaaaacaatacctacagtaacctgtgaggtaggacatgatagtgttttattggaccccttttactttatgaattggaaaaattaaatttgcatgtagtttgtaaaaaaaaaataaagaaaaaagaaattgattgagattatttcagcagccagaagtgtgggacaggcagggcagttattcctccttctcagtttggaaactgaagctcagagagtaaacttgtcagngacacagttattcaagaagttgtcttcagttgagagatatgtttttcacctgtagcttctggtattggagcagtacctttttaga

SEQ ID NO: 23636 - DNA, 343 bp, Homo sapiens
  misc_feature 1, 9: n = A,T,C or G
ntgataggnaaaggagtggttaacaaaattcaaggtagtggttattagggtgaaagttgtaagcttgaaataggcacatagaggggctacaagttactaatagtgttctatttctttaccattggtgtttggtttaatatttcctttcaccatatatatgctttaataagttatttgaaaggaaaaaagtgaattactgatccatactttgagtatcagatgacattttttaaaaatttcaaacgaactagccttctttcataagatctgtgccccaactctccctttcccaagaaatgttcttgattatttgaattgctgttgttttaactgagtgttacac

SEQ ID NO: 23637 - DNA, 142 bp, Homo sapiens
acagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccac

SEQ ID NO: 23638 - DNA, 374 bp, Homo sapiens
  misc_feature 367: n = A,T,C or G
agagcaatggaacagaatagagaactcagaaacaaatccatacatctacagtgaactcatttttggcaaaggtgccaagaacatacgttagggaaaagacagtctcttcagtaaagggcgatgggaaaactggatatccatatgctgaagaatgaaactagaccctacttctcaccatatacaaaaatcaagtcaaaatggattaaagacataaatgtaaaacctcaaactatgaaactactacaagaaaacatcagagaaactctccaggacattggtctgggtgaagatttctcacaagcacaggcaaccaaagcaaaagtggacaaattggatcacgtgaagtttaaaaacttctgcacagcanaagaaac

SEQ ID NO: 23639 - DNA, 339 bp, Homo sapiens
agaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagctatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattc

SEQ ID NO: 23640 - DNA, 305 bp, Homo sapiens
  misc_feature 286: n = A,T,C or G
tctaatagaagcagactctttcaatctgataagaaacatttacaatctagttctctcagaagcctgatatcttgaggtttcatctacttaataaacccttggtctccacaaccccttatcttaaccgaggtattcctttctattgatcgtaagcctttagacaattacttaactcaaccaattgccaatcagaacatctttgaatctgcctttgacttttgacttgcaagccctacttccagttgtcttgcctttctggacagaactaatgtacatcttgcatgtnttgattgatgtcttagtct

SEQ ID NO: 23641 - DNA, 414 bp, Homo sapiens
attgaaggcacatgaaagggtcctgaaggtgaaactctatggccatagcagtgtttcccaaatttgcttgaagataagatacaccaggaatgggtgattaaaaacagattccagagccctgagccaaatctgttataccagaatatccagagacatggcctagaaatctggtattcaataagcgctgtaggccagttgttctcaagctttacgaatacaccagaagcacctgcagagcttgttaaaacagacttgagaatgctgctcccctctcctctctagcttctgattcagtaagtctggggcggggcttgagaatttgcatttctaacattgagaatcactgctttaggctatgaaagtgcttctcaaactgcatctgcatcatctggaagcatagtcagattactagct

SEQ ID NO: 23642 - DNA, 448 bp, Homo sapiens
aaatttgatctgttggaagaacttgtggccaaagaagtgctacatgcattgaaagaaaaggttacttcactacctgacaaccataaaaatgcccttgctgctaacatagatgaaattgtatttacatcaacaggagacatctccatttactatgatgagaaaggaaggaagtttgttaacatcctgatgtgcttttggtatctaaccagtgccaacatccccagtgaaactttaagaggagccagtgtattccaggttaagttggggaatcagaatgtggaaactaaacaacttcttagtgcaagctatgagtttcagagggagttcacacaaggagtaaagcctgactggaccattgcacggattgaacactcaaaattattagaataattttcttggaaaaatcagcttatggactttagcagttgctgtgaaaaactaaggaaga

SEQ ID NO: 23643 - DNA, 323 bp, Homo sapiens
  misc_feature 321, 322: n = A,T,C or G
atagaaactgcagaagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatannc

SEQ ID NO: 23644 - DNA, 328 bp, Homo sapiens
ggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctg

SEQ ID NO: 23645 - DNA, 403 bp, Homo sapiens
attcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagattccgaagaggctcaatctgtaaatccttctagtgttg

SEQ ID NO: 23646 - DNA, 428 bp, Homo sapiens
agttttactccatttttgagaaggtctgaggtcaggaatgactcattgtaaggaagcaagctgttgcatatttaggacctgtcagccaagaaacttaagtgtccaatgacttttggatggcctttgaggtgggtctcccttgcccagaaatgctgactgtactgcgcttaagcaattaggcagcattgtagagcatagcttgtattacattttcccacacttagaaggttttcagacacaaaacccaaaggaattgtgtaacaattccggataaacacgcctagattgtttttacaaataataatgttgctatatttgcttaacgtggtgcttttaatgctgtgaatctagccctcctcttgaccaacttacttggaacattccttttttatcctgttaaccattttagtgaatcagaagcatgcctg

SEQ ID NO: 23647 - DNA, 391 bp, Homo sapiens
  misc_feature 387: n = A,T,C or G
ggtggcggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtntagc

SEQ ID NO: 23648 - DNA, 408 bp, Homo sapiens
  misc_feature 401: n = A,T,C or G
actccctctggttgatacccactcaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaactngtttctg

SEQ ID NO: 23649 - DNA, 473 bp, Homo sapiens
atttgttgaaatattactgtggcccttttttattttcagattggagttttaattatctgtgaaggagttaagagttcttgcttgggtcaagtgtttgcaaagaagattctttaaattctgtagctctcaaattttgagttatctgcacattagtttacaatccatgtagttatatgcattatcatatatagaaattaggaatgtgggcactggagtcaaactgtttgcttaccctatttctacctcttattagttgtgtgaattagggcaaattacttaatctctgaggttctgatttttgccccataaagaggggattaaactattgtttatcttatttaaagttcacggctgggcttgttggatcctgtttgtaatcccagcactttgagaggctgaggaaggaggatcacttgaactcaaaagttggagaccagtttaggcagcatagtgagactttgtctgtaatttat

SEQ ID NO: 23650 - DNA, 365 bp, Homo sapiens
ggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaacgagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaaggga

SEQ ID NO: 23651 - DNA, 250 bp, Homo sapiens
cagccttgaaggctacaagtgatgagaaagattctttttcgaatataaccagagaaaaaaaggatggagaaatatctaggacagtgacttctgagaaaccagcaggcttgaaggctacaagtgacgaggaagattctgttttgaatatagccagaggaaaagaggatggagaaaaaactaggagagtgtcttctcggaaaaaaccagccttgaaggctacaagtgatgagaaagattctttttcgaatat

SEQ ID NO: 23652 - DNA, 363 bp, Homo sapiens
  misc_feature 285, 288, 318: n = A,T,C or G
cccatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaaccctctataatctttaaaatatggtgagcatcttgtctgttttgaaggggatatgacaataaatctatcagatggaaaatcctgttacaaagtagaaaagctttagtaatttactcagtgtggnggntttatcctttttttctttttctcccttggnctataatgaaattgttacagcagtgcaaaataaaatcctatgtat

SEQ ID NO: 23653 - DNA, 410 bp, Homo sapiens
  misc_feature 360: n = A,T,C or G
gatttctgtcaagttgtaagttttaaaagagtaaagtgttttggttagtaatgatgtggagaaaaatacagtattgcatgtgttcgtgtgtatagattgtggttcgaggattgggagggctctgagaagcagagtactacatcaaaattgttttaagtattttttgccaataaaaaattaattttatggaaatggcttgtgctttgagaagcccagttttattctgtcttatgaaactaatttccactttgaaaattgttcttctgttgtttatggtataaatgaatggaatataatgatatcctccttctaggaaacaaagcatttccttaaaatgtttgctaggttaagctgtgctgntctactgatggttgttttaaattaataatgagaactataatttaaataat

SEQ ID NO: 23654 - DNA, 453 bp, Homo sapiens
aacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttg

SEQ ID NO: 23655 - DNA, 469 bp, Homo sapiens
gagataaaatgaagcaggaattagaggccaagatggatgaacagaaaaatcatcaccagcagcaagttgacagtatcattaaagaacacgaggtatctatccagaggactgagaaggcgttaaaagatcaaattaatcaacttgagcttctcttgaaggaaagggactagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaact

SEQ ID NO: 23656 - DNA, 307 bp, Homo sapiens
  misc_feature 104, 110, 140, 220, 269, 275: n = A,T,C or G
gaaggcattgaggcagccagcgcaggggcttctgctgagggggcaggcggagcttgaggaaaccgcagataagtttttttctctttgaaagatagagattaatncaactncttaaaaaatatagtcaataggttactaanatattgcttagcgttaagtttttaacgtaattttaatagcttaagattttaagagaaaatatgaagacttagaagagtancatgaggaaggaaaagataaaaggtttctaaaacatgacggaggttganatgaancttcttcatggagtaaaaaatgtatttaaaag

SEQ ID NO: 23657 - DNA, 320 bp, Homo sapiens
  misc_feature 9: n = A,T,C or G
gcacaaagnacagaagtaaagctttatgctaattttatttcaatatgatagaaaatttatcttggtatgtccttttttagataactccagcaggaaactgtaactgctatgtctttaggaaaatgtagaagaaagaacattattattctttaattcctacaaggtactcgaaaaccttaagtgaaaaagatttctatctttttatcttagcgcatttatggaaaaaatattaactatcctgaatattttataattttgtaggaaaaatatgcatctattttttcttgacttcttttatatagtaataaaagttattttgc

SEQ ID NO: 23658 - DNA, 425 bp, Homo sapiens
gaagtaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggaga

SEQ ID NO: 23659 - DNA, 238 bp, Homo sapiens
gggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtaccca

SEQ ID NO: 23660 - DNA, 375 bp, Homo sapiens
atttgtgaagaaatgaattttccgtttcaagtacctattcaaaattttattaaaaaccagcaaattaattttaatctctagccctaaaaacataagtaatagtaagctcctaagcttggacaaaggctggattctcttcactataactgagtggtaatttaaagacaacaatttaatgtcactaattttcaaaattaaatagtttaagctcaatttaattttgctagatatttaacaaaacatacggctcaacctcataacctatatgtgtgtatgtctacatctgtgtatatatcataggatttgagaatcttaacacatgtataaataagtatatataaactccaattttaaatcttaaaattgctgaattta

SEQ ID NO: 23661 - DNA, 367 bp, Homo sapiens
atgcttctcattcccttgactcatgtcttgccaggatggttagatacacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacatg

SEQ ID NO: 23662 - DNA, 462 bp, Homo sapiens
gtttgttgttgttgttgaagacagtaaaataagtgttttcaaatctatatgtctcctttttgctggataatgtttcttctttttaatggtaaatattcttgttcttcaacatttttctttggttcttttttccttttttaggaaaaacaaaacaacagacttcatccttaggttttctcaagatttaagtgaacacatttacacatatcaatttcttaaagaacacaaaatgtttcctccctagcaaaactatttaagagccaattaaactatgaaatagttataaaattatttttaatatttaaggccttgaaattatattccaaggcaaatctaaatgggtgtagttgtatatgcacgatgtaatttaatgctaaagagtacttacagcttgagggaaaagcataaagttttagttaaatagccttcatactgtggatttttcctcctactaactaatat

SEQ ID NO: 23663 - DNA, 467 bp, Homo sapiens
  misc_feature 8, 28: n = A,T,C or G
agtcgagnaatgggaatagggagcaagnagtgaagaggtgatagggagtgacatttatctgaatggacttttttggtgtagttctgatttttggaactgtgttaatatttcacatactcaaaacgtaaataattgaagtgaattagagtattcagggtaccccacatgaaatattaaaaaatagcaagaaaacttaaccatattcttaggaattacagatgaaggaagtggataaaaaagagctaatctaagtaactgccaaacagtaattggcgtttatactctaaaattttttaaaaatgaacaaaaaagaactgttgtactcttatcagaatatttgtatttcacaagatatgggtgagtgattcaattttttacaggggtgagattaagcatttccaaaactgattcaaatgtctcctaggattgtggatgagggctattttctctctgtcaaagaaaggaag

SEQ ID NO: 23664 - DNA, 480 bp, Homo sapiens
tattgttcatccaagaagggtttttgtgactgaatcagcagtgcctgccctagtcatagctgtgcttcaaaaacctcagcatgattagtgttggagcaaaacaaggaagcaaagcaaatacagtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtg

SEQ ID NO: 23665 - DNA, 473 bp, Homo sapiens
  misc_feature 439: n = A,T,C or G
caaaggatgtgaatttaatctaacttatttaacaattgcatcttcataaggtgatagttttgtggcattttggtaaatcttttaaaactaaatgttttgggtcccttgtccccccagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtaaatgaaactttacataattgttttcagttggctactatccatgtggnatatttgaggaatattctcttttaagagttgtgg

SEQ ID NO: 23666 - DNA, 473 bp, Homo sapiens
atagtcagtctgggatatggcatcgtcaagcccgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttt

SEQ ID NO: 23667 - DNA, 245 bp, Homo sapiens
agattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagttt

SEQ ID NO: 23668 - DNA, 464 bp, Homo sapiens
gaaatttctagatttatattttaacaggatcactttggttcctgtgtttagttgagaataaatgtcctatgtacgctttgtaaattttactttagttccttggaggaaaaacaaacacagataaaatggtttagagcctatttgcgatttttgatgtatattctgaggaatgaggagagacaggtgttcatgctttcatggctttgctattgctatcacatagggactcctactccatcttctctgtcagtgctgacttttttcatttattcaataagtattgaatgtgtaagtcattaattgtattgacaggatgaatcagacataggtcctgccattatgatgtttacagtctagccaggagagaagctgtacatagaaactttaaatccaagatagagattgaaaataaacaaaaatggctgagcacagtggctcacacctataatcccaacactttggga

SEQ ID NO: 23669 - DNA, 465 bp, Homo sapiens
attgaacaaatatttactgagtgcctgttatgccattctaggcacagggggatactattctcgttgagcttaacttctagtagggaacacaatagacaagtgaaaaaataaaaacaagataatttcaggtagtggtaataaagaagaaaataaaatagggtaatgtgatgagaggaataggctagaagtggaagtggcttcagattgggtggtcagggaagactcctctgaagataacttcatttgctaggagacctaaatgacaagaaggacccacctataaaaagacctgagggaagaaagagctttctaggctgaggaaagagcccaatgtgtttgtggattagagttaaagccctgagtgactaaaacatcaggattgagaagattgttagagaaggtcagggaggtatgctgaggccatggtggtcatgatgaaaaggttgattttactcagatagcaat

SEQ ID NO: 23670 - DNA, 196 bp, Homo sapiens
atgggctataaaactttaataacctatgtcttcaaaattgagtgattttgtagcaccaccaccctgccctcaacatacaaacacaaccacacatttacaaagaactaaagaagagatgaggttaaataagggtaaggggtaggaaaaataaaataaaaagaaacttataaggacaaatctataaaataagtaggag

SEQ ID NO: 23671 - DNA, 464 bp, Homo sapiens
gatatatacagggttatatagaaagatttcttttttagattgacccactgtattgtagactaaaattcatattttatggtataactgttatagtgaaaatacatctaaaatcacaattaagagtatatcctaatgtgttctggaaacaaagccatgagtgcatattttacatagggatctgtaaatttttgctgatgaccgaactgtaactcatattcctatattcaaggctaatttttggattatgtaaataagacctctctaaattagaagtagaattcataaaatatgactttctcatcatactgcaaacattttgagaaacgtaaatatactttgatttactatgaatttcataatcaagggagaagtatattctaaaactaatgtatttttttgcttagtcttagaagcataaacaaaaatagagtctaggaattcaataattatctgtgttgctgtcg

SEQ ID NO: 23672 - DNA, 466 bp, Homo sapiens
ggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatctcggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatac

SEQ ID NO: 23673 - DNA, 380 bp, Homo sapiens
  misc_feature 1, 2: n = A,T,C or G
nncacaattctcggctgattttttttgtatttttggtagagacggggtttcaccgggttggccagggtggtctcgaacgcctgacctcggatgatccacccacctcggcctcccagtgtgggtgggattacaggcatgagccaccgcgcctggcctcagaggctatactcttataattttgttctgaggggagacagggaaagggttagacaacttgaaacattgaccctgtataaaaatgcaaaattctcaatgtgtatttataaatttctattttttataactttatgggacttcttagaggccaaaagtagtaaacatgcagattaaaaatgtttatgaaaatctcaataaaaattcataataaaaactttgtaaat

SEQ ID NO: 23674 - DNA, 461 bp, Homo sapiens
  misc_feature 24: n = A,T,C or G
ggcgcaatagtatatagtaccgcnagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 23675 - DNA, 471 bp, Homo sapiens
gtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttggg

SEQ ID NO: 23676 - DNA, 469 bp, Homo sapiens
  misc_feature 465: n = A,T,C or G
gtgttatcaactgatgattttctggagtttttgacccattaccatttaagatatacagagaattttatggtagtttagcccactattctgagctaaacaggtctaactcagaacttctatattttaaaaaaaaagattatttgtattacaaggaaatccttaaattattgacaggtatttaatttgcccagtaaggtgagaagtaccatattattcccttatactatataatataaagagaacaggtattcaaactggaatacaaaagtaatgaagcctttttatgcattgcactcatcattccctccttcagaggtggtgacctgcagccatgatggaaagttctctctgcccctctgccctctgaggtcatgtctggatctgtgccattagaacttgggcctgttgggagaggaggcggaggcctgaaagcaggttacataaagctttcagtaatgggtgggntttt

SEQ ID NO: 23677 - DNA, 344 bp, Homo sapiens
gacaagatctgatggttttaaaaggaaatttccctacacaagctctcttctcgtctgccaccatgtgaggcatgactttctttcaccttctgccatgattgtgagacctgccccagccacatggaactgtaagttcattaaacctcttaaattgcccagccttgggtagtctttatcagcagcataagaacgaactaatacagacgcctctctgaaattttagaggtttgtattattgctaggaaaattagaaaaaataaccaatctcccctttccagattcctcctgcgagtggactgcatgaggagatgcctgtaagaaattgtgggtagatacctcaggac

SEQ ID NO: 23678 - DNA, 248 bp, Homo sapiens
cactgaacagacgtcctgcgtttaatttagtgctattgaagggcatttaggttacttttaaacgtttactgttcctgactgtgctttagtgaaaagttttctatctgtgctatttttgagtatatttgtaagatcagttcctacaaatgaaatttctgtatcaaagggtagatgctattgttttaatgtgaaataagttatagacacaaagagttataatttatatgtaaggaggaaagaatgaaagc

SEQ ID NO: 23679 - DNA, 242 bp, Homo sapiens
gttgaagcaagtcagtatccgagaaaactgctgttccctttgttgtgatgaggtagcagacacacaattgaagccatgtggacacagtgacctgtgcatggattgtgccttgcagctggagacctgcccattgtgtcgtaaagaaatagtatctagaatcagacagatttctcatatttcatgacacatgtgaagaggcatcgtggacttttttctactcaattccagccaatgttgaaaag

SEQ ID NO: 23680 - DNA, 353 bp, Homo sapiens
  misc_feature 208, 295, 351: n = A,T,C or G
gaaatacattgtaaggtagggaggccatgacagcaagacataaagctatttaatctgaattggccgggtgcagtggctcacacctgtaatcccagcacttcgggaggccgaggcaggcagatcatttgaggtcaggactttgagaccagcaacatggtgaatccctgtctctactaaaaattaaaaaaaaaaattctccgggcatggnggcgcacacctgtaatcttagctgctccagaggctgaggcaggggaatcgcttgaacttgggaggcggaggttgccggtgagctganatcacgccactgcactccagcctgggtgacagagcaagactctgtctcaaaaaaangt

SEQ ID NO: 23681 - DNA, 464 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcggtcttttaaaaagagattaaac

SEQ ID NO: 23682 - DNA, 410 bp, Homo sapiens
gggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatat

SEQ ID NO: 23683 - DNA, 328 bp, Homo sapiens
  misc_feature 5: n = A,T,C or G
acagnaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcaccca

SEQ ID NO: 23684 - DNA, 472 bp, Homo sapiens
  misc_feature 11: n = A,T,C or G
acgagaaagantcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgctttatttgaaggaaacctgtgtgatttaaaaagttatagcttttgcaactttattactggttatatacatttggccattatgatgtgcaagcaattggaaaaaaagtcaagtaaatgct

SEQ ID NO: 23685 - DNA, 202 bp, Homo sapiens
  misc_feature 202: n = A,T,C or G
atttctgcatttttaaaacagtttggccataatcctagatgcacgcttctaattcatgtacctgcacatgtgacctttgtgaacaggaatttgcatgtataatttgtgtttacttgtaactttctggttatatactgcttatatctgtggattcaagttactgaagtgaataccaataaaaagaaaaccctaggccatgctn

SEQ ID NO: 23686 - DNA, 367 bp, Homo sapiens
gggtggatcacctaaggtaagtagttcaaaaccgcctggccaacatagtgaaaccccgtctctcctaaaaatacaaaacattagccgggcatggtggcgcatgcctgtaatctaagctacatgggaggctgagttaggagaattgcttgaacctgggagatagaggttgcagtgagctgagattgtgccattgcactccagcctgggcaacaagagtgaaactctgtctcaaaaaatatatatatatagatttatatatattatattaattgatattaagattagattaagattagattaagattaatcttaagattagattaagattaattttaagattagaaaaagattaataattagattagat

SEQ ID NO: 23687 - DNA, 309 bp, Homo sapiens
gagctcaaacttgagagtgcccttactgaactagaacaactccgcaaatcacgacagcatcaaacgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactac

SEQ ID NO: 23688 - DNA, 226 bp, Homo sapiens
gaggcattgaggcagccagcgcaggggcttctgctgagggggcaggcggagcttgaggaaaccgcagataagtttttttctctttgaaagatagagattaatacaactacttaaaaaaatatagtcaataggttactaagatattgcttagcgttaagtttttaacgtaattttaatagcttaagattttaagagaaaatatgaagacttagaagagtagcatgag

SEQ ID NO: 23689 - DNA, 472 bp, Homo sapiens
  misc_feature 20: n = A,T,C or G
gaagcaattatattttaatnttttcttttaataattacatttgaaagtactgtgttaaaatcgcttaaactggcagaagcggacttttaggtcatatgcacagtggggtgcagactctgcattttaagattcagtggagtgtttgactgttctgctgtacactggaggggaaagagaagggtaagaagatgaagcctttactttgcttctcgtagcttgcagagaaggatgggggcaggtgagcagagacagctattcccagattacagccaaatacatattttgaaaatgatgaatggaatttcagggaatggggccctgtaagttccctgaggtcaggtaccgtgtcttattctttactgttttcctaacatgtgatttagtgcctggcacatagtaggtgcccagcaaaaatatttgttgagtacatatgtgaattaataagtaggtaatgcatggaatgaaacatgtc

SEQ ID NO: 23690 - DNA, 395 bp, Homo sapiens
atatctgaaatggttagaaccgaattgtttcaacttggggggttttcggattttggaatatagtcaagcatggcttaaccacagggatgtgttctgagaaatgcgctgtcaggcagtttttcctgtgaacaccatgtgtacctacatggacctaaaaaacaggtggtggagcctcctccacacctaggctatatggtgtatgtagcctgttgctctagactggagggcacgttactgtactgatactgtaggcaactgttaacacaatggtatctgtgtatctgaacataacatagtaaaggtacagtgcaaactgtgttctaatatgtggcccctcattgactgaaaagagattctctgcttgactatttgcattgtatttgctggttaagtat

SEQ ID NO: 23691 - DNA, 431 bp, Homo sapiens
  misc_feature 10, 419: n = A,T,C or G
agcttcaagnaattagcattgcaaagtgaacaggtcctagaaggtgcacagaagacattgctgttagccaatgaaaaagtaaaagagttcacatacagcagttcctactagagtcaacagagaaaagtacaaaaatataactgcccagaaatcaagtagcaatattattttattacgagaacggattatatccttgcaacaacaaaacagtgtacttcagaatgccaagaaaacagcagaattgtctgttaaagaatataaagaagttaatgaaaagctcctccatcaacagcaagtatccgatcaacgatttcagacaagcaggcagacaataaagaagctaaatttggatttggctgggcttcggaaagaaaaagaagatttactaaagaaattggagtactccagagaagaatggnaaagaaatgttg

SEQ ID NO: 23692 - DNA, 432 bp, Homo sapiens
  misc_feature 429, 430, 431: n = A,T,C or G
gctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttattttgtggcccgagtgtaacaaccatataataaatcacctcttccgctgttttagctgaagaattaaatcnnnt

SEQ ID NO: 23693 - DNA, 462 bp, Homo sapiens
  misc_feature 137: n = A,T,C or G
gatagataagtagtacatggtggataacttctacttttaggaggactactctcttctgacagtcctagactggtcttctacactaagacaccatgaaggagtatgtgctcctattattcctggctttgtgctctgcnaaacccttctttagcccttcacacatcgcactgaagaatatgatgctgaaggatatggaagacacagatgatgatgatgatgatgacgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaaaagaaaatgatttt

SEQ ID NO: 23694 - DNA, 472 bp, Homo sapiens
  misc_feature 463, 470: n = A,T,C or G
ggaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatccatctggctggagggaaggaaagaacttgcatgttggtgaaggaagaagtggggggggaaaaaanggggggngg

SEQ ID NO: 23695 - DNA, 472 bp, Homo sapiens
  misc_feature 57, 62, 460: n = A,T,C or G
ggaactcggtggtggccactgcgcagaccagacttcgctcgtactcgtgcgcctcgnttcgnttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccccttttcacatcaaagaactactgacaacgaaggccgcgcctgcctttcccatctgtctatctatctggctggcagggaaggaaagaacttgcttgttggtgaaggaagaagtggggtggaanaagtgggggggg

SEQ ID NO: 23696 - DNA, 337 bp, Homo sapiens
gcatgtggatgaagaggtgtttaagcgagcatatattcctagaaccttgaatgaagtgaaaaattatgagagggatatggacataattatgaaattgaaggaagaggacatggccatgaatgcccaacaagataatattctataccagactgttacaggattgaagaaagatttgtcaggagttcagaaggtccctgcactcctagaaaatcaagtggaggaaaggacttgttctgattcagaagatattggaagctctgagtgctctgacacagactctgaagagcagggagaccatgcccgccccaagaaacacaccacggaccctgacattgat

SEQ ID NO: 23697 - DNA, 210 bp, Homo sapiens
  misc_feature 1, 6, 21, 22, 25, 33, 40, 64, 149, 161, 171, 184, 196: n = A,T,C or G
nccccnggggaaattttcggnntcntttatggnccggggncctttttcgggccgggaaccgccntctttccagttatttcgcccaaaatggaccgaaccccaaaggggaaaggaggggagggccccccgatttttttttttcctttttngggcccttttanaaaaaacctngggggggtggttnccccttttgggncccccctttttttt

SEQ ID NO: 23698 - DNA, 237 bp, Homo sapiens
  misc_feature 10, 182, 207: n = A,T,C or G
cagtgttggngggaatgtaaattagtacaacaactatggagaataatttggagttcactcagaaaactaaagatacacttgccatacaatccatcaatcacagtgctgggtatatatccaaaagatacccatgtcgattgcagtactgttcatagtagccaagatttggaagcaacctgagngtccatcagcagataaatggataangaaaacatggtacatacacacagtggagta

SEQ ID NO: 23699 - DNA, 470 bp, Homo sapiens
aaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactc

SEQ ID NO: 23700 - DNA, 469 bp, Homo sapiens
ggcagccgtgcgatgttgtcctctacagcctgtattcggctcctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaaagaaggaaagggggctgtatacagctttt

SEQ ID NO: 23701 - DNA, 471 bp, Homo sapiens
ataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttc

SEQ ID NO: 23702 - DNA, 471 bp, Homo sapiens
ggacaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaagaccgcgcctgcctttcccatctgtctatctatctggctggcagggaaggaaagaacttgcatgttggtgaaggaagaagtggggtgggaagaagtggggg

SEQ ID NO: 23703 - DNA, 361 bp, Homo sapiens
tgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatatttttttcg

SEQ ID NO: 23704 - DNA, 468 bp, Homo sapiens
gataagcatttgtgttcaatgagacatgtttatttaactggaaatctagagctccctctttttaagtcaggaagcatatagaccaaaaaaattacagtgattattactggattctgagattacgattatgagtgatatctttatctatgtctaaaaatattaattatgacaagttataaattggtacaattactttggaaaacaatttagtatcatctataacctggcaatactacttctaggtatatattctgagaaacgctttacatttaaaaattattgaggacctcagggagcttcagtttatatgagttatattttttgaaattttccatattaaaaattaaaactgactgggtgtggtggttcatgcctgtaatccagcattttgggaggccaaggtgcgaggatcactttaggccaggagtttgagaccagcctgggcaacgtagtaagaccccatctcta

SEQ ID NO: 23705 - DNA, 469 bp, Homo sapiens
  misc_feature 10, 15, 468: n = A,T,C or G
actccacagnacagnacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcacttttctcaggctgcccccatcccagaagaggacacagacactgaagaaggtgatgactttgaactacttgaccagtcagagctggatcaaattgagagtgaattgggacttacacaagaccaggaagcagaagcnc

SEQ ID NO: 23706 - DNA, 466 bp, Homo sapiens
  misc_feature 4, 5: n = A,T,C or G
aagnnaggattctaatttatacctattgctccctgattttaaattttctatacctatggaatctgttgcttccttattttaaatttacttctatctaacattgtggttaacttttaaactcctttcacacttttaacacttcaaagaatttgaattattgattaaagttaaatgacaaattattaaattctttttttaaattcattttttcccaatggcatggtatatattttctttcttttttttccatacttatcttagatacagtaaaaacttatatttcctgtttggtatattggcagatttggagctctttatggtttttggctaacagttaaaagtaaccctgagtgagactttatgatttgtaactggttgccttattattaggaaaagaatctgatttatccgtgacatctatgaacataaatatatgtttgtatttggacattataagttctattca

SEQ ID NO: 23707 - DNA, 196 bp, Homo sapiens
  misc_feature 1, 162: n = A,T,C or G
ntagtgaaaccctgtctctactaaaaacacacacacacacacacaaattagctaggcatggcggcaggccctttgtaatcgcagctactcaggaggttgaggtagaattgcttgaacatgggaggcggaggtttgcaagtgagccgagagcgtgccattgcnttccagcctgggcgacaagagcaaaactccgtct

SEQ ID NO: 23708 - DNA, 471 bp, Homo sapiens
  misc_feature 442: n = A,T,C or G
atagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggggggatacaattggtgtcatgatcggaatgtggttaccattttcagtgcacccaattactgttatcgttgtgggaaccaggctgctatcatggaattggatgacactttaaaatattccttccttcaatttgacccagcgcctcgtcgtggtgagcctcatgttacacggcgcaccccagactacttcctataaatttctcctgggaaacctgcctttgtatgtnggaagtatacctggctttttaaaatatat

SEQ ID NO: 23709 - DNA, 129 bp, Homo sapiens
  misc_feature 1: n = A,T,C or G
nctcaaaaggacacttctgattaagacggttgaaactagagatggacaggttatcaacgaaacttctcagcatcacgatgaccttgaataaaaattgcacacactcagtgcagcaatatattaccagca

SEQ ID NO: 23710 - DNA, 347 bp, Homo sapiens
  misc_feature 303: n = A,T,C or G
ggctaacatgatgaaaccttgtctctactaaaaatgtaaaaattagctgggtgttttggtgcagacctgtaatcccggctacttaggaacctgatgcaggagtattgctcgaacccaggaggcagaggttgtagtgagctgagattgcatcactgcactgagccctagacgacagagcaagactctgtctcaaaaataaataaataaaatgtaatttttatcgtagagtaccaaattccattctatgggtagtggatttatgagtgatttttactttatactttatatatttctttatagttngcttttattttttaaaccaggaagcagtctcactttataattgg

SEQ ID NO: 23711 - DNA, 464 bp, Homo sapiens
  misc_feature 97, 221, 254, 336, 353, 424, 442, 457: n = A,T,C or G
gggtgtaaagaagtcgccgtagccgtcgcggccgggactccccgggctctcgcccttcaggtttcgttgacactcaggaccgtacgtacgctgcgcnatgttcaagaaactgaagcaaaagatcagcgaggagcagcagcagcttccagcaggcgctggctccttgctcaggcgtcctccaatttcttcaacaccaacaagaatgaggagcagggacattntttcattttacaggagcaacttggatgaaggtncaccccaataggagagaatgcatcttacttcatgccctcgaaatctcctggacagtggttaatgggaagtgaacccaaagcntttccttcagtcagggngacacacagtctttttgcacaagaagctccagcttccgggggcccctccggggagtcttttgtttcgaagnccgataaaggaatctttnttccgggcttttttntaaagag

SEQ ID NO: 23712 - DNA, 316 bp, Homo sapiens
  misc_feature 14: n = A,T,C or G
tgaccctagtgatncatgataaacagggtgtgtgtgctggtagcagggtgtgatgaccacgtgatacggttactagacagactgtgacaatggagatcaagagatctagattctagttccagctctgtcactatctagctttgtgactttaggtaaatctctgcacctcactttgctcatttataacatggggtccataaactttgctctctgaacttcatagggttactgcaggggattgaaagagataatggaaataaatgggttttggaaaattacatgcaaatatcaaagactgtgatttgttacttttgga

SEQ ID NO: 23713 - DNA, 456 bp, Homo sapiens
gatggtatacagaagtttaggtgataaaatttaactgagctagtcttctaagaaatatcaagtatttcccatgttctatccctccgaagattgaaaagaggaagaacatttctggtctatagctttggttggcatttatagcggtgagctatattgatctgctgctgcatattgtgtagcaaaaaataatcattcattttactttagcaaatgtaagcgagtctccaactactagattgtaaaagaagagccctatgtactagttgtctttttcatcgtctctgttagtataaatgtttacttacttgaataaggtaagtactgtacacatcctgtgaattaataagataaaaaatactttggaatcataaccaaatgaaatagtgctttttttatatcatgcacagaatggtgattcagatatgttggtataaagaatgaggaattctttctatt

SEQ ID NO: 23714 - DNA, 328 bp, Homo sapiens
gggtttgatggcgaatatcaagatgacagcttagatttgctacgctatttcaccgttacctgttattctggttatggagatgatgaaaagggattttacacggtgtatcgtaatgtttttgaaatgattgccaaggaagaactagaatctgtgttagaggaagaggttgatgatttcccaacttttggagactcccagagtgactatgatacggtagtccatcctttctacgcttattggcagagtttctgcactcaaaagaattttgcatggaaggaagaatatgatacacgacaggcttcaaaccgctgggaaaaacgagccatgg

SEQ ID NO: 23715 - DNA, 414 bp, Homo sapiens
  misc_feature 2: n = A,T,C or G
anatgaaggaaggaaaaattgagataattcacctagaattgcctcaatttttgttgagtgggcaatgaagctgtttgttgagaaagttagaagtatatttgagaatctgaaagggcttgaaaagttaggatgtagactgggcatggtggctcatgcctgtaatccctgcattttgggatgctgaggcaggtgggttgtttgaactcaggagttcaagaccatcctgggcaacatggtaaaatcccatctttattaaaaatatagaaattagccaggtgtggtggcactcacctgtggctccaggtactcaggaggctgaggtgggaagaatttcttgagcccaggaggcagaggctgcagtaagcagaaatcataccattgcactccagcctggatgacagagcaggaccttgt

SEQ ID NO: 23716 - DNA, 474 bp, Homo sapiens
  misc_feature 12: n = A,T,C or G
attgctaaaaantaaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagccttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacatt

SEQ ID NO: 23717 - DNA, 379 bp, Homo sapiens
  misc_feature 12: n = A,T,C or G
tatggccggganggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggagggcgaagaaagctgtacattgttgcttgagagtctgtacatttagtccagatttgtatttgcactgtcagtatggcaaatgagtgaaaaatgtttaatacactattgg

SEQ ID NO: 23718 - DNA, 449 bp, Homo sapiens
  misc_feature 3, 19: n = A,T,C or G
tantggcccgggggttaanctgtctgttttttggggcctgggcccaatcctacttctatagagaccagattaaatgaaactctgccttctgaacaagccagacaatctctgccacattgcatttgagggttgctcataccattataggaaaataaagcccaggggcttaatgtcaaaggctggaaaaggcactcatgctctgatgtttgttgaaactttaatgaatgaggctgccctgaattagcctctttcctttcagaatgcaaggccatcagggtagacaaagatttcttaaatttcttaaaacctcagaaacactatacatcaaagaaaaaattgacacaatggatttcaattattttgggtatattacaccttaggagtggaattactggatcatatggtgatcctatattaaactttttgaggaactaccaaactgctttcca

SEQ ID NO: 23719 - DNA, 327 bp, Homo sapiens
agttaagcacaattttatgctggaggcttgcttgcacagttaatttgatcaggttgtagtaaggctatataacagtttttttcaattatgatttaaaataatgtttatattgtactaagagaaaagataacagaaaacaactcaaggaaaaaataatctgccaaatatgtgtctttccagataaaaattttgttattaaactagtttggtggatcacacacagggatgcggacagatgcaatatatattataaagaaagaagtacaatggctttttgccaggtgtacctgcaaacccattttagcactaattcacataacatagact

SEQ ID NO: 23720 - DNA, 461 bp, Homo sapiens
  misc_feature 354: n = A,T,C or G
gagtccgagtggagagagcgagctgagtggttgtgtggtcgcgtctcggaaaccggtagcgcttgcagcatggctgaccaactgactgaagagtagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataangatggcaatggctatattagtgctgcagaacttcgccatgtgatgacaaaccttggagagaagttaacagatgaagaagttgatgaaatgatcagggaagcagatat

SEQ ID NO: 23721 - DNA, 358 bp, Homo sapiens
  misc_feature 44, 68, 183, 232: n = A,T,C or G
gaatatcattaaagtttgaggataaataaaaacatttttagatntacaaagactcagaaaattttccntccacagcattctcccttaaaacaattaggaatagtattaatactattccatgcagaggaaaatgaatccaagaggataaagtattctacaaaagatttgatgggcaaagaaatntgtgagacatattgttaattttaagtagtgctatggcctgtgtgtttgngtccctccaaaattcatattttgaaatctgaacccataaggtgacggtattatgaggtggagtctttggggaggtgattagatcattgaggtctccagtctcaggaataggattagcgcccttaag

SEQ ID NO: 23722 - DNA, 471 bp, Homo sapiens
attgtcttctaagagcagaaagagcaaaaagctaagggcctctactgggataatatataataaatatttctattgggaaataatcacatttgcacctcatatctctggaagattttagaaacaggagccacaagctgcctttaaaaagctgggtgcaaaatatggctgaaaacataaagattcattgaaagtgtttaaaataaattatattcccagatccttcccatactgaactcagccctgggttgaacccaagaagctctggactcagagatagctggagctaagagatgtatgaggcatcattctaaaacaggaaactattttagaattaaataaagcctcttctttgaggtgtgagatacccaggctcctcccttcttgaatcctagaattagaaagggagtttgtaaacgtaatttctgcagctattggcacaagagaggagctcttcagagactgacattttgg

SEQ ID NO: 23723 - DNA, 356 bp, Homo sapiens
gtcatgtaaatttgttgcacttttttgggctgagctgttagaggggcttctccagaggctcgagagcaggccatttcccaagaagatgaagaatggtgactgtgtttttattgaaggaatttcaaatgaagaataatgtttaaaatgtgtatatagagatagtatagactcctccgcggaagcatggagggaaaggaggttgtaaaatagactccatggagactcttaggaagcagtagattcccgggggctgtgcctttagcgttagaggaaacacatagagctggaactgttaatggaaagcagtcacagctgagttttcggagaccaagaaattaaaatacaattgcacttat

SEQ ID NO: 23724 - DNA, 110 bp, Homo sapiens
  misc_feature 110: n = A,T,C or G
gttttcaccagcaagtatttgttgcaaacttaatgtcattttccttaagatggttacagctatgtaacctgtattattctggacggacttattaaaatacaaacaggcgn

SEQ ID NO: 23725 - DNA, 426 bp, Homo sapiens
tggcagaggcttggttgtcatttagcctttagggtcttagtggagttaatgagaactgcaaatggtcatcaagtcttggtgcttcatggagaagcaacacttttacagtgagtgtgttagcttagtggttatggtattactgcagggacatggatcacttagggagagagcgtttcaggcttgggtcagtcttaaagcagatctcatgtggagggtttctgctaacctgcatctcttacaacacagtactagtcagtatgctgtagtattaatcagtaggtcaagttcagtgaagtaaaggagaattgaattcttgaagttcacatttaggcaaaaatttggcgttttaggaggtgagtataagacatgatctttatagaaaacgctgatgataaaaacagcgctctctgttaggtgcctttatgc

SEQ ID NO: 23726 - DNA, 361 bp, Homo sapiens
tagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacttcct

SEQ ID NO: 23727 - DNA, 318 bp, Homo sapiens
  misc_feature 11: n = A,T,C or G
gctggaacagnatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctcc

SEQ ID NO: 23728 - DNA, 473 bp, Homo sapiens
gcatgaatgtttttatgtagattttcctcccatgaacatgagtaaataaatctgtttcctgaatggattgtggttgcatttaaagctctgtaataattctaataaatttactctatagagttctgtgtgtggaaggtatagaacaattggaagtccatgaaaccataactataatcatatattattcagacaaaatattgtaataaaagtaggtcctttctttcatcaaaaacatatctgaaaattttcagatgctttaatattaaaagatgacaatgttatgtatgcacatttttaagttaggttggatatgcaaactgtacaaaactataaatccaaagagtttgtaaagtttaaactcaaacactggtggtataaatagaacttgcacttctaaattaaggaagatacctaaatggtctaggatgagatgatatattattttaaaagaggggactatctcccaaataaca

SEQ ID NO: 23729 - DNA, 334 bp, Homo sapiens
  misc_feature 271, 324: n = A,T,C or G
attatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgntgttgttgctgttaaactataatatgtgacttctttttttattattttttggnttgaatgctt

SEQ ID NO: 23730 - DNA, 389 bp, Homo sapiens
  misc_feature 370: n = A,T,C or G
ggggtcattgagaggaagggggagggacattagtttaagtgtggaatgagccttgattaaacaacaaaaacgaactagattagctttcagggataaggaacagaccattggtctgtttttttggatgattagagactgataggtctaggaaagttttggattttaaactgtactaatatgtgttcctctgagggctgctgagtatagaactgaactggcagaagggctatttttttttccagtctgatatgccgaaagcaggaatcctctaatctggtaacttttgttggattggaacactagaatctgaatttatacagtggccacatgaaggaaaaggacatgaaaatgtgaaaaactctggtagaanaaatgactcatttcttcat

SEQ ID NO: 23731 - DNA, 101 bp, Homo sapiens
  misc_feature 55: n = A,T,C or G
aaattaacatgtaatatatgttactatcacataccttctaagctattgtaaagangttataaaatatttttattaatcaaacatatattgaacatttagaa

SEQ ID NO: 23732 - DNA, 381 bp, Homo sapiens
atacagactaatttgaggtatctttgctttggcaggcgtgacagcagctgcttcacagttgtgttaaatgcctgttcatcagcatcccactaggaaaaaaatagataagacttaacaacaggtctctagggtttactagctggttttttctgggtcactaatgaaattccagtgtcatttccctcttcaagtataccaggagaatcagtaatagggagatagcagaaccagttaggagactgctggggttcctctgaagcaccagttttccttaaaacaagactccctaattagagcctgattaacaatgctgcagcccctagtgtgctgatgtgactttagagcagttatttctgcctaccgtttacttttttttttttt

SEQ ID NO: 23733 - DNA, 471 bp, Homo sapiens
atatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttttcatcttcacttgaaataccggatgattttggaggtaggtctgaagatccaagagatttttataacagctataaaacccaagcaggtagtagcaaaacag

SEQ ID NO: 23734 - DNA, 473 bp, Homo sapiens
ggaggtggccgaatcttcctgcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaaga

SEQ ID NO: 23735 - DNA, 415 bp, Homo sapiens
gagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttaagcagtg

SEQ ID NO: 23736 - DNA, 228 bp, Homo sapiens
  misc_feature 223, 225, 226: n = A,T,C or G
ggaggtaggaagagagggaggaggaaaggaaggagagatgcctcaggcttcagaccttacctgggttttcagggcaaacataaatgtaaatacactgatttattctgttactagatcaggttttagggtcctgcaaaaggctagctcggcactacactagggaatttgctcctgttctgtcacttgtcatggtctttcttggtattaaaggccaccatttgcncnnat

SEQ ID NO: 23737 - DNA, 471 bp, Homo sapiens
gggggacaggtcggcttccgggatgtggtcggtcctttgtctctcgctgcagccggaggtaaaggccttgtccttactgttcctagagtcccagcctctgtggccctatgacctgcaggtattgggagatccacaactaagtcgccaggaccccctggaagcctagaaatgggagcattgacatttagggatgtggccatagaattctctctggaggagtggcaatgcctggattctacacagcagaatttatataggaatgtgatgttagagaactacagaaacctggtcttcctgggtattgctgcctttaagccagacctgatcatttttctggagcaaggaaaagagccctggaatatgaagagacatgagatggtgggaagaacccccagttatatgttctcatttttcccaagagttttggccagagcaaggcatagaagattctttccaaaaaatgatattgag

SEQ ID NO: 23738 - DNA, 441 bp, Homo sapiens
cacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtg

SEQ ID NO: 23739 - DNA, 161 bp, Homo sapiens
  misc_feature 15, 16, 17, 44, 83, 86, 107, 142: n = A,T,C or G
atttaaccctggggnnnttgatttaaaagaaaactaccagtggntgctaaggccagacatatgcaagctcaatgacctgagtngcngttccatgcctggacattgcncgcctgcacaggaaatgcgtgcagacatgctccanaaagctagtgccgaagaca

SEQ ID NO: 23740 - DNA, 498 bp, Homo sapiens
  misc_feature 1, 2, 27, 40, 51, 55, 60: n = A,T,C or G
nnttctaaaaccccgggaattcggccnttatggcccgggnattagtccagnagangagtntaaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaacctccattccttacaatggatcttttggaatcttgttttccttatgtcttgctgagaaatgcataccatgctgtctacaaacaaagtgttacatcttctgcataaaattacctacttaatcaagataagcacgc

SEQ ID NO: 23741 - DNA, 437 bp, Homo sapiens
cacgtcctcagcgactccaaacctttggcttgtctgctgttatccctagagagtttctatcctcctgctcatcagctatctctggacatgctgaagcggctttcaacagcaaatgatgaaatagtagaagttctcctttccaaacaccaagtgttagctgccttaaggtttatccagggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtac

SEQ ID NO: 23742 - DNA, 233 bp, Homo sapiens
ggacgatggcaacaagtatggcggctgctagtggtagatttgaaagtgcgaagagtatcgaagagcggaaagaacagacccggaatgccagggccgaggtgttgcgccaggctaaagccaattttgaaaaagaagaaaggcgtaaagaacttaagcgacttcggggtgaggatacatggatgctacctgatgtgaatgagagaattgaacagttctcacaggaacactctgtg

SEQ ID NO: 23743 - DNA, 476 bp, Homo sapiens
atctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacaggtgcttgcatcctatttggggtac

SEQ ID NO: 23744 - DNA, 301 bp, Homo sapiens
gaggcattgaggcagccggcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacagaggttgagatgaagcttcttcatggaataaaaaatgttttt

SEQ ID NO: 23745 - DNA, 402 bp, Homo sapiens
caatttagacagtattggaaaattacttgaagctggattttcatgaagttctgaatgagtgtaaatgttttttaggatactataaagagtgatgtttttcataagcaccataaaatgggttctggaaaaactgattaccttagcatcctgtaatataacttatggtagcagattggggaaaatgaagcagcccactgaataattgacaaagtctgcttggagaacattctaaggtacaatatcatggagctcctttttcctttctccactaattgcgtgatgagctattgttctggctggtaattctccaactcggctgtcatttgaagtggcagacttaatatggaaagtttttataattatgaagtttgaaaaagcattttaagatgatacagaaagtat

SEQ ID NO: 23746 - DNA, 464 bp, Homo sapiens
  misc_feature 387: n = A,T,C or G
gaaaaagaatacagttcacccttgtcaaggtcaaatgtgaaagacagaagtttatttaatgtagaggtaaatgaaggtgagctgttttcagcatcttagtttgaccatgaaaatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggntgttgtatttcacaaaatttcctcatttctaacatgagagatgaacttattttaatataatcctttttctacacttt

SEQ ID NO: 23747 - DNA, 368 bp, Homo sapiens
  misc_feature 233: n = A,T,C or G
atatagatggggtctcgaactcgggggctcaagtgatcctcccaccttggcctcccaaagtgctgacattacaggcgtgagccgccccacccagcccagagtagcacttttaatttccttctagatcttttcctttacattcacaacttggctagctttggcacaaaaagcctagctttcagcctgtctcagctttcaacatgccttcctcactaagcttaattgtttctagngttttgatttaaagtgaatgatgtgtgacgcttcctttcacttgaacacttagaggccattgtagagttcttaactggccccatttcaatagtgttgtgtctcagggagtaaggaggcctgcacagagggagaga

SEQ ID NO: 23748 - DNA, 302 bp, Homo sapiens
  misc_feature 5, 16, 302: n = A,T,C or G
agggnaattgcggccncttatggccagggggaaagatcagagcaagccttgcctcttatcttcgggaaaccagaatatgtttggggtggtaggagccacacagactcttctgagccccctcactcacttccttcctcctgtgcctttcctttgagagtgaaggtgggtggagttgaccacgagaaaggggagagaatttgggaaagacccaaagtgtttgtaattcttctttgtccttttacctacagaaatggtcacatggttctatttaaatagcctaataaacacatctggagcctgtn

SEQ ID NO: 23749 - DNA, 471 bp, Homo sapiens
ggaaaagttaaatcttttaaatagcttagcagtgggccactgaatgaatgtactttatacatagcaataataaaaaaaagatatcataaataaagttaaaaaggatggtagagaagaaaatattcttaggaatgactaacaggataagtaacaacctggttatttatttactttaggttatataaggttcttcatgcctgtgaattaatattattgtgtaagaattaagttaaaaagcctgggctgacttttaaatttataaattcatttatcatgtttatagtatatttattgtttttctttcatggctattaaaaagtatgactgtaaaggacaatgcaagtaaaccaacttaatactgtattgaataataagtacaatttattattttactttgaaacattatgaatttactttcctactttttcttagttgttatctatataaattgattaaaaaaacattttatgt

SEQ ID NO: 23750 - DNA, 459 bp, Homo sapiens
  misc_feature 26: n = A,T,C or G
atggatgaaattgaaaagtacaaagnaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatgggaagtttccttttatgcattggaggaaaaacatgttggcttttctcttgatgtggga

SEQ ID NO: 23751 - DNA, 437 bp, Homo sapiens
  misc_feature 19, 398, 399, 431: n = A,T,C or G
aatcacggcagaacgcagnagtgagagtaacactccacatggccagagaaggagcaagagagagaatgagcaagggggagatgttgcacacttttaaactacgacatctctgagaactctagtatgagaacagcaccaagaggatggtgctaaaccattcatgaaggacctacccccatattcagccacctcacactaaactctgctccaacattggggactacggttcaacatgagatttggtggggacacagatccaaaccgtatcacttactttcagggccttaagtgctcatcatagacttttttaaaaggtgaaaattaaaaagataagcattaaacagttatttaaaaagacggcaaaattacagtcaaagacagtagaggggagggaattnnttaaggagaaaattaattgggaggaaccttangaatga

SEQ ID NO: 23752 - DNA, 220 bp, Homo sapiens
agatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcagg

SEQ ID NO: 23753 - DNA, 368 bp, Homo sapiens
  misc_feature 361: n = A,T,C or G
ggagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagcttgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcncaaaaac

SEQ ID NO: 23754 - DNA, 210 bp, Homo sapiens
  misc_feature 22, 209, 210: n = A,T,C or G
gcagcaaactataatgcaaagnagttgagttagattatattaaagttaagaatttctggttgataaaatgctgcagacaaaattaagaggctgatggcaaactgaaaaaaacatctgtagtagctaaatcaacaagagactgacattatatattcaaggacttcctataaactagtaagaagaagaaaacccaaattagaaaattggcnn

SEQ ID NO: 23755 - DNA, 378 bp, Homo sapiens
aagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcc

SEQ ID NO: 23756 - DNA, 356 bp, Homo sapiens
  misc_feature 9: n = A,T,C or G
accaatagnaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaattcggagaagatagaagtttgaagtggaaaactggaagacagaagtacgggaaggcgaagaaaagaatagagaagatagggaaattagaagataaaaacatactttt

SEQ ID NO: 23757 - DNA, 469 bp, Homo sapiens
gccaaagccaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaatt

SEQ ID NO: 23758 - DNA, 439 bp, Homo sapiens
  misc_feature 23, 368, 418: n = A,T,C or G
aatatattaataatgaattccgnaggggagaataagggggagagagagaatggaataatttaccaattaagtagaatacaagataattccccagaagtgacagatacgagcttataaactgaaaaaaaaaatgcaccgagtacttagcacaatatattttaaatgaccacacactaagccagacacagaatgtcatgtgttatattgttttatttatatgaaatatctagaacgggtaaatccatagagatagcaagcagatgtgggactgccagggaccggtgaggtggaggtggggaataaatgcttaatgggtatagggtttttgttgggtaatgaaaatgttttggaactaggcacaacatagngaatatactaaattctacagcattgttcatatagttgttttatgttatgnggaatttcacctcatttaagg

SEQ ID NO: 23759 - DNA, 313 bp, Homo sapiens
gctcccagacccaacttgcgcccagccttgcctctgtgcctgctctgtaggcatgtctcctccgcagagtcttgttggcaaaaagataccttttctaggaaaacacgttctctggagcaagttagctaaagtcagtttccagtttgtacctttcacatggtcttccccagactaaaaacagtgcatcttttacatgatatttttgtactgtttaaatcactaatgctaccagttatttttggtgaacttgtctctgtagagtggaggagataagggcatattaggtgcaaacaaaggggaggaggattgtgtt

SEQ ID NO: 23760 - DNA, 320 bp, Homo sapiens
  misc_feature 23, 39, 251: n = A,T,C or G
gctctttccctaaacgcctgagngatctgtgaaaatggntcgctattcacttgacccggagaaccccacgaaatcatgcaatatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcangccaagcaatggggctggacacaaggtcggtggcccaaaaagagtgctgaatttttgctgcacatgctt

SEQ ID NO: 23761 - DNA, 108 bp, Homo sapiens
accaagtatattgtagtaagagtagaggaaggaaaagcaaactgaggcactgataattgaagtatgaggtattaggcaaaaggaagaaataaaggatatacaaattgg

SEQ ID NO: 23762 - DNA, 471 bp, Homo sapiens
  misc_feature 13, 14: n = A,T,C or G
gaacagctaaagnncacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctctgcataagcctgcgtcagattaaaacactgaactgacaattaacagcccaatatctacaatcaacca

SEQ ID NO: 23763 - DNA, 471 bp, Homo sapiens
atctgggggccaaacacatgttccgtcttgattgccttaagagttactagcgaggtcagtgttaggcttgcaatagggattttaaaatacactaactagttccttagctaccttcacatacattctataggccttcttaaattagcactaacctccacttccttctctgccccattgcctcccaaatatgctatggagctatttttgttaccacgttataacgtgaatatttatacggtagcctcttcaggctttgtaattttcattccaaaaatgcccggtgtgatgctttacactctacaaagtgtggtttaaaggcacaaggtcatggcctttgtcatagcagttgaatgtgcattgacatatttttctatgattttttaaaattacaatagaaaaataagctgttgtaacgtgtaaggtcatgacaatttttgtatttatattttgaaatcagatttctataactcg

SEQ ID NO: 23764 - DNA, 475 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaaggtgat

SEQ ID NO: 23765 - DNA, 462 bp, Homo sapiens
gcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaaccattttaggtgtactgttactcttgagtacttctatgtctggattggtgataattcttccatatttctcttttaaattatggcaaattatacctgatgaattagagaaaaaatattgttattccttcagttactgcagatcgatagtttatatgagctagtaaaagattatcatattttgtatgtaatatatgggaaattatatatat

SEQ ID NO: 23766 - DNA, 469 bp, Homo sapiens
  misc_feature 459: n = A,T,C or G
catgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaaccatttactatggctttgtaacaattgcatacccatattttaagggacaggtgaatttactactttctaaagtttattgatacttcccttttatgtaaaatggtagtagtgatacctatatttccacattgtgcattgtgacacacttgtctagggatgccctggaagtgtataaaattggactgcatttcttagagtgttttactatagaatcagtctcatgggccatctcttcctcagatgtaaatgatatctgggttaagtgttatatggaaaaaaaagnggacattttt

SEQ ID NO: 23767 - DNA, 308 bp, Homo sapiens
  misc_feature 4: n = A,T,C or G
gatnactgttcctgattgtgacattgtgcaagtgttaaattgtgtgccttttgttcctgaagaaagaggtatggtaaagattgaaatactggagtatatagtctattaagtagtaagttggtatgttttaatattggactaaataaagtaaaatataggttaagtatcccaaatccaaaaatccagaatgcaaaattttttgagtgctgacatgatggtcaaaggaaatgctctttggaacattttggattttgaatttttggatttgagatgctcaactggtataatgcaaatactctaaaatcctt

SEQ ID NO: 23768 - DNA, 472 bp, Homo sapiens
aatatctgaatagacagatagattcagaccagggagtgagcaaaaaataaaaatgattgctaattaggcaattatatactaaaagtggaccttttaaggccagagttttcatcccaatcaccagagatccccataatttcaccgtattcagattggctatctctacttttaaattggcactgtctaaaaattcacaaacatttatggaatggtaaaaattttgagcttcaaacaattgaataccatttggtgatgcaagaaaatgctaattttaaaaatagcttctgattttggaattatggaagtctaaatataatgttttctcactttaaaatggaaaaaactttcgtgctgtttctaaaacacaacataaaaagggaaaaccatttggcactgtgtacacacaggaacatcccagttttagtttttaatcatgtttttcaaggaaacaattactttctccaaatgcatg

SEQ ID NO: 23769 - DNA, 312 bp, Homo sapiens
  misc_feature 2, 3, 311: n = A,T,C or G
tnnggaccgggatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatnc

SEQ ID NO: 23770 - DNA, 310 bp, Homo sapiens
aaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtcttgtaagtgtacagatccgaagtttcaagggcaaacgtgtgagatgtgtcagacctgccttggtgtctgtgctgagcataaagaatgtgttcagtgcagagccttcaat

SEQ ID NO: 23771 - DNA, 470 bp, Homo sapiens
  misc_feature 31: n = A,T,C or G
attgagcagttagctcatttgagataaagtnaaatgccaaacactagctctgtattaatccccatcattactggtaaagcctcatttgaatgtgtgaattcaatacaggctatgtaaaatttttactaatgtcattattttgaaaaaataaatttaaaaatacattcaaaattactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgtaatcaggctgagcatttcta

SEQ ID NO: 23772 - DNA, 466 bp, Homo sapiens
gatattggtatttctttaaagggaaatgaggaatgcacatcagtgattgattgtcaaacctcaccccctgatttcctacctaatctacccccacctaaccaatcaatcacatccacaaattgttttgtttgtttgttagtcgggcttccaacaaagttcaatatttctaacactctagtgcaataaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcattta

SEQ ID NO: 23773 - DNA, 399 bp, Homo sapiens
gacagagcagcctgttgaaattagacagcagggtcaccctggtcctctgtgccacaggaaggaggggtactgaagtgtcagttgttggtgggggagcagtgctgcagtgggaattccagagctgagaaggctgccatcaaccaagtgagacatgaccagcccccgagttgctgcagcaaaacgagattgctaaggaaaggaggaagcaagatgtggttaatcgtgttgcaacccattcctcaaatataagatcgacatttaaaccagtaatcgatggatccatgcttaaaaatgacataaaacaaagattagcaagagagcgcagagaggagaaaaggagacagcaagacgccaataaagaagcacagctacttgaaaaagaaagaaagaccaagctac

SEQ ID NO: 23774 - DNA, 150 bp, Homo sapiens
  misc_feature 15, 17, 28, 37, 40, 47, 50, 51, 52, 54, 58, 61, 65, 76, 82,86: n = A,T,C or G
ccttatggccggggnantcacaaggctntatcggatngtntaacaanatnnncnatanaanggcnctaggcttgantattcnacanaatgaatataacactatgacacttcatatttgtccaaaccttaattgcggatttaatggaagca

SEQ ID NO: 23775 - DNA, 469 bp, Homo sapiens
  misc_feature 389: n = A,T,C or G
ggaagcggctcgaggctggaagaaggatcttgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaacttttaacgaacagcttgaaaatggtgggacatccttatcaganaaaacagttcttctgctggtgactccattttctggcagcagcctggagccttcatccctaagtcaacaccaggagagctt

SEQ ID NO: 23776 - DNA, 466 bp, Homo sapiens
  misc_feature 3: n = A,T,C or G
ccngcttagaagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtattttt

SEQ ID NO: 23777 - DNA, 471 bp, Homo sapiens
  misc_feature 4, 36, 46, 62, 113, 116, 224, 230, 234, 275, 315, 372, 445,459: n = A,T,C or G
gctntttcttttcgccatcttttgtctttccggggngctgccccantaaaggtcgagctgtncagttttagcgggtacaagatctaccccggacacgggaggcgctaccgccnggnccgacgggaaggttttccagtttcttaatgcgaaatgcgagtcggctttccttttccaagaggaatcctcggcaggataaactggactgtcctctacagaaggaagcncaaaangggncagtcggaagaaattcaaaagaaaagaacccgccgagcagncaaattccagaggccattactggggcatctcttgctgatntaatggccaagaggaatcagaaacctgaagttagaaaggctcaacgagaacaagctntcagggctgctaaggaagccaaaaaaggctaagcaagcatcttaaaaagactgcaatggctgctgctaaggcncctacaaggcagcncctaagcaaaag

SEQ ID NO: 23778 - DNA, 465 bp, Homo sapiens
  misc_feature 18, 21, 24, 28, 32, 147: n = A,T,C or G
agcaaaattaatttcctngcncgngccncccnatctatagtattttgttatggcagtctgagctgactaatacaatctccaatatttattattattattattttgagacagagtcttgttctgtcacccaggctggagtccagtggngcgatctcagctcactgcaacctctgcctctgggttcaagtgatttgcctgcctcagcctcctgagtagctgggattacaggtgtgcaccaccacacctggctaattttttgtatttttagtagagacggggtttcaccatgttggtcaggctggtctcgaactcctgacctccagtgatctgcttgcctcagcttcccaaagtgctgggatcataggtgtaaaccactgcatctagcctccaagatttatttttaagtaggggagaaaagagtgccaatgtgtactgcaaagtgccaatgtgtactgcaatgggagc

SEQ ID NO: 23779 - DNA, 476 bp, Homo sapiens
  misc_feature 15: n = A,T,C or G
tgacctaaggccagnacacctgccgtgactgggcaggctccctcccattattaacagaggaagaggagggaggcatgcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaatttt

SEQ ID NO: 23780 - DNA, 472 bp, Homo sapiens
  misc_feature 469: n = A,T,C or G
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtgggaagaagtgggggnggg

SEQ ID NO: 23781 - DNA, 472 bp, Homo sapiens
aggcattgaggcagccagtgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaaggcgatcttttaaaaagagattaaaccgaaggt

SEQ ID NO: 23782 - DNA, 472 bp, Homo sapiens
gattcctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggttttgaagatgccgcatttggattgggatgaattccaaattctgcttgcttgctttttaatattga

SEQ ID NO: 23783 - DNA, 371 bp, Homo sapiens
  misc_feature 38: n = A,T,C or G
caatttgagaattagaaatgccatgtttatgattattnagctgtatttgttgctaacttgtaaagcaatacaaacattttttggtctgtttgactgaatttgtcccacaactcattgttgctctgttcatttttttccaggtttcttttttctttctgtgtttcattttggatagtttttattgctatgctgtgttttcaatttgtctttttatttttggcagcatcctgtctggtatttaactaattcagtgaaattttcaatctcagacattttaaaaaacctttagaactaagttcaaattgagtctttaaaaatacgtttatgctttcctctactttcttgaacatataaaatatagttataatagc

SEQ ID NO: 23784 - DNA, 294 bp, Homo sapiens
  misc_feature 290, 291, 292: n = A,T,C or G
atctatagattcaatacaatcacagtcaaaatcccactaagttactttgtggctatcaagaaactgatcctaaagtttatatggagaggcagaagatccagaacagtcaacacaatattaagggaaaagaacaaagttggagaattgacactgcccaagttcaagacttactgtaagactgcagttatcaagacagtatggcactagtgaaagaatagaccaatagatcagtggaacacaatagagcccagacacagacccttgtaaatatagtcaaatgatcgttggcnnngg

SEQ ID NO: 23785 - DNA, 255 bp, Homo sapiens
  misc_feature 144, 156, 179, 195, 198, 232, 237: n = A,T,C or G
gagggatgggcgtggctaatatgaaagctgcatctttactagttagctaccatgcgtcattatttatcaaaagatatatgctgcttaaacacaaatacgttttaaaatatattttaggcagtagggttttgggttttttttttngcaagttctttnggggagtaaatttagggataaangatttttttttctttnganacagtttgctctgtcgcccaggatggagtgcagngcagnggcgcgatcctgcaacct

SEQ ID NO: 23786 - DNA, 411 bp, Homo sapiens
  misc_feature 2, 17, 40, 43, 44, 55, 59, 63, 66: n = A,T,C or G
gntactgactcttaacnagtcatgcttacccaaattttgntgnntgcttttaagnagcnttanctntgcccacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcgtgacacctgtaataaaaacttgactccaaagtcaaaacttaagcaagatacaaatgtgctgcctgcagttagtcctgcatgggaataaggactagttatttttttagtgctgcatttttttaaagttggattgctgctattt

SEQ ID NO: 23787 - DNA, 473 bp, Homo sapiens
  misc_feature 298: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtntttaaaagaaaattgagagaaaggactacagagcctcgaattaataccaatagaagggcaatgcttttagattaaaatgaaggtgacttaaacagcttaaagtttagtttaaaagttgtaggtgattaaaataatttgaaggcgatcttttaaaaagagaatttaaaccgaaggt

SEQ ID NO: 23788 - DNA, 470 bp, Homo sapiens
ggggctgctcgggttagatcgtcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctaacaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttgggaagggaaaatagactatggtgaatacatggataaaaataatgtgaggcgacaagcaacaacaatcatagc

SEQ ID NO: 23789 - DNA, 473 bp, Homo sapiens
gtaaatttaggatttaatatgctcataattgtattaacattcaatttttaatggtactgatttttttatttattagcgattttgcatgctaaagaaagagtacatggaatcctttgaaggtatattcaaagaacagtatgataccatccatcgcttggaaacaaacaagttgcgaaatgttgctaagatgtttgctcaccttttatacactgattcacttccatggagtgtaagtacatgggtcaatatttatacttccttcctaattccctgttctcaaatagattttcgtataagctagccatatttatcctattatgaaatgtgctttaaaatgaaatgtgtagaactgctgtctttgagattatcatcatgttataaggaatcagagagctaggtaaataatatacaagaaatactatctttgtattatatttaacagtccaaacatgccagtgtttcgatagtgatgg

SEQ ID NO: 23790 - DNA, 473 bp, Homo sapiens
atacatggatcaggccgtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgt

SEQ ID NO: 23791 - DNA, 409 bp, Homo sapiens
  misc_feature 50, 51: n = A,T,C or G
tgatatcacagagaaactctgcattctcgcttcctggagggggtcccaanngttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggaatttgggctctttgactaatcaccaaaaagcaaccaacttagccagttttatttgcaaaacaaggaaataaaggcttactttttg

SEQ ID NO: 23792 - DNA, 472 bp, Homo sapiens
  misc_feature 49: n = A,T,C or G
gttcttcatctcgacagaagataaagttaataaaagaaatgaacgtggngaaactcctttacacatggctgctattcgaggagatgtgaaacaagttaaagaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaagtgaaaaacagtcaacaccactaaaacaagaacatactaaaacatgtttatcaccaggaagttctgaaatgtcattacagcctgatcttgttcgg

SEQ ID NO: 23793 - DNA, 467 bp, Homo sapiens
gtcaagtaaaatagatactgttgttgctatattgttattgttatgaagtcttcattatttaaagtgaggttacctcaggaacatatgtaaattgcaacttaggtttcaactacaattgttttctttaaatgtataccaatcagaatagaagaaagttggtatgttgattaatacttaaatttgaaatacctttccaagagtcctaagaaaccttctgtgttatataatgcttttcagcttatcaacccgtactactgtctgccaacaatcagttcgagttagtgagttatgagcaaggtatacttataggaattaaagctctatcatttaatgtaaattatcaaagaagtaggttgtcagcaatagataaggaatggaatataaaatatgggaacctgtaattaattaccccatttttattatctgtttttcaaggttttcaaaatgccttatagaatatcttacat

SEQ ID NO: 23794 - DNA, 336 bp, Homo sapiens
  misc_feature 334: n = A,T,C or G
agtttgtaaaaatatatttgaagtaattgccaactttaaacatcagtaactgtcacataaaaatctgtatttctcacttatcttgaaaaagtgtattttctggcacagagcttccccagttctgcttggaactccaggcagaagctgagtattggctgctgctttggacacagcatttgctaaacagctcactgcagtgctttgaatgacttctctaggcctctgacctggaacttcttcactatgttacccttttcctaatgaatcttcatttcatgatattttcaccaaagaacaatagaatctgtaaaaataaatacttgcagtgcttaantg

SEQ ID NO: 23795 - DNA, 369 bp, Homo sapiens
atgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaaaagtttagtgtttcttgtatgcttgaaaataaagtatgtactgttttgaatgc

SEQ ID NO: 23796 - DNA, 483 bp, Homo sapiens
ttatggaccgggggactgaaatagggatttgagtctgactgatggaactcgaggttatttatttttccttttatctatctattaattcatattcattcttaaatctacaaatattgttgtaatatatgagatatcgaagcaatgaaaactaatgcagaacaggagttctagccttaagatatcttcactctggatggtacacaaaatataatccagggtagaaaatatttgtttgaagaaaatagcagatacagtgccatgaacgtctagagcaactgaaataatcttttcctataaaggaggtagacggggacacagatattgttaaccagtatttgttaaacttaatgtcaagggtatgtaatttataaaataaatcctttgatgaaatgtttcatttaatcaacattgagtactcagtatttctagtcatgagatgtagcttctgtcctctagtgattcatttaaatggaggagacagag

SEQ ID NO: 23797 - DNA, 467 bp, Homo sapiens
gagagaatcctgtgacagtgctttaagagcctatgtgaaagaccattattccaacggcttctgtactgtttatgctaaaactatcgatgggcaacagactattattgcatgtattgaaagccaccagtttcagcctaaaaacttctggaatggtcgttggagatcagagtggaagttcaccatcacaccacctacagcccaggtggttggcgtgcttaagattcaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacattcaaggccttgcgccggcagctttccagttacccgcaccaaaatcgactggaacaagatactc

SEQ ID NO: 23798 - DNA, 470 bp, Homo sapiens
gggcaccaatccgctgaagagctcaggaattgaaaatggggctttccagggaatgaagaagctctcctacgtccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactggg

SEQ ID NO: 23799 - DNA, 469 bp, Homo sapiens
  misc_feature 24: n = A,T,C or G
gagccgcagtcttggaccataatntggtggacatgatggacttgcccaggtcgcgcatcaacgccggcatgctagctcaattcatcgacaagcctgtctgcttcgtagggaggctggaaaagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcacacgattgtaaatgagctatattaaagtctattaaaggaagcccttcttgtttgagggagagat

SEQ ID NO: 23800 - DNA, 156 bp, Homo sapiens
gtcaattagtagggtccttgtttgtattgcaataaacactgggaccagttccggggttaagaattaatttttgtttttaatatttcacatgaaaagaatcaaagtaattgtaatggctagaagagacctgccagaagattaaaaaaagaatgagag

SEQ ID NO: 23801 - DNA, 426 bp, Homo sapiens
aaggtgaacggtgagtacttcttaagtgaactggaacctgccacagagtacatggcgcgagtacggtgtgctgatgccagccacttctggaaatggagtgaatggagtggtcagaacttcaccacacttgaagctgctccctcagaggcccctgatgtctggagaattgtgagcttggagccaggaaatcatactgtgaccttattctggaagccattatcaaaactgcatgccaatggaaagatcctgttctataatgtagttgtagaaaacctagacaaaccatccagttcagagctccattccattccagcaccagccaacagcacaaaactaatccttgacaggtgttcctaccaaatctgcgtcatagccaacaacagtgtgggtgcttctcctgcttctgtaatagtcatctctgcagac

SEQ ID NO: 23802 - DNA, 230 bp, Homo sapiens
cactctgacatgacaactgaagagttgataattatgaattttcaggaaaaatcaaataaattgagatgatttaattcagataagcgttttaatgtgggtcattattgagataaatgaatcataattctaatgctactagctagttatgttccatatttatcacaggcaaatggtagcaaatggattttaagaggaaaaaatgatatttgatataaaggactctctaatgg

SEQ ID NO: 23803 - DNA, 329 bp, Homo sapiens
  misc_feature 7, 13, 65, 66: n = A,T,C or G
agggggnagtagnagccccccaccaatatatcaatgggtgatttatgatgccttctgccctttgnngagtgaatgggtttcccataggggaagttggcctccctccgtgagctttggaaatgttttctaatagacacagggaggccagttctgtttcagagcaattatcttcccaaattctctgttctggtgttggaactgtgtgccctggtttctgttttcctttctactgctgtaattctctgtctcatcatccttctcttttgtttccatagccttttataatgcatatatgatgctgtaaacagaaataaattatttatacaatc

SEQ ID NO: 23804 - DNA, 399 bp, Homo sapiens
gacagtcctaggaaggttgacataaaaataccaaccttcagtaaagctctagtacaaaaaagggtaaatgtcatcattcttatttttaggcctctttcttgagagaggtgggagtgggaggtagtgttataactggcactttaatttgtttttggaactagaatttaggggcagttggatgaaattgcaaatttagaaggggaataagaattttctagtgctatataaagaaatgatgatggagacaaaagccttgctttcctctttttagaatttattttcgatttttagcatactgtggggcttttagagctaatatgatctaaattcagaaaatttaattttcatagtaggccaggtgtgaattacttatgtttgctatagaatgcttatttagac

SEQ ID NO: 23805 - DNA, 425 bp, Homo sapiens
  misc_feature 417: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgnaggtgatt

SEQ ID NO: 23806 - DNA, 212 bp, Homo sapiens
gatttatatgaattttaacagagctgtatttgtgtgtgtttaataaaatatatatttattcagtactttcctcagtattttatgggcaaagtaaaaataacaatgcctagtgaaagggcatatattaccagcagtaataattcaaaatcctgaaaatgtttcattttttttgtttttgctatgcagaataaacaaggcagaaatgctctttg

SEQ ID NO: 23807 - DNA, 385 bp, Homo sapiens
gaaataccctgaaattttgcaactcataaaagaaaaaaattttatgaaagttttcccaaattttacagtgatcctaaaaacccgacatgagttgtgaactgaaaagaagctttccttaacacatatttctaaaaattctttttatagcataattagaagagatgccaaattattttttaatttcgtatgtggaaaattgtgttataaaattgtcatttgtcaaaatatgcataatcaaaaattttagaaaaaagcattatagaggtttgttggataaataaaaataagatggtatttttctgaatttcatgatgtttattttcagctatttaaaatttgtaatttttctgttctaaatatacttccactttctcttctaattttg

SEQ ID NO: 23808 - DNA, 406 bp, Homo sapiens
  misc_feature 13: n = A,T,C or G
ataagagtgatcntttaggatcggcaagtcatttcagtaaccgaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactgacacacaaagtggcagaatgcaaagctttagcattagaatgtgaaagggtcaaggaggattcagatgaacagataaagcaattagaagatgcattaaaagatgtgcagaagaggatgtatgagtcagaagg

SEQ ID NO: 23809 - DNA, 352 bp, Homo sapiens
accgggggacactggacaagaacagtaaatattccaacttttaatgctaattaaaggagtataggtaaagaatacgtaggtatacataattggtgagacaaatattcaccttatttatattttatatattattttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctg

SEQ ID NO: 23810 - DNA, 143 bp, Homo sapiens
  misc_feature 15: n = A,T,C or G
acagataaaagagantaacttgtgttcatttttgtacaaacaaaaaagatataaattgtgaatgatgcatgatttttaattacaagtaaactgggcaaatgcttctgcactccagcctgggtgacagagtgagtctctgtctc

SEQ ID NO: 23811 - DNA, 491 bp, Homo sapiens
  misc_feature 11, 19, 48, 111, 119, 129, 251, 253, 292, 321, 424, 461, 462: n = A,T,C or G
gttcggcgatnatggagcnggcatgctgattttccaattacccaggcnagaattttaaaggacctcattaataatttgctcacttggtaaatgacgtgagtagttgttggnctgtagcnagctgagttnggatgtctgtagcataaggtctggtaactgcagaaacataaccgtgaagctcttcctaccctcctcccccaaaaacccaccaaaattagttttagctgtagatcaagctatttggggtgttngntagtaaatagggaaaataatctcaaaggagttaaatgtnttcttggctaaaggatcagctggttcagnactgtctatcaaaggtagattttacagagaacagaaatcggggaagtggggggaacgcctctgttcagttcattcccagaagtccacaggacgcacagcccangccacagccagggctccacggggcgcccttgtctcanncattgttgttgtatgttcgtgctggagtt

SEQ ID NO: 23812 - DNA, 363 bp, Homo sapiens
  misc_feature 1, 31, 57, 108, 123, 155, 156, 161: n = A,T,C or G
ntagaacatttgttatgcttcccaatacaanaaaaagggataagcatctgagatganggataccctaattaacctgatttgatcattacacactgtagtcaatctatnaaaatattacatgtncccttataaatatgtacactttaccctaaggnnacagngaaaaaagaaggtgtggaacaccgaccacaacaaaatcaaagaggaaaatctttgtgaacttgggtttgtcaggccaggaatcagcaaaccatggccaatccactacctgtttttctaataatcgaaacaatataattgataatttgggaaaattatgtgaaattcaaactgcagtgttcataaagttttattggaacagct

SEQ ID NO: 23813 - DNA, 474 bp, Homo sapiens
atccggtattgtaatattcaacttttgaaaactcaaatccctctaccactcttctagtgtttttgtagtcactttttcctttattaatgaagcagttatctcatgagcataattcatatccatgaatttacagatacatttacagagggattttttaaggctctgcatttccaccttttccccacacttttgtaaccaaatgccttaatttgaagacgtgattattgtaacgaaaggatgcagaggatgaagcaaattattaaaataaagataaatacatttgataacttattcaaatgaactcacctatttgactctaaaggactcctttacaaaatgaattctgtgttcttccattgttcaacacacctcagacggtgaggtttaaataagtgagttttagtacatgaacatttttctatttttaaacttcatactgatatcaaaattcatagacaaatatttacattttag

SEQ ID NO: 23814 - DNA, 279 bp, Homo sapiens
atttataatcagtaggagagactgtctagatgttggggcagctctatgatttaagtctgtaacatgttataactgaatttagtaccctagttttgttaagctattaggattttctaatagaacttactccccctgcctccccagccttatgtttcttttaatgacttctggatcctgagctccctttgcagtctgaaaaaggtattgcaagtcagaactgtgtactgatgataaaagcctctggtagcaataaaaagttgtccttaaaaaaaaaagggg

SEQ ID NO: 23815 - DNA, 255 bp, Homo sapiens
  misc_feature 46: n = A,T,C or G
tatggccgggcaaattatcaattacttaaaattatatgaagtgccntgggggaaaagtacaggatgctatgagaacacatactaggagactaactggagttattataagtgcaacaaattggaaacaatctgaacatccacatggagaagaatggttcaagaaatctcagtacatccacttgaaagattattacaaaaccacttaaatgtcctttgatagagcatggaaaattgctagtgatttaatgctaagag

SEQ ID NO: 23816 - DNA, 356 bp, Homo sapiens
gtactactgctttgcggaattgcatacaactgtgcattacaaagttaatatggtaattatggtctggggtaaaattgagtttcagaataaaattaggaacagtaaaatccaaagaactatgtaaacaaaaaggcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttctt

SEQ ID NO: 23817 - DNA, 470 bp, Homo sapiens
  misc_feature 21: n = A,T,C or G
caatgtgactgctgacaaagnaggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaactt

SEQ ID NO: 23818 - DNA, 466 bp, Homo sapiens
gaataaagaaaggtggtacatatataccatggaatagtatgcagccatagaaaagaatgagatcgtgtcttttgcaggaacatggatggagctacaggctattattcttagcaaactaacacaggaacagaaatccaatactacatgttcgcatatataagcgggagctaaatgatgagaactcatgaacacaaagaagggaacaatacacactggggtgttcttgagggtggagggttggaggagggaaaggagcagaaaagataacaactgggtactgagcttaataccttggtgatgaaataatctgtacagcaaattcccatgacatgagttcacctatgtaacaaaccttcacatgtatccgaaactaaaataaatttttttaatgaataatatgggggtttttgggggggggccctcctcttttcggctttggagccccccctccctctgtctcggatgg

SEQ ID NO: 23819 - DNA, 231 bp, Homo sapiens
ggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttgttttttttaataagaattccggctgatttttgtgaggcctgtttaaat

SEQ ID NO: 23820 - DNA, 436 bp, Homo sapiens
  misc_feature 144, 328: n = A,T,C or G
gaagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcaganccaccagaaacgtacacctgattttcatgacaaatacggtaatgctgtattagctagtggagccacttttctgtattgttacatggacatatgtagcaacacaagtcggaatagaatggaacctgtcccctgttggcagagttaccccaaaggaatggaggaatcagtaatcatcccagctggngtaataatgaattgtttaaaaaacagctcataattgatgccaaattaaagcactgtgtacccattaagatatggcattattgaagaaataaagtacatttggaaacct

SEQ ID NO: 23821 - DNA, 464 bp, Homo sapiens
  misc_feature 5, 7: n = A,T,C or G
caagnanaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaag

SEQ ID NO: 23822 - DNA, 325 bp, Homo sapiens
gacaaatttaactacataaaattaataacttgtgcttggaaaaataattcctaaattaagtttaaaaaagagacaaagttagaaaacagtatttacaacaccaatgtcagacacatggctaatttcattcattaacaaagagcttataagaatcaataaagaaagataaacaactaagaaaaattgatgaaaaataattcataaattaagtttaaaaaagagacaaagttagaaaacagtatttacaacaccaatgtcagacacatggctaatttcattcattaacaaagagcttataagaatcaataaagaaagataaacaact

SEQ ID NO: 23823 - DNA, 440 bp, Homo sapiens
  misc_feature 209: n = A,T,C or G
attcaacgagtagacaaaatgctaattatttccctgattaggaaagtttctttaaaaaacacgtaattttgcctagtgctttttctctacctgcccttgggctcactaatatcaccagtattattaccaagaaaatattgagtttacctgattaaactttaaaagttaattgtagatttaaattgtgtgaacctaatgatttttgcagngaaacctttactaattcaaagttgcatgtcctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggtaaaggaaatggttttattgcccatagtcatttaggctgg

SEQ ID NO: 23824 - DNA, 287 bp, Homo sapiens
  misc_feature 2, 10: n = A,T,C or G
anggaaaatnaaattttaaaaaaatttctctccaacctccttcaaattcagtcacccactgttatattacccttctccaggaaccctccagtggggaaggctgcgatattagatttccttgtatgcaaagtttttgttgaaagctgtgctcagaggaggtgagaggagaggaaggagaaaactgcatcataactttacagaattgaatctagagtcttccccgaaaagcccagaaacttctctgcagtatctggcttgtccatctggtctaaggtggctgcttcttc

SEQ ID NO: 23825 - DNA, 354 bp, Homo sapiens
gagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctt

SEQ ID NO: 23826 - DNA, 197 bp, Homo sapiens
  misc_feature 12: n = A,T,C or G
ggtgggcccagnaaaacaagccgtcagtgttcaagagacctatgaagccaaaagacatgagttccatggtgaacgtcagagggaggaagaagaaatgaaacagatgtttgtgcagcgagtaaaggagaaagaagccatattgaaagaagctgagagagagctacaggccaaatttgagcaccttaagagacttcacc

SEQ ID NO: 23827 - DNA, 461 bp, Homo sapiens
  misc_feature 2, 10: n = A,T,C or G
gnagggcaanttcggcccttatggaccgggcatgtcgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggctccattttttaaatgtttaaaaatatgttgacatggtaagttcagttcttaaccaatgacttggggatgatgcaaacaattactgtcgttgggatttagagtgtattaatcacgcatgtatggggaagtagtctcgggtatgctgttgtggaattgaaactgtaaaagtagatggttgaaagtactggtatgttgctctgtatggtaagaactaattctgttacgtcatgtacataattactaatcacttttcttcccctttacagcac

SEQ ID NO: 23828 - DNA, 280 bp, Homo sapiens
gtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttca

SEQ ID NO: 23829 - DNA, 195 bp, Homo sapiens
  misc_feature 41, 194: n = A,T,C or G
agggcaattcggcccttatggaccggggagaatgatgcagnctaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcng

SEQ ID NO: 23830 - DNA, 283 bp, Homo sapiens
  misc_feature 282: n = A,T,C or G
atgattaagtagggacggccgggggcattcgtattgcgccgctagaaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagctttccgggaaaccaaagtctttgggttccggggggagtattggttgcaaagctgaanc

SEQ ID NO: 23831 - DNA, 498 bp, Homo sapiens
  misc_feature 8, 16, 26: n = A,T,C or G
cggcgctnatggagcnggcattactncatatccaagagcaggagcaaaaaacttgtgggatgcaaataaaactatgcttagaagaccttttaattttattttaaatttaaagagtacctgttcaggtttgttacaagaatatattgatgatgctgaggtttgggctcctaatgatcctgtcacccagatagtgaacatagtacccaatagaaagtttttcagcacttgcttccctctctccttcccttcctccctcgttttggagtccctagtgtctattgttcatatatatatatacacacacatatatatttaaatgtttatgttagaaaagaagaaaggttaaaaatcaattaagcaattacctcaaaaattttaaaaacagcacatgaaacccaaaaataagccaaattactgatatggaacacaaatatacaataaagggaatcaaagtcaaaagttggttatttaaaaggattaagaggactcattggctgg

SEQ ID NO: 23832 - DNA, 469 bp, Homo sapiens
atgcagtctaatgaaaaagacacctggatgaccttagacgttctaatgggagagactctggtccaaccctagactgcctaaggttagagacacctggtcaaccccagacattccaatgaaagagactcctggcccaattcaggcagtctaatgatagagacaccaatgtcacactaagcattttaatgtgagagactcctggctgagaccaggaagtctaattatagagacacctgggcaatcccaggcattctaacgggagagacttcaggctgaccccaggcagtctaatgatagagaaacctgggcgactccaggcataataatgggagagactgctggctgacccaaggcagtataatgatagagacccctgggcatgctatctgtgaaaatgctttaggatgtgtggattagtctcaccaaatggaacctgtgtattgattcaccaggttgaaaacactcttgc

SEQ ID NO: 23833 - DNA, 473 bp, Homo sapiens
  misc_feature 290, 378, 412, 415, 456: n = A,T,C or G
gacagcaccctcctgaaaactgcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcnctgcagatgacaggaaagtcaagagcaccataaccttagatggggggtgtcctggtgcatgtgcagaaatgggatggaaaatcaaccnccataaagagaaaacgagaggatgataaactggnggnggaatgcgtcattgaaaggcgtcactttccacgagagtttntgagagagcataagcca

SEQ ID NO: 23834 - DNA, 469 bp, Homo sapiens
  misc_feature 120: n = A,T,C or G
gctaaacctagccccaaacccactccaccttactaccagacaaccttagccaaaccatttacccaaataaagtataggcgatagagattgaaacctggcgcaatagatatagtaccgcangggaaagatgaaaaattatagccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtaggaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaacct

SEQ ID NO: 23835 - DNA, 499 bp, Homo sapiens
  misc_feature 6: n = A,T,C or G
cagggncaatttcggcccctctatggaccggggtttcttgctttgaaaacaatattattagtagtaatatcatagttgctgatattaaatggatacaagttcggtgaactaattaaagattaaagcagaaaatctttactgtggcattaaatcaatccatagtttcagaattcattatgctaagcgttctagtaattaaggagcacttaaatgaaacacatgcagataaattaaaactgaatttcgcaagctgaagcttgtaatggaatcctaatagagatatacataaaatatattccactaaagactgtgccatttagttgccgcatggtttaacacagaaattactggtgccacctattggtcaaagagtagaattccaacaggtgtttaataaaagtaataatcaggagatttcattacaagacaatgggtttcataaagtgaatgtaccagtgttatttcttggtgttgaaattatacttaagttttaatacat

SEQ ID NO: 23836 - DNA, 220 bp, Homo sapiens
  misc_feature 21: n = A,T,C or G
accgaggtcagcggttcgagnaccagcctggccaacatgctgaaaccctgtctctactaaaaatataaaaattagcctggtgtggtggcacctgcctgtaatcccagctacttgggaggctgaagcaggagaatcacttgaacccgggaggcggaggttgcagtgagctgaggtggtgccattgtactccagcttgagcaacagagtgagactccatctg

SEQ ID NO: 23837 - DNA, 255 bp, Homo sapiens
  misc_feature 153: n = A,T,C or G
ataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctnagaaggaatgagtgctatagagaggagagaggagtgtactgcccaggtctttgacagatgtaattctcattcaattaaagtttcagtgttttggttaagtgg

SEQ ID NO: 23838 - DNA, 379 bp, Homo sapiens
actgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactg

SEQ ID NO: 23839 - DNA, 201 bp, Homo sapiens
tgatgaaagctcattgactggtgaatcaggatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaaga

SEQ ID NO: 23840 - DNA, 266 bp, Homo sapiens
aagagaactgcctactctaaaaacctctttcgcctatttaatgatgcctccattctaaactctttgttccaaaattggagaaggggccactggtttgattacgggttaggttaaaaaaaattatatcctttcctttcttgctggggtggccagaagagactgagcagattggaagtctaaaagtccataatagttttacaaagtagaagcccctgaatgagaaaaaggatcagaaaagggatagggatactgaaggaaaacatctc

SEQ ID NO: 23841 - DNA, 477 bp, Homo sapiens
  misc_feature 30: n = A,T,C or G
tatggccggggggcattgttttctacaacngaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtg

SEQ ID NO: 23842 - DNA, 239 bp, Homo sapiens
  misc_feature 89: n = A,T,C or G
atgcattatgtggtgtaatcaaacccgatgctttcagatgacctacttacatcttcaatgtggataagataaagaacaaaacacatgcntctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatattt

SEQ ID NO: 23843 - DNA, 475 bp, Homo sapiens
  misc_feature 8: n = A,T,C or G
cgcctganaaagaagtttgcccaaaagagcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcttggaggattt

SEQ ID NO: 23844 - DNA, 470 bp, Homo sapiens
  misc_feature 453, 457, 463: n = A,T,C or G
gaactttaatgataggaaccggaggtgggtgcatttcttttgtccttagcaagtcagatagaataggagaaaggtcaaaactcctaagagacatcattgtttgccattactggttaacctataggataatttggcataagaaccctgtaggagaatttaacataggaaaacaaagtttaagtcacctgaaacgtgtgaattcaccctggatgagctgccatggccaactgcaacacacgtaaggatcatggactatagctggaaaagatagaaaagagtcctctccttccccctcctggtatgggcagctatcccccttggccttcaggtaacactggaaagtggccctggccagttgcccacaattatcagggagctactaggaaatggccactgaaagactgaaaaagaaaaaaaggaaaggactcaggcctctcacccaaactgggcggngggnggtcanggtgctt

SEQ ID NO: 23845 - DNA, 447 bp, Homo sapiens
ggggaaaatgaaggttaggatttaacagtcatttaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtccg

SEQ ID NO: 23846 - DNA, 474 bp, Homo sapiens
ggtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgt

SEQ ID NO: 23847 - DNA, 498 bp, Homo sapiens
agggcaatttcggcccttatggaccggggtgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataatttgttggcaaggatccttttgctttctttggcatgcaagctcctagcatctggcagtggggccaagaaaataaggtttatgcatgtatgaatggttttcttcttgagc

SEQ ID NO: 23848 - DNA, 490 bp, Homo sapiens
  misc_feature 5: n = A,T,C or G
aatcngaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgagatgatatgaccaaaattttaagtagggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctt

SEQ ID NO: 23849 - DNA, 492 bp, Homo sapiens
  misc_feature 1, 436: n = A,T,C or G
ntatggaccggggtaaaacaaaaggctgaccctccagccagtaagagggatttccttgttcctgaagacctggagctggaacatcagtcttttgcttctttcagactagaactgaaacaacagctcttcttggttgtggagcctttcagatttcagactaaaccttagatcttcagttcctctggttctcaagccttggattcagactgcaactataccatcagcagtcctgggcctccagcttgccaactgctgttcttggaacttcctagcttccataattttattgtatataaatctctttatatacaccttatttatgtatgtataaataagatatatgtatacatatacatgtataaataagatacataaagatataagatgtgttatatattaatattatatgaaggataattttatatgttatatatgnataagagattggtattataaggaaatggcttaggaatttcatatgatacatagcat

SEQ ID NO: 23850 - DNA, 329 bp, Homo sapiens
tatggccgggacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacct

SEQ ID NO: 23851 - DNA, 388 bp, Homo sapiens
attctatttttatagaaatagctgagcagtttctaaaccaactctctgctgccttacaagtattaaatattttacttctttccataaagagtagctcaaaatatgcaattaatttaatactttctgatgatggttttatctgcagtaatatgtatatcatctattagaatttacttaatgaaaaactggagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattggagatgctgtaacttaatggcaataaatgatttaaatattac

SEQ ID NO: 23852 - DNA, 232 bp, Homo sapiens
  misc_feature 6, 7, 35: n = A,T,C or G
ccctcnnaggcccggggtgaaatggaaaaaaaaantaagccttcaaactaggtatttctgggaatgatgtaatgctctgaatttagtatgatataaagaaaactttttttgtgctaaaaatactttttaaaatcaattttgttgattgtagtaatttctatttgcactgtgcctttcaactccagaaacattctgaagatgtacttggatttaattaaaaagttcactttgg

SEQ ID NO: 23853 - DNA, 500 bp, Homo sapiens
  misc_feature 2, 7, 36, 190: n = A,T,C or G
tnggccncttatggaccgggcatagcatgacattgntagtgtcgcacgtccccatgttcagtgtccaaaccggcaatgtaaaaagtatcctgtgtggtttaacaggaaatctgtttatgtctctttatttgaaaccagttttactctcagtggttctttaagttcaatgaagtctgccaggaacattggntggtagtattattccgacacctttaatttccaaaatctgaagttcctgctagtttaccaccttcatgatcttcttgaactggtaactgattaggttgaacttatggaagatttgtggacttaactcaaaagtaacctctcagtgttctatagaacatgtatttgtgtaactgaacctaccaggagaaatgtttggaattctatatgtgcaatttttcaacaaatgcaaaaaaaatacagcacatgcattgacaagcttctgtcaagcagcttgagttgaaatttgatttaagaaaataaatcatgattgt

SEQ ID NO: 23854 - DNA, 470 bp, Homo sapiens
  misc_feature 469: n = A,T,C or G
attcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcagcaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgttggttggggggggtcttgccagctggggccctccctgtcgccagtgggcacttttttttttccaccctggctccttcana

SEQ ID NO: 23855 - DNA, 471 bp, Homo sapiens
  misc_feature 432, 436: n = A,T,C or G
gaaggatgaccgtcgggacagatactctgcgggcaaaaggggtggatttaatacctttagagacagggaaaattatgacagaggttactctagcctgcttaaaagagattttggggcaaaaactcagaatggtgcttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctggtttttcataattgctctttatattngggngttatctgacaagatagttattttaagaaacatgg

SEQ ID NO: 23856 - DNA, 204 bp, Homo sapiens
  misc_feature 25, 89, 90, 94, 95, 103, 164: n = A,T,C or G
atggcccgggatggaagaaaacctncgttctctactaaaaatacaaaattagtcgggtgtggtggcacatgcctgtaatcccagctatnnaggnngctgaccnagagagaatcgcttgaacccgggagctggaggttgcagtgagccaagattgtgctattgcnctccagccttggcaacaagagtgaaacttaacttcatctc

SEQ ID NO: 23857 - DNA, 466 bp, Homo sapiens
  misc_feature 423: n = A,T,C or G
gagtgggaaagtgggcttgtgctgctgcctagacagtagggatgtaaaggcctgggagctagaccctccccaagcccatccatgcacattacttagctaacaattagggagactcgtaaggccaggccctgtgctgggcacatagctgtgatcacagcagacagggtcgctgccctgatggcgcttacattccagtgggtctaatgaccatatcttaggacacagatgtgcccagggaggtggtgtcactgcacaggaagtatgaggactttagtgtcctgagttcaaatcctgattcaggaactcacaaagctatgtgaccttacaccagtcacttaacttgttagccatccattatcgcatctgcaaaatggggattaagaatagaatcttggggttagtgtggagattagattaaatgtntgtaagacacttggcacaaaacctggcacatagtaaaggctca

SEQ ID NO: 23858 - DNA, 500 bp, Homo sapiens
  misc_feature 5, 15, 37, 41, 55: n = A,T,C or G
cgcanttcggccctnatggaccgggcattcattacantcancagatttgctgagncaccttctacatgctaggcactgttctatggactgaaaacacatgtgtgaataaaacataagtattcctaccctcattggtttggctgtttgtgagggacacagtcagtttaaaaatcaccaaactgataaatatggagtttgagatgcttagttttgaggaataattttcatgcagtaaaatgtactcttttagtgtatagctctctgaattcagacaaacacatacagtcatagataaacaccaccactataaagatatagatgggttccatcacccccacaaaagttcctcattcccagtccctggcaaccagcaattgattttctacccctatgattctgcctattccagaaagtcatataaatgagatcatattgtatacagccttttgaatgtggctttttcacttagaatgatgtatttggagattactcatgacgtg

SEQ ID NO: 23859 - DNA, 301 bp, Homo sapiens
  misc_feature 274: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgacgacttagaagagtggcatgaggaaggaaaagataaaaggtttctaaaacatgacggaggttgagatgaancttcttcatggagtaaaaaatgtattt

SEQ ID NO: 23860 - DNA, 161 bp, Homo sapiens
  misc_feature 7, 19, 38, 81, 86, 87, 103, 116, 122, 153: n = A,T,C or G
gaatatngtagtacccccnaaaacctttacctggactngggggttggattttaataaaaaaagccttggttttctggcctnccttnnctggaaaaggcccttngggaattttgganaaggtncccccccccggaaaaagttttttttaaaaanttttcccc

SEQ ID NO: 23861 - DNA, 288 bp, Homo sapiens
  misc_feature 8: n = A,T,C or G
agggcaanttcggcccttatggccgagtgggtacataacgaaatgaaggcagaaataaagatgttctttgaaaccaacgagaacaaagacaccacataccagaatctctgggacacattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactg

SEQ ID NO: 23862 - DNA, 461 bp, Homo sapiens
ggctacctaaggttaacatgtcactagcagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcac

SEQ ID NO: 23863 - DNA, 354 bp, Homo sapiens
ccttatggccgggtataaccaagctaatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagaga

SEQ ID NO: 23864 - DNA, 469 bp, Homo sapiens
catataagaagtcccagttatacatccactagtaatagctccatggccaggtacatgctagtatttgcattttggaacggtttttctctcccgtttgttgtctcttggtcacaagatgacagattatcccaggcctcacgtttacattcgaagactaaaaaccactgtggtgagtaggaaatgcccctccccagagatgactcccaagccctcattcccagaccggtgactgtgttgccttacattgcagatgtactccgcagatgtgattaaattcaggagctcgacatgaagggattaacctgtcttatctggggcctctagacttctttcaagtaatgtgactgtgcctctacctcagtgttcttgaaccttctttgacaagtaggaggctggactgtccttggtggtgaagactctagaaggtcatgtgacttaactgaagttttgtatcgggatataaactcat

SEQ ID NO: 23865 - DNA, 475 bp, Homo sapiens
gggtactcagtaccaatccgcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgat

SEQ ID NO: 23866 - DNA, 472 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttggaagggcgatcttttaaaaagagattaaaccgaagg

SEQ ID NO: 23867 - DNA, 472 bp, Homo sapiens
ggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcag

SEQ ID NO: 23868 - DNA, 473 bp, Homo sapiens
gaggcattgaggcagccagcgcaggggcttctgctgagggggcaggcggagcttgaggaaaccgcagataagtttttttctctttgaaagatagggattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttggaaggcgatcttttaaaaagagattaaaccgaaggt

SEQ ID NO: 23869 - DNA, 472 bp, Homo sapiens
gattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctacctggagaggagagacagcaagtccaccctaacttgttacacagcacataccacaggttctggaattctcatcttcgaacctagagaaataggtgctataaacagggaattaagcaaaatgctggatgctatagatcttttaattgt

SEQ ID NO: 23870 - DNA, 461 bp, Homo sapiens
  misc_feature 433, 441, 443: n = A,T,C or G
atagcagcactatgcgtaatagctcaaagtcttcaatgtctatcaatggatcaatgaataaacgaaaggtggcatatatatgtaatggaatattattaatccgtaaaaaggaatgaagtttgggaacatgctacaacatggatgaacccccaaaatgttatgctaattgaagaaggctggatacaaaaaggtcacatatggtatgattctatttataagaaatatccagaataagtaaatccatagagacagaatgcagatcagctgttgccaggggctacggggagtgaagaactgggagaatctgcttaatggtgaaggggtttttactttggagtgatggaaatgtgctggaactagatagaagtggggggttgtgtaacaccacgaatgtacaaaatgtcacagaagagtcaccttaaaatggttaatntattgttngnttcactgcaataaattat

SEQ ID NO: 23871 - DNA, 469 bp, Homo sapiens
aagagaaaatatgaagacttagaagagtagcatgaggaaggaaaagataaaaggtttctaaaacatgacggaggttgggatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaattcggagaagatagaaagtttggaagtggaaaactggaagacagaagtacgggaaggcgaagaaaag

SEQ ID NO: 23872 - DNA, 499 bp, Homo sapiens
  misc_feature 16: n = A,T,C or G
agggtaattgcggccnttatggaccggggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattattggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatg

SEQ ID NO: 23873 - DNA, 204 bp, Homo sapiens
  misc_feature 183: n = A,T,C or G
aactgtacttcatttaatgccttaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatggnggtgaaataaagaaataaaac

SEQ ID NO: 23874 - DNA, 320 bp, Homo sapiens
  misc_feature 9: n = A,T,C or G
aggagaagnaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcc

SEQ ID NO: 23875 - DNA, 399 bp, Homo sapiens
ctactaaaatgaacacacagtttttaatggacttagcatatatgctgcctgagctgcaaaattattctaattttaaatgagttctgtctactcagtaaaacaatcttctaatttgaaatagcatgaccattgtaagagtattttctaattccagcctttcagcagttcaaaagtgcttttcgccaggtagtctttattaaagatgttctgttgttacaatttacagaactggttttaaaatacaaatttatcagctggcacaggggctcacacctataatcccagtacccggggaggctgaggcaggaagaccacttgagcccgggagttctaggttgcattgagccctgattaagccactgcattccagcctggatgacagagcaagaccctgtctcc

SEQ ID NO: 23876 - DNA, 344 bp, Homo sapiens
aagatttctttattaggttttgttttgtctactcaaacagaagtatttgctgggcaacaaaacagtgattctctttgtaatctgtatttgttcaaagccatatttattttacctgtttctgtgattggaaaatagagcatgtaatttgttctcctgatttgtttaaagtttaccagtaaatcagaagctctattactaaaaatacgtggagttatcaaccagttggcatttggcattgacaaaaggtactgctaagatattttttatatcatttattgagtgattgatttagccaatgttgtctcatctgattattgttctactcagtctcttgtgtcttgacc

SEQ ID NO: 23877 - DNA, 396 bp, Homo sapiens
gggccacgttcagcggacacgggagcaagatggcgattccgggcaggcagtatgggcttattttgccaaagaaaacacagcagttgcaccctgttttgcaaaaaccatcagtgtttgggaatgattctgatgatgatgatgagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatgg

SEQ ID NO: 23878 - DNA, 283 bp, Homo sapiens
  misc_feature 12: n = A,T,C or G
atttgcaaaagnatatatctaataaaggactgttatccaaaatatacaaaagaactctaaacaataagaagacaaatagcctgaataaaatacagcaaaagacttgaacacataccccactaaagaagattcacaaggttgggtgcagtggttcacgcctgtaatcctaacacttttggaggccaaggtgggagaatcacttgagcctgggaggtcgaggctgcagcgagctgtgattgtgccactgcactccagcctaggcaacagagggagaccgtgtctg

SEQ ID NO: 23879 - DNA, 487 bp, Homo sapiens
  misc_feature 274: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaancttcttcatggagtaaaaaatgtatttaaaagattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaat

SEQ ID NO: 23880 - DNA, 410 bp, Homo sapiens
  misc_feature 25, 76, 79, 247, 299: n = A,T,C or G
cttctgctgagggggcaggcggagnttgaggaaaccgcagataagtttttttctctttgaaagatagagattaatncanctacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaancttcttcatggagtaaaaaatgtatttaaaagaaaattgagagaaaggactncagagccccgaattaataccaatagaagggcaatgcttttagattaaaatgaaggtgacttaaacagcttaaagtttagtttaaaagttgtaggtgattaaaataatttga

SEQ ID NO: 23881 - DNA, 241 bp, Homo sapiens
  misc_feature 8, 41, 63, 109, 167, 190: n = A,T,C or G
gaattganattgtgccactgcgctgccagccttggtaacangcagcaaaaactccgttctcanaataaataaataaatgggcaacaggatgggaacagacatttctcanaagacatacaaatggcccacaggtgtatgaaaaaatgatcaacatcgcaaatcaccanggaaatggaaattaaaattatcntgagatataacctcatacctattagaattctaggtgcttattaaaaatatg

SEQ ID NO: 23882 - DNA, 500 bp, Homo sapiens
  misc_feature 6, 15: n = A,T,C or G
atggancgggcagtnctatgtaaggcggggaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatct

SEQ ID NO: 23883 - DNA, 363 bp, Homo sapiens
  misc_feature 3, 5: n = A,T,C or G
ccncntaatggaccgggaagggaagcctgtgatgactacagactttgcgaacgctacgccatggtttatggatacaatgctacctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgg

SEQ ID NO: 23884 - DNA, 490 bp, Homo sapiens
gggcttctgctgagggggcaggcggagcttaaggaaaccgcagataagtttttttctctttgaaagatagggattaatacaactacttaaaaaatatagtcaataggttactaagatattgcttagcgttaagttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtca

SEQ ID NO: 23885 - DNA, 488 bp, Homo sapiens
acgtctgggtacaaatgagtatattgtaaaaagtataccatcaacacactgacaatctttatcagtatttcctagtagaagaaacatgaaagtcggagcaggtaggactaaagaatgctagtgtacacaggaccatcagatgccttttagtagaagaggtctagagccttgcggaagagcttcccaccctgtacagagaatgtgttgcctgttctttgctttctgaaaactcttgcctattatcactctgtgattaattctgcactaggctgtctagagctttcacatttgggatcattttatccccgtctctcaaataagttcatgggttcattatgtcgcacatatcttatcttacatgcaaatgtaaatctgttgcacccttaactcacaggtctgagtatttttttctaccacacaaagttttttgcaaaaattaaaaaaattgataacattaaatggttacctgagaaaagaaagaaagtcct

SEQ ID NO: 23886 - DNA, 100 bp, Homo sapiens
  misc_feature 4: n = A,T,C or G
ccanatgataacttccagactgaagcactatggccttgggtgggtactcctggccaacgctgggcctgacacccatggctctcaactctttatcacattg

SEQ ID NO: 23887 - DNA, 100 bp, Homo sapiens
  misc_feature 13, 21, 50: n = A,T,C or G
atatagtaccgcntgggaaantagaaaaattataacctagccttttatgncaaggagtaacccctatacgttctgcataatgaattaactaccaaataca

SEQ ID NO: 23888 - DNA, 489 bp, Homo sapiens
  misc_feature 14, 16: n = A,T,C or G
tgctgaacatcatngnggcggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttc

SEQ ID NO: 23889 - DNA, 148 bp, Homo sapiens
  misc_feature 11, 32, 65, 71, 79, 81, 93, 94, 132, 146: n = A,T,C or G
cacagggggantttcggcccctataatagggncccggggttatttaaattattgtttgtattatnaaggtnaaaaaaananaaaccttggggnngccccttttttttttttttgggaaaattaaaaaccttnccaaaattaaaaangg

SEQ ID NO: 23890 - DNA, 499 bp, Homo sapiens
  misc_feature 4: n = A,T,C or G
aganggaccggggtgtacaagcagggttagtgcctttcccttagatttgaatgggcagccaagggccatcccacatggaatgagatttacaggctaaatgtggtggctcatgcctgtaatcccagcactttgggaggctgaggcaggaggatcgcttaagcccaggagttcgagaccatcctgggcaacgtagggaaatcctctctctacataaaataaaaaacaagccaggtgttgtggcacatgcttgtgatcccagctacttgggaggctgaggtgggaggattgcttgagcctgagaggttgaggctgcagtgagccatgatcataccagtgcactccagcctgggtgacagagtgagaccctgtctcaaaaacaaaaaagagagagagagacagagagagacttctagtgtgaaagacagagacccaaatgaacagaaaaaaaaatttgagaagtcacaaacagggtcgtatggggaaaaaaaggcacattcat

SEQ ID NO: 23891 - DNA, 493 bp, Homo sapiens
acccaaataaggaatgggagaggtgacatcactatagattctgtagatatgacggataaggtaatgttgtaaacaactatggtagatagcctctaagatgttcttcgatgattcccacctccttgtagtcacactcctatgaagtcctctctccttgagtatgaggtgaacttactaacttgctttttagtgagatgtcgcttttggcattagttcacaaaaactgtggcttccaccttagagctctctcattgtcccactaactcccactctgtgggaggccagctgttgtgttataagctgtcctgtaaagaggcccccattggcaaggaactgatgtttccagcctgcagccagcaagtacctggggcttgctaacagccatgtcagtgaactttgaaacaggtgacaccttgactgtattgttgtgacaccttgactgtattcttatgtgaaaacctgagccacaggcacccaactaagctgtgactta

SEQ ID NO: 23892 - DNA, 490 bp, Homo sapiens
  misc_feature 50: n = A,T,C or G
ccgggcagtgcatgatgtaagcaaaatgtaacccacagcattgaaaaagnaggaaatggagcttagtttggtgatgtcccagagatgggacagcaatattgaagaacattgtgccaaaaagagatcactgtgcagaaatacccacagaagttcaactgaagatgatgactcatcttcaggagaagaagtggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaatttggaagacctttcacagacaaacaaaaatacag

SEQ ID NO: 23893 - DNA, 425 bp, Homo sapiens
tattcatgaaagcatataaattaaaatatttaaaattagatatgattcacactatattctgtttcatatgcagattttattctcacctgggccatttgcagatgagactgtagtttgcagatgagactgtagtttgcagatggcgtggaagcattcatcaggggagataaccataaaggatttggcctaattaccatactcaattgtcagtttacgtggttttgtgaatactggcaaaagcaattgtttttaaattaacaatggagagaatgataagatgagggaaggaaaaggcattcattattgacttacatgtcagtaaggtctgcttttatttctatgtactcctgtttgccaagctcaataatggacaaaggatacaaacacacacacatctactattttagataaatgtactgttatat

SEQ ID NO: 23894 - DNA, 498 bp, Homo sapiens
  misc_feature 1, 7: n = A,T,C or G
ncatganggaccgggcagcactaccaagtactggaaacccaggcatagtctgatacctgagccatctcttcttgtgctacgcctagttattctgtcccccaaatcaaaaggcatgacctttataagaggcgctttactgacaatagctgcaattttaactttgaaaatgattcagaattatcaaagatagtagattcgaatgacatgattgtctataatctcgctagccttgtactgtgtgtgcatagcaattacagggaagtaatctagctcctgactattatgttgaactatgtcgctgctttttacaaacttgtcttgatccaaagcagtcacaatgataaccctgcatatctgggaatcataagtcaactatgtatccctgtgtgtgtatatatattgtatgtatgtatctattttcaaactgtgatttaatatttaaatattcctactgccatttttgtgactgaaaaactacacatgaggaaacgtcttaga

SEQ ID NO: 23895 - DNA, 132 bp, Homo sapiens
  misc_feature 2, 10, 52, 53, 120: n = A,T,C or G
cnttctgacngccttgaactttctggggctcctatggaatcaattacatatnncatttgtagtgtcccacacgcaacttacgattcgtaggatacatcacaatataccatcagactgccnaccagagttgtc

SEQ ID NO: 23896 - DNA, 121 bp, Homo sapiens
  misc_feature 90: n = A,T,C or G
tggaccggggaaggaggctgaggtggaaggcattgcctgagcctaggagttcgaggctgcagtgagccatgatcacaccactgcattgcngcctgggtgacagagtgatacccctgcctcc

SEQ ID NO: 23897 - DNA, 367 bp, Homo sapiens
  misc_feature 365, 366: n = A,T,C or G
atatcaaatatattttctaaccacaatggtataaaaagacaaatcaataagagaaaaactggaaattttacaactgtgtggaaattaaacaacacacacctaaacaatatgtcaaagaagaagtcaaaaatgacatttaaaaatatcctgagacaaacaaaagtggaaagactatgggatgcagcaaaagtattcctaagaggaaagttcacagtgataaacacctacataaagaaaaaggaaagatctcaaataaacaactttaaagctcaaagaattagggaaaaaaagaatagacttagcacaaagtaattacagaaggaaggaaataataaaggattaaagcaaaaataaattagagactnnt

SEQ ID NO: 23898 - DNA, 459 bp, Homo sapiens
  misc_feature 4, 21, 27, 30, 33, 34, 35, 48, 53: n = A,T,C or G
aganggtaagttggggatganggagcnggntgnnngatgaggccggcngcgcngggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaat

SEQ ID NO: 23899 - DNA, 227 bp, Homo sapiens
tatgaattaaaatgaaggataaaagggaaggaaaatgaacatagaacaaatagacaacaaacagaaagatgatacatttaaacatgaatatgtcatattaccttatatgtaaatgcactaattctccaattaaaaaacatagattgtcagtgtatttaaaaaataccaaaaatatactttttacaaaagaataacattaaacataaggatagagaaaacttgaaagc

SEQ ID NO: 23900 - DNA, 207 bp, Homo sapiens
  misc_feature 9, 22, 206: n = A,T,C or G
taactgaantctcagagtaatnagcaaaagctacggaataattctaagaattagatgtttccattatcattaaaaccaaggatccatgaggggcagaagggaggattcaaagatttaaaaaaaatcaaattttagaccttggttaaatattaactggaatgggatcttggaactcccaactttaatttggtgtaataaaaatgatnc

SEQ ID NO: 23901 - DNA, 100 bp, Homo sapiens
cttcaacaattcggaaaatcaagtcttccaaaaattcagctgctaatagagaattacagaagaaactcaaagtaaaagataacaagaagaacagaaccga

SEQ ID NO: 23902 - DNA, 417 bp, Homo sapiens
aggtgccaggatttcttattcaacagaatgtaaacacctgtacatatgtacacaggactgtcagcttgaatgtttgttaaggaatttattatatgcaaacacaagtaccactactaccatagaaagcaactggacaaatagaagccttgacaccttggaatccatgtattaaagacagagcctctgtcattctaagggtctttgagtgagggtgtggaacacagcccaccaaatgaatatgatcaaagaataaatttctcatgttaagtcactgagattccatgatttaccttcatagcaattagctcaatattttttcgcaatattctagtcattcttcttctagtcttgcctccaaccatgtgtttcattttttaaacaatggttggtacaaatctagggaaagaataggtgatt

SEQ ID NO: 23903 - DNA, 398 bp, Homo sapiens
  misc_feature 2: n = A,T,C or G
gnattcagtacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctacttttgagtgctgtctccatgtttgatgtatctgagcaggttgctccacaggtagctctaggagggctggcaacttagaggtggg

SEQ ID NO: 23904 - DNA, 440 bp, Homo sapiens
  misc_feature 2, 6: n = A,T,C or G
cngggnttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagcccccgaattaataccaatagaagggcaatgcttttagattaaaatgaaggtgacttaaacagcttaaagtttagtttaaaagttggggggtgattaaaataattttgaaggcgatcttttaaaaaagaga

SEQ ID NO: 23905 - DNA, 450 bp, Homo sapiens
  misc_feature 10, 16, 431: n = A,T,C or G
gaaaatagangggcantttcggcgattatggaccgggggtagcacacagggctaaagctgggcaggctgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggtagccacagttggtgtggctggttcaggggctggcattggaaccgtgtttggcagcttgatcattggctatgccaggaacccgtctctcaagcagcagctcttctcctatgccattcttggctttgccctgtctgangccatgggggctttttctg

SEQ ID NO: 23906 - DNA, 293 bp, Homo sapiens
  misc_feature 5: n = A,T,C or G
atccnaaagtgagcttcaggaagggtttgtaggatatccgaagaatgtcagtccttccgggcagcagagttctcatcttcattgtatatgagcccctgggaagtgtgtgaaggatgcccttgtccaggctccacctagagacggacgcagtggatctagggacttttgagagctccaccggcagctttagggtcatgtgaattcctgcctggccgcatgttccatcttctctcctggcccagcctgccagtcatggaagattgagaggctagttactcatctttcttcattat

SEQ ID NO: 23907 - DNA, 408 bp, Homo sapiens
tatggccggggaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtggtctgctgtgtgaataaataattcctgaagaatgaagaagattaattttggggagttctttgacgaactttgatatgtggaaaaagtatttataatttattgtaagaagaaagtaaaaatattactagtgc

SEQ ID NO: 23908 - DNA, 264 bp, Homo sapiens
  misc_feature 2, 4, 25, 27, 30: n = A,T,C or G
ancnggcatgccctgcaccactacngngcntgcctaggaaacaacatatgacgcactctcccctgaactctacacaacatattttgtcaccaagaccctacttctaacctccctgttcttatgaattcgaacagcatacccccgattccgctacgaccaactcatacacctcctatgaaaaaacttcctaccactcaccctagcattacttatatggatatgtctccatacccattacaatctccagcattccccctcaaacct

SEQ ID NO: 23909 - DNA, 454 bp, Homo sapiens
  misc_feature 164, 205, 245: n = A,T,C or G
atgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacncccaatgtaagaagtatgacaagtgctgtcccgattatganagtttctgtgcagaagtaaaagataacaagaagaacaganctaaaaagaaacctacccccaaaccaccagttgtagatgaagctggaagtggattggacaatggtgacttcaaggtcacaactcctgacatgtctaccacccaacacaataaagtcagcacatctcccaagatcacaacagcaaaaccaataaatcccagacccagtcttccacctaattctgatacatctaaagagacgtctttgaca

SEQ ID NO: 23910 - DNA, 119 bp, Homo sapiens
  misc_feature 14: n = A,T,C or G
ccagcggtcacggnggactcaccagttggcagaactaaatgagaagaagaatgaaagactccgtgctgcctttggcatcagtgattcttacgtagatggcagctcttttgatcctcagc

SEQ ID NO: 23911 - DNA, 473 bp, Homo sapiens
  misc_feature 22, 59: n = A,T,C or G
gatcaactctaggatttaggcntgttaacttctgttgtgttttgaatctctccagaggngcctgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgct

SEQ ID NO: 23912 - DNA, 450 bp, Homo sapiens
  misc_feature 1, 5: n = A,T,C or G
ngctnatgccccatctcccctcaaaattttgtagaggttctaaaaagaaagtggtatgttgtgtgatgatcagcactaagtcctgcattcctgttaaagccacttgggtcataagaagggagtaaaaaatgaagtctgactagaattctattgcagaggccaagtacatttagtatggcattgagttgtgatatagttttactttgacgtgcattttgaatttcagctacacctagatagacgtaaaatgataattaaaatgctgtaaccaacttatctaataaaattggcaaccagccactattttgttgactatgagaaagttaaaagtttatgttaatttttagggtctgatagaatatttcatgtgtattacagtggtattcatatgctatgtctctaaactttattttcaaaagcttaaggcccaaatacaaacttctctggaat

SEQ ID NO: 23913 - DNA, 334 bp, Homo sapiens
atggaccggggaaccttatctgatagggaatcatatagtgtttgtaggaagtgattctttgggctgtggagctacattctgtcctgtaccaatatagtactgtcaactcaaagaaaggaagaaatctgagttggatgttaatcaggaaaagtgactgaaacgtcttcaactcaaagagctgaacagctgagcagggtgtaacagatcaaatagagagtgcccagtaaagcacagcaatatagcaggggagaaaaagtatagcagaagtagccaactggtggtctatgacttagttctagtctacaggtgtgttttgtttggctcccagaatgtc

SEQ ID NO: 23914 - DNA, 488 bp, Homo sapiens
  misc_feature 277, 319, 380: n = A,T,C or G
tcctgcttacatttattaaacttctgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagngcatctccagacatagtaaggggttgctctgaccaatcaggngatcattttttctatcacttcccaggttttatgcaaaaattttgttaaattctataatggngatatgcatcttttaggaaagatatacatttttaaaaatctatttttatggtaagaactgacagaggaatttgctttgtataatgcaggctggctttacaaaagcact

SEQ ID NO: 23915 - DNA, 341 bp, Homo sapiens
  misc_feature 2, 7: n = A,T,C or G
tncggcncttatggaccgggcattgaagaaagtatttcattttccgcgcatccacttgttgcagtccaagtcctctagtgcaacgccatagcaaatataaagatttactatgcacgtgatacattttatggagtgcctcaagccaagatagtgaatttatatgaagggtgtgaaatgtatttctttactactatagtagtttagttataactttgcatctataattgagctttctcatctgtcaaatgctatggttttcttaaaatgttacaattctagatctatccaccttgtttttttattgtctacaaaccattaaatgtaaatattgtttttagagc

SEQ ID NO: 23916 - DNA, 431 bp, Homo sapiens
  misc_feature 23, 430: n = A,T,C or G
aacggttcgtttttcctttagtnaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagcctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattaccctagaagtttgtcactgacttgtgttcctgaactatgacacatgaatatgtgggctaagaaatagttcctcttgataaataaacaattnc

SEQ ID NO: 23917 - DNA, 400 bp, Homo sapiens
  misc_feature 2, 4, 29: n = A,T,C or G
tnancgtcaatttcggccattatggaccngggttttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcct

SEQ ID NO: 23918 - DNA, 216 bp, Homo sapiens
  misc_feature 5, 29: n = A,T,C or G
aattncggcccttatggaccggggtagcntcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctcccc

SEQ ID NO: 23919 - DNA, 424 bp, Homo sapiens
  misc_feature 6: n = A,T,C or G
ccgagnatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgc

SEQ ID NO: 23920 - DNA, 434 bp, Homo sapiens
  misc_feature 25: n = A,T,C or G
ggtacaaacgacacaggttaggagnacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtga

SEQ ID NO: 23921 - DNA, 500 bp, Homo sapiens
  misc_feature 5, 15, 35, 44, 76, 231, 250, 439, 489: n = A,T,C or G
gagcnggcatgtctngatactgcatttgacaggcntatgcaagngcagcaatgtgctcacgaaagcatgatgttgngaatgcctttatttggaattcactggtcttaccatgtttgccatcatcctgaagcttggcttgatagagtggcagaatgggcttttgaagattcagttatggcgccagttgataaaataactttgtggagctgatttagtacccgatgagatgcngaacatactccgaatcagngactaatttatgatgtagtttcccccacagcaaagatacgaagttttaaaaatcaaggaatgcaaatgggagtagtgtcttttactgtacatctaatgatctaccaaagttttggcttttttatccccacaacattaaactctgctagtttagaggtctgggtttccagggcaggaatacttccaccanggaacacaacagtgagtccatttaacaggaatctgagactgtcatctggncactttgtcag

SEQ ID NO: 23922 - DNA, 436 bp, Homo sapiens
  misc_feature 2, 7, 14, 26, 76, 109, 229, 431, 432: n = A,T,C or G
gnagggnactcggnctggtgctgagngcaagcaaaccatgaaggacccaggagatgtaagatcccctgcaactggnagaagcaatttggcgcggagggcaaataccagntccaggcctggggagaatgtgacctgaacacagccctgaagaccatgaactggaagtctgaagcgagccctgcacaatgccgaatgccaaaagactgtcaccatctccaagccctgtggnaaactgaccaagcccaaacctcaagcagaatctaagaagaagaaaaaggaaggcaagaaacaggagaagatgcttggattaaaagatgtcacctgtggaacataaaaaggacatcagcaaacaggatcagttaactattgcatttatatgtaccgtaggctttgtattcaaaaattatctatagctaagtacacaataagcnnaaac

SEQ ID NO: 23923 - DNA, 428 bp, Homo sapiens
  misc_feature 2, 3: n = A,T,C or G
gnncctccgagaaacacaagtaaaagaagtgaaagaaaaatttgaaaacaaggaaaagaaacttaaagcggaaagagacaaaagtattgaactacaaaagaatgcaatggaaaaacttcatagtatggatgatgcctttaaaagacaagttgatgcaattgttgaagctcatcaagctgaaatagcacagctggccaatgaaaagcagaagtgtattgattccgcaaatttaaaggtattgtccatcaaattgaaaaagaaatgcgtgaacttttggaagaaacatgcaagaacaaaaaaacaatggaagcaaaaattaagcaacttgcttttgctttaaatgaaattcagcaagatatgtgatggttctgagaatgaatttaattgaaatagaccagcagacctattgtaaaaatgattaaatattg

SEQ ID NO: 23924 - DNA, 269 bp, Homo sapiens
  misc_feature 3, 80, 118, 135: n = A,T,C or G
tanggaccgggaggaaaacgggggatccacttccgccatgcgatgcatcccagacccccgatgtcgtgttcgcaagcatnctagcagccttctccaaagccacatgtaaagacttggntatgtttatctaatgtngggtccaagaaggaatttctttccatccctgtgaggcaatgggtgggaatgataggacaggcaaagagaagcttcctcaggctagcaaaaatatcatttgatgtattgattaaaaaagcacttgcttgatgtgc

SEQ ID NO: 23925 - DNA, 497 bp, Homo sapiens
  misc_feature 13, 25, 32, 33, 43, 45, 48, 50, 62, 483: n = A,T,C or G
aaataaaacgccnttcggccctgancgagcanncatgcttatntntcngngaccgccacccnggaggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggntttactaaaaaacg

SEQ ID NO: 23926 - DNA, 491 bp, Homo sapiens
  misc_feature 1, 2, 222, 461: n = A,T,C or G
nncctataaccagatttttaaagccactaggttttaaatcagtgggtatcataaaagccatatataaaagatcctttcttatagtaagacttgtgcttgttagcaggtttttctgttagtttttcccccataacatttaattattactaaaattgtatttacaatagtggtgccaaatcaaatggtaatttaaataaaatctattctgtgtttatgtagggnggtataaaaaagaggtcttcatttagacatgtgatttctaaaattccagaaagcaaaattgataagatgttagaaatttggaccattatttataatcagggtagcattaaaatggagaaaagaaagttttctgaaaaaatgcagtaaatataagccacatttctaaagtttatttttatgaaagcttcttttaagattttgaaatctattctgcattcccaagagtttatgtttattgnattttatatgatctacaacatataaaattg

SEQ ID NO: 23927 - DNA, 497 bp, Homo sapiens
  misc_feature 8, 11, 38: n = A,T,C or G
atggagcnggntaacctgttctttaaatgaaacacaancaaattggccactggtaaaactctgcagcttcaactgtacttcatttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatggtggtgaaataaagaaataaaacacaatacttttacttgaaatgtaaataacttatttatttctttgctaaatttggaattctagtgcacattcaaagttaagctattaaatatagggtgatcatagttcctctaccaagtctggaaagaacatctcctggtatccacaattacaccaggttgctaactgtatttgtacatttccctttgcattcgcttttgttcttgctagaagcccagtgtag

SEQ ID NO: 23928 - DNA, 490 bp, Homo sapiens
  misc_feature 3: n = A,T,C or G
tgncgaaaccccatccctactaaaaatacaaatattagccgggcatggtcatgcatgcctgtaatcccagctactcaagaggctgaggcaggagaatcgcttgaacccaggacgcagaggttgcagtgaactgagatcacgccactgcactccagcctgggtgacagagcgtgactctgtctcaaaaaaaatggacacagagagcaatggaacagaataaagaacccagaaataaagtcacatatttacacccaactgatcaactgttggtttacacccaacaaagcaacaaagccaacaaagcagtcaagaatatacactgaggaaaggataccctcttcaataaatggtgctgggaaaagtggataaccatatgcagaagaatgaaactaaacccctatctctcatcatatacaaaaaacaactcaagctggattaaagacttaaacataagacctgaaactaaaaaactgtttgatgataacatagg

SEQ ID NO: 23929 - DNA, 490 bp, Homo sapiens
  misc_feature 23: n = A,T,C or G
tcctgtgactgagagcacatagnattccttctttttaggtagagcgcaacagtcaccatgacttcagtgtttgcatatggaagctaaaatctgtctgagaaagggcaaacaatcacaggagtcattgatttatttatttgttcatttttaatgcaaattttaattgagtgaaaaagtggtggaaaaaacagttgactaaagaagatatgagaagggttaatacatgaagaagtcctcaataatattagccaccatggagatgcagattaaaaccacaatgccatactactttccatccacaagaatagctaaaattaaaagaagtcagtcaccactgaatgttggtgaaaataggaagcagctgaaactctcttacatggctggtggaagtgtaaaatggtaccattcctgtggaaaactaattgacagtttcttagaaaaaacactcaccctatgagcaagcactcctagttatttacccaggagaaat

SEQ ID NO: 23930 - DNA, 172 bp, Homo sapiens
  misc_feature 7, 10, 28, 29, 145: n = A,T,C or G
gcactgnacnagggactccgcttccccnngtagattagactggacagcttgtggcaagtgaatttgcctgtaacaagccagattttttaaaatttatattgtaaatattgtgtgtgtgtgtgtgtgtgtatatatatatatatgnacagttatctaagttaatttaaaggtg

SEQ ID NO: 23931 - DNA, 474 bp, Homo sapiens
  misc_feature 5, 14, 29, 37, 55: n = A,T,C or G
gcaantcggccctnatggaccgggttctnagaagttnatattcatgcgaattggnagaactgctcgcagtaccaaaacaggcacagcatacactttctttacacctaataacataaagcaagtgagcgaccttatctctgtgctccgtgaagctaatcaagcaattaatcccaagttgcttcagttggtcgaagacagaggtgcaggtcgttccaggggtagaggaggcatgaaggatgaccgtcgggacaggtactctgcgggcaaaaggggtggatttaatacctttagagacagggaaaattatgacagaggttactctagcctgcttaaaagagattttggggcaaaaactcagaatggtgtttacaggtgctgcaaattacaccaatgggagctttggaagtaattttgtgtctgctggtatacagaccagttttaggactggtaatccaacagggacttaccagaatg

SEQ ID NO: 23932 - DNA, 427 bp, Homo sapiens
  misc_feature 3, 4: n = A,T,C or G
ccnnctatggaccgggatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtat

SEQ ID NO: 23933 - DNA, 498 bp, Homo sapiens
  misc_feature 5, 14: n = A,T,C or G
caaanacgtagtcnaatctctttcacctaaagagttggtccggatacatgtccctaaacctttggacaggaatgatggaacatttttgatgagatataggatgtatgaaactgtcgatgaaggcctgaagatagaggtcctttatggtgatgaacatgtggctcagtctccctatattttgaaaggaccagtgtaccatgagtactgtgagtgtccggaagatcctcaggcctggcagaagactctttcttgtccaaccaaggaaccacagattgcaaaagattttgcttcctttcccagcatcaatctccagcaaatgctaaaagaagtccccaaaaggtttggggatgagagaggtgccattgttcattacacgattctcaataaccatgtttaccgggagatctttagggaaatacacagacttcaagatgttctctgatgagattttgttatcattgacaagaaaggtccttctcccagatttagaattttatg

SEQ ID NO: 23934 - DNA, 500 bp, Homo sapiens
  misc_feature 2, 17, 303: n = A,T,C or G
tnattttccaggagcanaggtatgcttatactctgttggtggaggtataaattggttcagccgttgaagaaagcagtgtggctattcctcaaagagctgaaaacagaactaccatttgacccagcatttccattactgggtatatacctgaaggaatataaatcattctaccataaaaacacatgtaggtgaatgttcattgcagcactattcacaatggcaaagacatggaatcaacctaaatgctgatcagtgacagtttggataggaaaatgttgtacatatacaccatggagtgctatnagccataaaaaggaatgagattgtgccttttgcaggaacgtggatggagctggaggccatttgtcgttagcaaactcacacaggaacagaagaccaaataccacaagttctcacttataagtgggagctaaacattgagtacacttgtacacaagggaacaaagacactggggcctactggagggtgcacagggtgg

SEQ ID NO: 23935 - DNA, 443 bp, Homo sapiens
ttctccacatacgattctacttgtcaaattgcccaagaaattgctgagaaaattcaacaacgaaatcaatatgaaagaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggcttgggttttgatgaaatccggcaacagcagcagaaaattatccaagaacaggatgcagg

SEQ ID NO: 23936 - DNA, 450 bp, Homo sapiens
  misc_feature 18, 25, 30, 31, 39, 45, 56, 58, 60, 61, 63: n = A,T,C or G
agaaatggtgtttggggntggaggnagaanncatgttgnttttcnaggggcgcgcncncnnanagatggggacaaaatgggctgtttccaaggagaagacatttgtttgctccttttttgaatctcatatccagtgtttttcttcacaggttttgcacactagggaccaagaagccctcggggacactgctgagaaaagactgccgaagggaagaccagcggggatcatggaatctattccagaggaaactaaccaacagtgagcatcttcaactaaaactacccctggatgtaataagtgttgcatgcatcattcctttaattgagcagagttaactggatcaaattatttatgggagagaaaggaaaagttataaagaattatagtaatttttaatttccaccaatatactctttgtaagtgaatcactctataattactttctgttg

SEQ ID NO: 23937 - DNA, 334 bp, Homo sapiens
  misc_feature 8: n = A,T,C or G
tccggccnttatggaccggggaaggcattgaggcagtcagcgcaggggcttctgctgagggggcaggcggagcttgaggaaaccgcagataagttttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaatt

SEQ ID NO: 23938 - DNA, 500 bp, Homo sapiens
  misc_feature 11, 16: n = A,T,C or G
cttatggaccnggcanattcttattggcccgaatgcctgttcctgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcagga

SEQ ID NO: 23939 - DNA, 444 bp, Homo sapiens
  misc_feature 25: n = A,T,C or G
accggggacttctgccccacctggnacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatattatat

SEQ ID NO: 23940 - DNA, 364 bp, Homo sapiens
  misc_feature 9, 15: n = A,T,C or G
aaatagaantgcaantcggccattatggaccgggctagcatcgtctagcattttgacgttctccttgtctttgctgtgtacccctgggagaaacaaagggtgagaagaaacaagggaaaggagaaacatttgtgttttccaacttttcagtgttgatcaggtatgaccattgctatgaggaaatagacattggggattactatagcatgagggagcggggaaagggttgaaaaactaactgttgggtactatgatcactacctgcataggcgatcatttgtaccccaaaccttagcatcaagcaatatactcatgtaacaaacctgcacatgtactccctgaatctaaaataaaacttgaattt

SEQ ID NO: 23941 - DNA, 461 bp, Homo sapiens
  misc_feature 38, 39, 44, 51: n = A,T,C or G
gctttttggcagcgatacagcaacagaaggtgtccttnnaggantcccaanttaaaagaaatttgcactttgcaaaggatacaaatgatgagataaaatacctgatagtaatttgaatttcttctaggactttctatttatgtaatgagaaatcacccaaaagaaggtagtttgaaatttgaggccagacgcggtggctcacgcctgtaatcccagctctttgggaggccaaggtgggcggatcacttgaggtcgggagttcaagaccagcctgaccaacatggagaaaccctatctctactaaaaatacaaaattagccaggtgtggtggtgcctgcctgtaatcccagctactcggaatgctgaggcaggagaatcgcttgaacccaggaggcagaggttgtggtgagccgagatcacgccattgcacttcagcctgggcaacaagagcgaaacttcat

SEQ ID NO: 23942 - DNA, 416 bp, Homo sapiens
  misc_feature 5: n = A,T,C or G
ctttnaggaaagccgtgcctagagttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagacttttttgttaaataaacttttgtaataggc

SEQ ID NO: 23943 - DNA, 384 bp, Homo sapiens
  misc_feature 3, 6: n = A,T,C or G
ccnganaaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttcattctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatat

SEQ ID NO: 23944 - DNA, 484 bp, Homo sapiens
  misc_feature 3, 14: n = A,T,C or G
ccngtgcatctgcnagattaatgaccctctgagtttttgaagaaatctagttctaaaaggagaactccatcgacaactacctcttctcactatttagggactttaaaagtcttggaccaaaaaccttcacagaaacagagcatagaacctgatagagcagataacataagggcagctgtttatcaggagtggttagaaaagaaaaatgtatatttacatgaaatgcacagaataaaaagaattgaaagtgaaaacttaaggatccaaaatgaacagaaaaaagctgctaaaagagaagaagcattagcatcatttgaggcctggaaggctatgaaagaaaaggaagcaaagaaaatagctgccaaaaagaggcttgaagaaaaaaacaagaggaaaactgaagaagaaaatgctgcaagaaaaggagaagcactacaagcttttgaaaaatggaaagagaaaaagatggaatatctttaaagag

SEQ ID NO: 23945 - DNA, 245 bp, Homo sapiens
  misc_feature 7, 8: n = A,T,C or G
gcggcanngtggccgggggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactc

SEQ ID NO: 23946 - DNA, 454 bp, Homo sapiens
ctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggtcaagtaaactatgaagagtttgta

SEQ ID NO: 23947 - DNA, 499 bp, Homo sapiens
  misc_feature 3: n = A,T,C or G
tanggaccgggcagactacagtaattaggaaataaatgtaagttttgggtttatgaggaaatagtatacagtatactttaagagtaaatggaagtgataacactgtagtatattaaaaactgtgggatataccaaaagtctaattaaaggatttttcctccttagaaacataaactgtaaaacaaggaatagaagataaaaatatatgaactatgttttcatatatcctaattaaaaaaccaagcaaacctaatgacatatggaaggacttaataaaataaaaacaatgtacaatatactttatcaacaataccaacagatatttaagaaaaaggtgagcctagcagatcaaagtaagaaaaaatagagattgacatttaacattaggaataatgagacaaaaaaaaccccacaaagctattgagcttcatattgataaatctgaaaatctaagtaaaacaagtaattttaaggcaattatagttaccagtgctgtctc

SEQ ID NO: 23948 - DNA, 393 bp, Homo sapiens
  misc_feature 5, 8: n = A,T,C or G
cggcnccngtggccgggaaccagtggcatttcaattttgtttcttaattgtgtactttaatgtttagtagtattttgtggtagatcaggtgtggttcgtcctgcatactctgttcagcattttattttaggctgggtatgaagaggcaagtaaatagagactaatatttttctttcaaattatctaaggtgagatttgcttagaagaggaaaaaaggtgaaagataggaaaaaattagcttggaggatataaaataagaccataatgaatgtagaactaaaccagacacagtaggtaacagaacatagagactatttcctcatactaaaatttcagttaattcattaagtttttatttagaaaacaacaaatacagttttaactcctctatat

SEQ ID NO: 23949 - DNA, 363 bp, Homo sapiens
  misc_feature 20: n = A,T,C or G
accgggcagggacttaccancaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggacatttctctacattcctgaaacaatttttaggttttttttgtactaga

SEQ ID NO: 23950 - DNA, 403 bp, Homo sapiens
  misc_feature 294, 393: n = A,T,C or G
caagcctgtggtcccagctactcaggaggctgagacacaggaatcacttgagcccgggaggcgaaggttgcagtgaggcaaagttgcaccactgcattccagcctgggtgacagagcaacactctaaaaaaaaagaaaaaataggccgagcgcagtggctcatgcctgtaatcccagcattttggggggctgaggtagatggatcacctgagatcaagagttcaagacgagcctggccaacatggtgaaaccccatctctactaaaaatacaaaaattagcagggcgtcatggngggtgccttgtaatcccagctactcaggaggctgaggcaggagaatcacttgaacccaggaagcagaggttgcagtgagccaggtttgtgccacttgcnctccagccag

SEQ ID NO: 23951 - DNA, 473 bp, Homo sapiens
  misc_feature 4, 15: n = A,T,C or G
cccntagttggaagnaaagcacttagcaaatgtaaaagaacagaaattataacaaactgtctctcagaccacagtgcaatcaaactagaacgcaggattaagaaactcactcaaaactgctcaactacatggaaactgaacaacctgctcctgaatgactactgggtacataacaaaatgaaggcagaaataaagatgttctttgaaatcaatgagaccaaaagcacaacataccagaatctctgggacacatttaaagcagtgtgtagagagaaatttatagtactaaatgcccacaagagaaagcaggaaagatcaaaaattgacaccctaacatcacaattaaaagaactagagaagcaagagcaaacacattcaaaagctagcagaaggcaagaaataactaagatcagagcagaattgaaggagatagagacacaaaaagcccttcaaaaaatcaatgaatccaggag

SEQ ID NO: 23952 - DNA, 389 bp, Homo sapiens
  misc_feature 2: n = A,T,C or G
anggccgggagagtgaattataaggcaaacctaatgctctgtgttgtggaagagaaacagaaacaaactgactcaggaaagttaaaataaaaggatggacaaatgtgaataaaaagaaagcaggtgttgtagtcgttatagtgttttacaaggtagaattcaagcagaacagtaaatgaggcaaagaaagatgcctggtactgaaggttgaaattcatattagaaataactattacgaatagctatatagcaaaataaagtgccaatattcatgatggaaaaatcataggctatgaaaggagaagttgaaaaatatactagtcttaggggattctccttcacctgtctcatttactgacagattaagtggggaaaaaataaggatttga

SEQ ID NO: 23953 - DNA, 268 bp, Homo sapiens
  misc_feature 3, 4: n = A,T,C or G
atnntgcaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttg

SEQ ID NO: 23954 - DNA, 366 bp, Homo sapiens
  misc_feature 12, 15: n = A,T,C or G
atagaatacagnagnaacagaaagcctaaggcttgccttccttcccataaagctgggactccaaaggcctgttttctcagtataaagtagaaatcctctctggagaaagagccttttaacccaggccacacaattcccacagggagagttttaaggaatatgaattcacagttttaaaaacatcacaaaacagacaagggaaaaagaaagcaacaagaggaaacagcagcaaaatcagcggacaggcaaacctgacccacaaagtctccagctgttgaatccatcagacacggaatataaagtaggttatattatatacttagaaaaagaagagattgaaaatatgaataagaagcaagacactat

SEQ ID NO: 23955 - DNA, 454 bp, Homo sapiens
  misc_feature 7, 17: n = A,T,C or G
cgtcaanttcggccctnatggaccgggcatttcttaagtaaacataaatatttttatagatgcacaattcccaaactgtgtttttggaatactgttaacaggtgatacatgaagaatttattttctaaccaatgaagtcacaaaaactctggatttaataaagtaaaagagatttctgaacatccattagtttctcagcagccattgatgtgctaataaacattgtttatatccaaaataggaaaaacaatatgcagtgatttctaaatattttggcaactgactgctcttttccaaaacaaatctattaactccatagtgtaagagaccatcttggccgggcacggtggctcacacctgtaatcccagcactttgggaggccaaggcaggtggatcacgaggtcaggagatcgagaccatcctggccaacatggtgaaaacccatctctacta

SEQ ID NO: 23956 - DNA, 116 bp, Homo sapiens
cgtactatattaatggtggagttgctaccgctccaactctaatagaattattctatatgaaagcaaaaatttacaacgcctataggtaatctcaaagaagctgcacagtggatgga

SEQ ID NO: 23957 - DNA, 469 bp, Homo sapiens
  misc_feature 2, 20, 27: n = A,T,C or G
tnatggaccggggtagcgtnaaagttngatcgccgttctggcaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggc

SEQ ID NO: 23958 - DNA, 489 bp, Homo sapiens
tatgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagatcttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaaggtgattaaaagaccttgaaatccatgacgcagggagaattgcgtcatt

SEQ ID NO: 23959 - DNA, 491 bp, Homo sapiens
ctagccttgctcctaaagggctgttggacctggggtaattcatttaacccctctgtatctcagtcttctcctctgtgaagtttgagtaggacgatcgctgagggtctttccaggcttgtgatcctgctggaattcgagaagattctttattggtggtaatactgcacatctacatctcaactttaacatgaatatgttttgtatttagaatttaaccacttgaactcgaaaagtttgaaaataggccaggcactgtggctcacacctataatcccagcactttgggaggctgaggcgggcggatcaccgaggtcaggaattcgacaccagcctgaccaacatggtgaaaccccatctctactaaaaatacaaaaattaacccggcgcagtggtgggcacctgtaatcccagctactaggaaggatgaggcaggagaatcgcttgaacctggaaggcagaggttccagtgagccaaggtcgtgccactgcac

SEQ ID NO: 23960 - DNA, 497 bp, Homo sapiens
  misc_feature 3: n = A,T,C or G
ccnttatgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagaggaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaag

SEQ ID NO: 23961 - DNA, 116 bp, Homo sapiens
  misc_feature 9, 13: n = A,T,C or G
tatggaccnggcnggctggctgaggtgggaggatcacttgagacctgggaggtcgaggctgcagtgaaccgtgatcataccactgaactccagcctgggcaataggagaccttgtc

SEQ ID NO: 23962 - DNA, 500 bp, Homo sapiens
  misc_feature 2, 7: n = A,T,C or G
cnacccnaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcg

SEQ ID NO: 23963 - DNA, 493 bp, Homo sapiens
  misc_feature 2: n = A,T,C or G
anaaccgggcatggactccctgagtactgcacaaggcacctcttggaagtatatggccccaagtgaagaatccttgggatagagaatgacttgtattgggcattaggctattactttagaaagagtaataatgcaatttccacttttaaacagtcattctggacatatagatcagtggaatagaattgagagtccagaaatacatccagtttttatagtcaactaatttttgagaataataccaagaccatttaatgaggaaagaatagtttttccaattaatgatgctgtccagtgtgggcaacatagtgagactctgtctctacaaatttcttttttaaacattagccaggtatggtggcacacgcttgtgaacccagctacttgagaggctgagatgagaggatcacttgagcctgagaggtggaggctgcagtgagttgtgattgtgccactgcactccagtctgggtgacagagtgagaccctgtctc

SEQ ID NO: 23964 - DNA, 480 bp, Homo sapiens
  misc_feature 29, 43: n = A,T,C or G
catggcactctttggatattgataaagcnccacgccctcaagnagctggatttgacacatcaagggcagccaattactgaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaggaaacagctgagatggca

SEQ ID NO: 23965 - DNA, 427 bp, Homo sapiens
  misc_feature 2, 3: n = A,T,C or G
annggaccgggcccaaggtaatttacagattcaatgccatccccatcaagctaccaatgcctttcttcacagaattggaaaaaactactttaaagttcatatggaaccaaaaaagagcccgcattgcgaagtcaatcctaagccaaaagaacaaagctggaggcatcacactacctgacttcaaacgatactacaaggctacagtaaccaaaacagtatggtactggtaccaaaacagagatatagatcaatggaacagaacagagccctcggaaataacgccgcatatctacaactatctgatctttgacaaacctgagaaaaacaagcaatggggaaaggattccctatttaataaatggtgctgggaaaactggctagccatatgcagaaagctgaaactggatcccttccttataccttatac

SEQ ID NO: 23966 - DNA, 106 bp, Homo sapiens
gactcttcccgtggtaaggcatgatgctgagctgcgggtaccttcacctactgaggagccctatgcccctgagctgtaaccccactccaggagaagatacgcttgg

SEQ ID NO: 23967 - DNA, 398 bp, Homo sapiens
  misc_feature 2, 22, 360: n = A,T,C or G
gnggtgagtgttaatcccctgncacctcccacctgccacaggtgtgggtagagtggactgctgaggtcatggacaaaagcctgcaggcaaaaagaagaagatattggcagttagaagtggctctgagcctgctggagggttccagggctatgtggagggcacgaacagcatctgctcccctggggatgatgacaggtgacacttgggtgactcagatcttcttgccataacatggagacacatggttagaaagccagtccattgtctcaaggagaagagtcccagtttggtgctaataatcttaacacctttccaacactgttcatctccatctggaaccaagaaagagccagccttggncctagtgtctttggtaggcccgtcgtatgtacctacct

SEQ ID NO: 23968 - DNA, 500 bp, Homo sapiens
  misc_feature 9, 10, 95, 440: n = A,T,C or G
gatcacacnncgtttatagttgcaatctattcttcaattattctaagacatagacagcacttaaatgaagactcctaaactttcacatatatttnggggatgatacctataacagttttgatgcttaaaaataaccagaagtcattcacactctagggaaacttataaggaaatacaaagctgttttaaggaaagaagaaaaagctattttaacatcaaaatgtcaaacttggatttcctcttttctgtttgttagctaggatttcctcctgtttacacttcagtgttccattttcattgcgagcaggttggcaaataggtgtctttaatatagaaaacatgtttcccctgaaattatgaagttataattcatcttctatcttcaggaagcatttttaatattaacgcgaatagctattctgatgatgtttcactgttgngctgccctcctttgctctttgtaattgcctctttctactgttcattaaaatatatttaca

SEQ ID NO: 23969 - DNA, 466 bp, Homo sapiens
  misc_feature 15, 18, 19, 23, 392: n = A,T,C or G
ggtgcttaacgcggnggnnacgngagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgaacatggtgctggagaacgtgaaggagatgtggactgaggtacccaagagtggcaagggcaaagaagaagtccaagccagtcaacaaagaccgctacatctccaagatgttccttgcgcggggactcagtcattcgtggtcctgcggaacccgntcatcgccggcaagtaggggccgccttgtctgttgacagaactcactccctctgtcctatgaagacccgctgca

SEQ ID NO: 23970 - DNA, 479 bp, Homo sapiens
  misc_feature 301: n = A,T,C or G
gcaagttacttatattctagcagccaagaaagagatagatgaagaacacatcttatatattaggactgtgttgggggcaggagtaggcagagtaaccctttggatatgggaaatgaaaataaatcaaactcaaaacaagtttattatttgcttgaagctctggtaaaagataaagtgaaacctgcaaactgtaaaatgaagttgctgctacacatttctccagttttggatttcattcttggatggcctttaacttggatagaaggatacaagacagccatatatatatatatacagctgntgctctttaagatatccacttcaccctgttgtggggtgggaggaggggggagggatagcattaggagatatacctaatgtaaatgtcgagttaatgggtgcagcacaccaacatggcacatgtatacatatgtaacaaacctgcaccttgtgcgcatgtaccctagaacttaaagtac

SEQ ID NO: 23971 - DNA, 292 bp, Homo sapiens
  misc_feature 4, 151: n = A,T,C or G
aaanaatacagctcctccccaggatgacgccattttccaaagcttggcccgggcatactcttctttcaacccggccatgtctgaccccaatcagccaccatgtcgcaagaatgatgatgacagcagctttgtagatggaaccaccaacggnggtgcttggtacagcgtacctggagggatgcaagacttcaattaccttagcagcaactgttttgagatcaccgtggagcttagctgtgagaagttcccacctgaagagactctgaagacctactgggaggataacaaaaac

SEQ ID NO: 23972 - DNA, 495 bp, Homo sapiens
  misc_feature 11, 46: n = A,T,C or G
cggccgcctcnatggaccgggcatcgtcatgcacttgctgcctggnatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatg

SEQ ID NO: 23973 - DNA, 485 bp, Homo sapiens
  misc_feature 4, 14: n = A,T,C or G
gcancaaaagagcntgcctctttaacatattggccaaaggagaaaaagagaaaaaagaacgttgaaaatgtgttgtcctacttcattttcccttctgtgtcacacacagtgagaataattaacagccacttagtagatttcttttaagcagatcactgatctgggaagtgctcacttagtctcagaaaggatttggtcagtggagaagaaaatcacaactgacatttatgggtggagtctgtgggcaggagcagccagctttttgacagcagttgtgagctctgggtaactcccaccagttagtgaaattaatgccaacttctttttgtttctttagccttgccactgtttgcctaaacattcaaagaaaggcagtaattccatcatatttcttgattcacaaagcttaagggcaggcaggaggatgttcatcttatggaagcctccggttgttgagttagtgttttgcattaagatggcaagag

SEQ ID NO: 23974 - DNA, 108 bp, Homo sapiens
  misc_feature 3, 14, 51: n = A,T,C or G
tgnaaccgccgggnaattcggtccttatgggccggggggggactctgtacncatacatgacctcatttgattctccccatgacacggtgtggaagacacacagcagat

SEQ ID NO: 23975 - DNA, 425 bp, Homo sapiens
  misc_feature 2, 16, 20: n = A,T,C or G
anattataactctagnctantatagcaaggactaacccctataccttctgcataatgaattagctagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 23976 - DNA, 280 bp, Homo sapiens
  misc_feature 180, 251, 273: n = A,T,C or G
ggtgccgctgggttctgagccggagtggtcggtgggtgggatggaggcgaccttggagcagcacttggaagacactatctatgtaaaattcaaaactggaaaagtgtaaagggtacagagagacacctgcctcccaccgatgtccctcagcttccacttaccctccaggagaatgaagantccctccattggtggagtcctgtgcacagattcacaaggacttaatctgggttgccgcgggaccctgtcanatgagcatgctggagtgatatntgttcta

SEQ ID NO: 23977 - DNA, 103 bp, Homo sapiens
  misc_feature 26, 44, 49, 59, 60, 63, 89, 97: n = A,T,C or G
aagtagctggtataatcccagtatcngtcatgattaagaagtgnattgnagttctgatnnacnaacaatacatagaacgcatccaggcnctggttgntgaata

SEQ ID NO: 23978 - DNA, 355 bp, Homo sapiens
  misc_feature 23, 260: n = A,T,C or G
atatgataaaagttaattttgtnaagtgcttttctatatcttgtttgactttaatatttttgttttacataggtctctaattaacagaagatggcaaagcccagccacagcagctatgtccttcagcagctaaacaaccaaagagaatggggttttctctgtgactgctgtattgcaattgatgacatttactttcaagcacacaaggcagttctagctgcctgtagctcctattttagaatgtttttttttccaatggnaaacccaatcagcgtagtactgcacaactgaatctcagcaacatgaaaaattagtgcaggaatgtttttgatctcatttttgcagtttatgtatt

SEQ ID NO: 23979 - DNA, 178 bp, Homo sapiens
  misc_feature 12, 13, 31, 96, 114: n = A,T,C or G
tggcattatggnncggggagtattgtgtggntggggaattcatgtggaggtcagagtggaagcaggtgtgagaggcaccagcagaaggaaacatgnctgccaaagtgtttgagnccattggcaagtttggcctggcccttagctgttgcaggaggcgtggagaactctgccttatata

SEQ ID NO: 23980 - DNA, 465 bp, Homo sapiens
  misc_feature 4, 11, 32, 38, 55, 58, 60, 63, 65, 66, 72: n = A,T,C or G
aaantagaaanggcacgtttcggccgcctgancgaacnggggtagcctttaattnatnantgncnncacagnacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctact

SEQ ID NO: 23981 - DNA, 359 bp, Homo sapiens
  misc_feature 14, 18: n = A,T,C or G
catagttaaaaagnaccngctctggctggggtccgtgaagcccaggccaggcagccaaatcttgcctgtgctgggcatacaaccctctgccttcacatctctgagctatatcctcattagcgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaaga

SEQ ID NO: 23982 - DNA, 386 bp, Homo sapiens
gaaaagggaacagtaactctttgttatccttcttattagggtaacacattaagaaagatacttctgaatcgatactttaaaggtgattatagtattggtgtgaatggacacctatcaggagcctactccaaaactgcacaggtgggaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacaggtacttgttcatcaatcatggggattacatttattattggtattttcttg

SEQ ID NO: 23983 - DNA, 412 bp, Homo sapiens
  misc_feature 2, 7: n = A,T,C or G
gngtccnctgaaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgt

SEQ ID NO: 23984 - DNA, 445 bp, Homo sapiens
  misc_feature 13, 15, 29, 31, 46, 49, 52, 57, 58, 63, 65, 70, 72: n = A,T,C or G
ataaaaacggtcncntttcggcgctcgancngagcaggcatggctnatnttncccanngagtngncaccngnattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatg

SEQ ID NO: 23985 - DNA, 499 bp, Homo sapiens
  misc_feature 4, 461: n = A,T,C or G
attngctttctgaacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcacttgtgacaagctgcacgtggatcctgagaacttcaggctcctgggcaacgtgctggtctgtgtgctggcccatcactttggcaaagaattcaccccaccagtgcaggctgcctatcaaaaagtggtggctgggngtggctaatgccctggcccacaagtatcactaagctcg

SEQ ID NO: 23986 - DNA, 413 bp, Homo sapiens
taagcaaaatgcattcatacattgttgaggaaagagtcttgaactcattggattcaccaatgtttaaaatctttattgcaccaatttttttaaatctttattggttttcattgatctgatgtggttcatgattttccatgacattcactcttttaaaatgaatcataaaatccagcattttgctctgcttgtcccattacttatccataaaaactagatttaatttctactgtaattatttttttaaaatacacatttagtgctttaagaatggaataattacaggtcgggcacggtggttcaccttccgtaatcccagcaatttgggggggtgtggcaggaggatcacttgaacccaagttcaagtggagtttgagaccaggctgggcaacaaagcaagatccagtctcttc

SEQ ID NO: 23987 - DNA, 299 bp, Homo sapiens
  misc_feature 3: n = A,T,C or G
cangcatgagtatttgggtggggacacagccaaaccatatgagatcatgatgtcttttgctgagctggagatgactgaagctggttcccttccctcatgactttgtctcattatattaaggcatctgacatgcgctgcttctatggaatacagaagtataaatgactgctatgcctgcagtttttaggcaggaagaagactgaaacaatatttttgtgtcttacttcagttatctttcattctaaggggactggaacaggactagcatagattaaaaacatacaagaatgcaaataacc

SEQ ID NO: 23988 - DNA, 461 bp, Homo sapiens
  misc_feature 417: n = A,T,C or G
ataacatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgccttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggngggtgattattttttatactgtatgtgccaaagctttactactg

SEQ ID NO: 23989 - DNA, 388 bp, Homo sapiens
  misc_feature 19: n = A,T,C or G
ggtattgagtttcaacagncatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgct

SEQ ID NO: 23990 - DNA, 165 bp, Homo sapiens
  misc_feature 8, 25, 35, 78, 79, 86, 91, 97, 98, 106, 113, 116: n = A,T,C or G
accggggnaggcgtatgtggcaggnagggcaagtncttactgcgtgtggggggcgtgtcggagtcttgctagaatccnnaaataanctttntttctnnttcacaancatatgnatntattcttctcctctacaaaactgtgatccttacgtacacggtagatgtt

SEQ ID NO: 23991 - DNA, 251 bp, Homo sapiens
  misc_feature 39, 86: n = A,T,C or G
tctctcaagaaaacatcatctggtccaatctcaagtatngctgcaatgacaccatccctgaggacttccaagagtttcaaacccanaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcatttct

SEQ ID NO: 23992 - DNA, 461 bp, Homo sapiens
  misc_feature 10, 12, 27, 71: n = A,T,C or G
tactatcctngngctcctcattaattnaattaaaaccattaccttaaaatttttttctttcgaagtgtggngtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttgggaatttaaga

SEQ ID NO: 23993 - DNA, 453 bp, Homo sapiens
  misc_feature 3, 13: n = A,T,C or G
tgnttctcctggntacgtaataccggcaattacagttttcaaagcattaagtctaacataactttaaacattctcttaggtttcaagacacttctatttaatattcattggggaaaagttgtccagctatcagctaagaaaacacatgcaaatatggttgtgtaaagttaagggttataaggaaaaaaaatcagtagaattacataatactaaagttgcagttgaaagaatatccaagtatgtgttggtagttactaaaagaattatagctgttattgccttgtatttatagcccttgtttcaggttttatgattcaagtcttagtccaatctttcttttggacatttgcaatatttaccagttgtgttttgtgtagtctgaatttgctttctgtagttgagcaaacgtcttaaaaagtcatttgtaatttattaaattactttcttatgatg

SEQ ID NO: 23994 - DNA, 385 bp, Homo sapiens
  misc_feature 2, 19, 342, 354, 376: n = A,T,C or G
gnttgaaactagcaaaggncaggttatcaacgaaacttctcagcatcacgacgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtntccaaccaactngtttctgcttcaataaatcttnggaaaaact

SEQ ID NO: 23995 - DNA, 184 bp, Homo sapiens
  misc_feature 2, 3, 4, 5, 7, 10, 14, 18, 20, 22, 23, 37, 38, 40, 46, 47,51, 52, 56, 59, 65, 72, 73, 75, 80, 81, 86, 88, 94, 97,98, 102, 104, 109: n = A,T,C or G
cnnnntnatnttgnaggngnannactctacacccccnngngcgtanngggnnggcnaancctatnctaactnngntgctnntcggnangctttnaannttgnancaccnatcaagaccaaaggagtgggtgaggccaccattgtatcatatgtgacctaccgctgcaatgcacaaaagacagga

SEQ ID NO: 23996 - DNA, 483 bp, Homo sapiens
  misc_feature 1, 13, 16: n = A,T,C or G
ngggtatgactgnganccaacaaactttatttatgaaaataggccatgggtggatttggcctgcaggtcatagtttgtcaaaccctggaccagaggaacccagtatagcaaaatataaactaccaaaattgagctagggaaaatttaaaacttgaatagatgaattaatattatatttagtgtaatttcagttaaagtcccaacaaagatattttgaaattagattgtgctcttagagcatctattgaagaataaactgtgacacatgacaaagtgttatgataactataagcggaagaaattgccttatgtgctgttaatatgtaccataaagccatctttatcaaaacggtgtgacgttgacaccatagctaagcactatgtgacaccacatagttaggggcagaaaactgggacctcagccacagaaaagtcaaaatgtgacttttattgtatgccttataaagttaattttatatagat

SEQ ID NO: 23997 - DNA, 218 bp, Homo sapiens
  misc_feature 2: n = A,T,C or G
gnactcaggtatgcagagcttgccgtgagcagagattgtgccactgccctctggcctgggcaacagagcaagactcggtctcaaaaaaaagaaaaagagggttacagatcattgcacatggaaaatattcccagcagtaaccacttccattaatgtgatctacagcttttaaaagggagcatctcagaataagatggtggtacaatttgcttattggg

SEQ ID NO: 23998 - DNA, 406 bp, Homo sapiens
  misc_feature 2, 17, 34, 74, 78, 405: n = A,T,C or G
cnagggcagttcggccnttatggaccgggggaanagcaagtcattatatgaaaaagatatgaattaatggcctntgcngcaacttggataagattggagactattattctaagtgaagtaaccgaggaatgggaaaccaaacatcgtatgttctcactcataagtgggagctaagttatgatacgaggatgcaaaggcataagaatgacacagtggactttggggattcagggggaaagggtaggaagtggggctgagggataaaagattacaaattgtatgcagtgtatactgctcaggtgttgggtgcaccaaaatctcacagatcaccactcttgtaaccaaacctcacctgttccccaatgccctatggaaataaaaaattaaaagatagaaaaaaataant

SEQ ID NO: 23999 - DNA, 500 bp, Homo sapiens
  misc_feature 2, 9: n = A,T,C or G
tntctcctngctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaacta

SEQ ID NO: 24000 - DNA, 460 bp, Homo sapiens
  misc_feature 2: n = A,T,C or G
gntgtggccgaagcatgaatctttattccctcaactaatattgaaaacctactaagtcctcagtgctatacccgtaagtcaggctctcctttaacaattaggcaattggctcaatcttcaatgtaaagattgaaaaattaaaaagagaaaaagagcagaacactcaactcagcatatactaattgttgaatgaactgaagctattattgtttgcttttccaggtagctttccttactgaatacatgtggatttaggggagggtgatcaagtgctggagcaaacattttcctgattgtactttcagagaaaaatctgtgagcaaataaataatgatataagttgcaaatctcttaatgaacctaaagattcttgccacaaatttcccaatgaatacatatcttttcaatctaacagttttgattttctaagactttaaatttgattttcaatttatacttt

SEQ ID NO: 24001 - DNA, 500 bp, Homo sapiens
  misc_feature 8, 9: n = A,T,C or G
cgcttcgnnaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctctgcataagcctgcgtcagattaaaacactgaactgacaatt

SEQ ID NO: 24002 - DNA, 198 bp, Homo sapiens
  misc_feature 2: n = A,T,C or G
gnaattcacactagctgaatggtcagaaaaacattcagcttagaatctaattaaaatggtaccaggttggtagttgctcttgtcagctagcagaagcaaatgcagattctttgtgaaggaattctttatttgaccataaagaatcgttacagaattcctaaaatacattagctcccattcaaaaatctcaaaacacac

SEQ ID NO: 24003 - DNA, 403 bp, Homo sapiens
  misc_feature 16, 28, 29, 34, 44, 50, 53, 56, 62, 70, 402: n = A,T,C or G
cacaataaaacgtccnttcggcgctganngagcnggcattgctngatttntcnagnggtgcnactgccgntcctgtcacaagctgggatggatttatcacattgagttatgaaattacctggttctaagaatttttgagtggcaaaaatagaaaacaatcttcatttgaaaacatccctaagcttgaataaatggataccatagatagtttctcttttttattctggtgtcattaccagcatctgaatttcaagttcttaaaatttcaaaaattaaaatttttcattattagctatccatttatcttttacatgaacttgtcatgaacaaattcaaatgtttatgccagcaaatttttgtactgttgcatagttaaaaatgctgggagtctctgcatagatnc

SEQ ID NO: 24004 - DNA, 255 bp, Homo sapiens
  misc_feature 6, 7: n = A,T,C or G
agcagnncgttttcccatcctattttcaacctgcaaatgatggcttcccctaaaatatcttggaatagaacacatgattagagaccatttttagggtttccatcaatgctttattgatactataggagacatttaattccaaaggtaatgagaacacttgtgaacaaggtaaattcttacacagaaagagcaaatgtacgtgggaaacagctatttcctcttgcttggaagagataacttctgatccatattggc

SEQ ID NO: 24005 - DNA, 499 bp, Homo sapiens
  misc_feature 3, 446: n = A,T,C or G
gcnagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggngaggccttgacttaaaactttctttgtactgtgatttccttttgggtgtattt

SEQ ID NO: 24006 - DNA, 488 bp, Homo sapiens
  misc_feature 3, 17, 55, 105, 106: n = A,T,C or G
cancaccaaaaggcttnttattcgggtgtgagtcttttcagcaacccggtccagnactgggagatacagccatccaccttcagatgtgtctacgtgcgctctgcnnttctctcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcat

SEQ ID NO: 24007 - DNA, 346 bp, Homo sapiens
  misc_feature 3, 14, 16, 17, 27: n = A,T,C or G
ctnctacaaaccgngnnttatgatggncttgatttatgatttttcaacgttatgatgggtttattggaatattagattcgtttctgagttacactgggtttatgagtatgcgaccctacactccagaaacagctgtataaggaaaaacaggtgtacctaataaaaatatgcttagtgacttgggataaaccaatagatgttcacaagtggtggagagccgtgaaagagagatagcggtaaatagttacaataacacaattttcctgcacctgtcgaggatttcccccaaaaaacgcagaatgtgggatgcacctaaggcatatgaaagagagagggcagaaggagc

SEQ ID NO: 24008 - DNA, 323 bp, Homo sapiens
  misc_feature 2, 22: n = A,T,C or G
gngaggaaggggagaacttggngaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcact

SEQ ID NO: 24009 - DNA, 194 bp, Homo sapiens
  misc_feature 13, 16: n = A,T,C or G
cttcatttacatnaanattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttg

SEQ ID NO: 24010 - DNA, 231 bp, Homo sapiens
  misc_feature 13, 21: n = A,T,C or G
aatagtgacaagnacacaaanaagcacttatgtttatctatagcacagaaaagacaagctgttggagaaactggacagtggtgttaagtgtgcagtgtgttgcaagaagagtatggtgttggaatgactaccgtatatgacctgaagaagttcacgactctttactagtgacagctccacaaccaaggagaatagcaaaaaattaaaaatgaagtttccacctaaaatccc

SEQ ID NO: 24011 - DNA, 223 bp, Homo sapiens
  misc_feature 15, 16: n = A,T,C or G
gttatagttttgagnngggtattttatgttcattggtttttctctgtgaagcaatttttttctcctttattagatctaacttgcagtgtattttctaggctggaaagtggaaaatgaaatatattataatcttaggttacataaagtttctaaagtttcaaagagtcttgatacaaaatcagtttatattctgaaaatatttataataaagtattctaatttc

SEQ ID NO: 24012 - DNA, 477 bp, Homo sapiens
  misc_feature 12, 20: n = A,T,C or G
tatggccggggncaaaaganatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccaccgttattgttactttgacttttcagagcacacccttcctctggtttttgtatatttatttgatggatcaatagtaatgaggaaagcatgatatgtatattgctgagttgaaagcacttattggaaaatattaaaaggctaacattaaaag

SEQ ID NO: 24013 - DNA, 306 bp, Homo sapiens
  misc_feature 45, 50: n = A,T,C or G
aactcgaaaaagccgtacaaaaaataagccaaaagcgtcccaggngccgnactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattc

SEQ ID NO: 24014 - DNA, 500 bp, Homo sapiens
  misc_feature 2, 8, 46, 48, 55: n = A,T,C or G
anggcaanttcggcccttatggaccgggggagttaggtatccaggntncgacttnctatcctctgtccttaaattgtgtttattaaacgttgtatctatccttaaattgtgtttacacttcagaagttcatttttgttaatgagtagaatatttaaccttggagctattatattgtttatatttaaaattttcttcttctttcatatatttcccccactctccaatactaaaagttacccaaaatgtgctagttttattacctaatgccagttaggtattctgttcaacttgggtaaatattttaagcatccagaatggactcatgaatcttaaggtggcttgatgatgaagtctgacctgttgaatgcaaaattatataccaaagttaaatccttcttttattgaagaatcttttattagaatatgaaaagcagtcagagcaactggatgaggaaaaagaacgtgctaataattttgagcatcgtattgaagaccttac

SEQ ID NO: 24015 - DNA, 500 bp, Homo sapiens
  misc_feature 2, 8: n = A,T,C or G
gngcaacntacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagcttcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaat

SEQ ID NO: 24016 - DNA, 252 bp, Homo sapiens
  misc_feature 6, 21: n = A,T,C or G
gttganataccaagtgaagcnagggggacaaaaatggaaacaggactaagattcctgcattttgactctaaatggttcctttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgctggaaat

SEQ ID NO: 24017 - DNA, 286 bp, Homo sapiens
  misc_feature 8, 18, 30, 41, 52: n = A,T,C or G
agggcaanttcggccctnatggaccggggngaagttgtaancattttttagnatataaagcagtataaagtacttgttattttactctgaagttgtttaaaattcaccatgactttgaccgctgaagattctttaagcgggttaatttatgttttgaggtggaatacaatttacacttttttcttaaaaacatgaatgtgggtttctatattaagcatattttgtgactactattaacagattgatttgtttagatattaaatgctttaagctattttaccttttc

SEQ ID NO: 24018 - DNA, 500 bp, Homo sapiens
  misc_feature 10, 12, 28, 30, 36, 185, 465: n = A,T,C or G
aggcatgctnantttccaggggcgcgcncncccganagcagggatgacctcagtggagagtcacaagaaggactgaggcgtcttctgcaagatactgccagccaggacagaggggtctcagcagagctcagtgggcttcattcagcaagtgccagcattaccatcctttcccaagggcaaggccntgcagagcttcattgggcctccatccctctctgagatttatcagtggaaacttggacccacttgatatcgttccactgagctgcctctaatcttgcattggacaggagctttggacaaagaagggaatattaagattgtgtgtacaaaatggcacttaactgtgaaggaccacctaggagcaagatcttggaccattctgctcaacctaacagtgcagaatgctaagtaaggggaaaaccaggccacctgaagaatatctttaatgatggtattcttggngatgggaccaacaagctccagaatactacaggtac

SEQ ID NO: 24019 - DNA, 395 bp, Homo sapiens
  misc_feature 2, 3, 33, 218, 223, 262: n = A,T,C or G
cnntggaccgggcatacaatggcagtcctcgangcgtaacgagttcatctttctttcaccataggggttatagttggcttgtgctactctggaatcattttactgtttgtttttattatcctaagtgctaattaaaaaaaaaataaaattttaaaaaaacctgtagtttcattacctttttgaataatgtcatacaaaaaatgtatttgtttttttgngctgngagaattgatgtttgtagattaataatcattttgtttanaattacaaaatagtttttaaatattgtctgagaaaagccaaagttaatgcaacctagtggaaactgtaagaccatttgagtattgtttgttttattgatgcatttggattttgttgtttgatggaatttgagc

SEQ ID NO: 24020 - DNA, 500 bp, Homo sapiens
  misc_feature 3, 10, 406: n = A,T,C or G
ctngagactngcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcngggaaaataaccagttaaaccagctactcaaggctgctcaccatacggctctaacagattaggggctaaaacgattactgactttccttgagta

SEQ ID NO: 24021 - DNA, 359 bp, Homo sapiens
  misc_feature 55, 62, 83, 99, 103, 106, 130, 249: n = A,T,C or G
acctactagcaggaggctagtattagtacctacagcacattttcaatctcttgtntctgtgntctttaaatcctcaaaacagnatcaattcttatagtngggnttntcttagaacttcaacaattatagnatcataccattcagcacatgaagataagaaatcactacgtctgaaggttaaaagtaaactttagtctaacattgtctcttatttagttcatctccaacaaactatgtgccaagcattgngctacatggtagaatataacagtaaatacgacagaacaccatgacaggaaagtttaggttctagtggagaagacagacaaattaagcaactgtaatctggtatagtaagt

SEQ ID NO: 24022 - DNA, 430 bp, Homo sapiens
  misc_feature 2, 7, 27, 34: n = A,T,C or G
cnggcgnggcatatgtaggccagggcngtcgcangggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagg

SEQ ID NO: 24023 - DNA, 478 bp, Homo sapiens
  misc_feature 18: n = A,T,C or G
gttttgacgaattaaggnagatgaagcatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtggaagaagagcctgaagaagaacctgaagagacagcagaagacacaacagaagacacagagcaagacgaagatgaagaaatggatgtgggaacagatgaagaagaagaaacagcaaaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggtttttt

SEQ ID NO: 24024 - DNA, 374 bp, Homo sapiens
  misc_feature 5, 11: n = A,T,C or G
cttancctgtntcagtatagatactacttacaggtgtctatatatctaaaaatcataacatttcaagaattgaaggaatcccagccatccaagtgcctctgaatgtgaaagagaaaacagagtccaagaggttaaccattttggccaagaacattagctagtacatggcagatctgtttctcaaattgagatacttgatgtttttgctgggtaggaggagaaacaagagggacagtggccagttcacggagactatagcagtagggttctggggcgatgttgcggggagcagcatgatttatcacaacccttctgtacccagagagtccccagtgctgttttcttatccttcattagtccctcttcttgttcct

SEQ ID NO: 24025 - DNA, 331 bp, Homo sapiens
  misc_feature 2, 9, 33, 330: n = A,T,C or G
antgtcacncgcggccccttatggaccgggganggcatatgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtnt

SEQ ID NO: 24026 - DNA, 305 bp, Homo sapiens
attctgtttaagtgtttttcttacgtttttctcaatgagttaatcaacaagtatttattatgtgctgatatctttgttttagatgctttaaaggagacaggaatataattattgagtatagaagcatcagaaactattgaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaacga

SEQ ID NO: 24027 - DNA, 263 bp, Homo sapiens
  misc_feature 81, 257, 261, 263: n = A,T,C or G
gaaaagaagccactgatgctattgggcatctagacagacagcaacgggaagatatcacacagagtgcgcagcacgcactgnggctcgctgccttcggccagctccataaagtcctaggcatggaccctctgccttccaagatgcccaagaaaaccaaagaatgaaaacccagtggactacaccgttcagatcccaccaagcaccacctatgccatttacgcccatgaaacgcccaatggaggaggacggggaggaanaagncn

SEQ ID NO: 24028 - DNA, 229 bp, Homo sapiens
  misc_feature 229: n = A,T,C or G
tatggccgggctctatagtagcaattatattccattgtaactttgaatagatgatggtttagagtctaacattttcccattctttcagtctcgattttgaagagggaacagctataatgtataaatagtgagtaagctgaggtatgactgttaattctatcctcagcataggatgtttagcccatttttttttctgttgaattctggtggtgcttattataacttgccn

SEQ ID NO: 24029 - DNA, 500 bp, Homo sapiens
  misc_feature 2, 7, 117, 324: n = A,T,C or G
gncccanatgtacctcgtctacctccacacaggatttctccattagcatctttaattagtatggtatgtttgttacaattgatgagccaatactgatacattattataaactaaagnccatagtttacattagggctcattttttgtgttatatagttgtatgagttttgacaaatgtataatgtcatgtagccaccattgccatgttgtacagaacagtttcactgccctaaaaatcccttgtgttccacctatttatctctccctctttctctccaaacccctggcaaccactgatctttttgctttctctatagttttggngttttccaagtgacatatatttagcatacagtatgtaaccttttcagactgttcttttactttacaatatccatgtaagattcctctatgtctttttgtgaccttatagatcatttcttttcatcactgaattatatttcactctggatgtaccacagtatgtttattcactcact

SEQ ID NO: 24030 - DNA, 248 bp, Homo sapiens
  misc_feature 8, 101: n = A,T,C or G
atgaaatncctggcctagagtttggtagcttctaacttctattgccagtactgctaaatcttcttttttttctttttctttttttttgtgagtcatttggngaggctcttgatcagtaattttcatcttcagtttgtagatatcttaagtctcaggtgtgcaattagttatacttgaattaataaatttaaggattgaaggaaaaatcacccactgccagctgttacttgtctgattcagtgttttct

SEQ ID NO: 24031 - DNA, 500 bp, Homo sapiens
  misc_feature 9, 10, 34, 65: n = A,T,C or G
agtgtcaannttcggccccttatggcccgggggnataagaaagtcaagacactataaaaataatnagtcatagtaggataaaaatggaatttcaaacatgaaaaatgtaagaaagacaaaagctcaacagatgggcagaacagctacatgaacattattaaaggaataaaattaagaaactggaaaatagatctaaagaaatcactcaaaatcagcccaaagggcccagaaaaaattgtgaaaaaatgttgaaagacatgtagaattgagattgtggatttagtatcttataattccaaatggagatgatcctctttctccagagaggatttctattttctgagaaaacagtatggagggttaggcaaaaaacatatttaaataaatgatggcttaaaattttcccaaactgataaaagacaccaatcctcagatttaagaagtcatgccatccaaagtgaggtaaatataaagatatccccatttagatataccataga

SEQ ID NO: 24032 - DNA, 483 bp, Homo sapiens
  misc_feature 2, 7: n = A,T,C or G
ancccanatttgtttttcatgagcctattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattggtgtttaaacccatttgcatattgacttgtcagtacctttaactcaatttaatataacaagaaatcgtaaaatacttataacctatcttagagaaatgagtgctggttttgagagttgttttttaactgaaagattatttctaga

SEQ ID NO: 24033 - DNA, 177 bp, Homo sapiens
  misc_feature 1, 2: n = A,T,C or G
nngatccagggcaattcggccttatggaccggggaaaaagtttgcacaaggattccattcggccagcgcggtggtgcacacctgtaatcctaggcaccccatagactgagacaggaagatcacttcagcccaggagttcaaggccagtctgggcaacatagcaaacctccatgccat

SEQ ID NO: 24034 - DNA, 152 bp, Homo sapiens
  misc_feature 2, 3, 7, 9, 10, 12, 17: n = A,T,C or G
anngggngnngnccganatgtcctcggtttctcggctgctgggtcggtcccgcccacagctggggcggcctatgtcgagtggcgcccatggcgaagagggctcagctcgcatgtggaagactctcaccttcttcgtcgcgctccccggggtg

SEQ ID NO: 24035 - DNA, 330 bp, Homo sapiens
  misc_feature 3: n = A,T,C or G
ganaaggacttggatctgagctaaaggacagtattccagttactgaactttcagcaagtggaccttttgaaagtcgtgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggctcagcgtcttccatttctttcaagctcaaatctttcactggatgttttgaggggtaatgatgagactattg

SEQ ID NO: 24036 - DNA, 476 bp, Homo sapiens
  misc_feature 15, 21, 29: n = A,T,C or G
atgcaaggtactctngatctntttctacngacaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccggacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatact

SEQ ID NO: 24037 - DNA, 498 bp, Homo sapiens
taatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattg

SEQ ID NO: 24038 - DNA, 500 bp, Homo sapiens
  misc_feature 11, 14, 27, 34, 39, 381, 386: n = A,T,C or G
gagcaggcatnctnattttccaggggngcgcttnccganaagtgattctactgcctcagcctcccaaagtgctgggattacaggcctgagccaccatgcccagctgaatttgagctttttaataatctcattccacatagccttatagatcctgtaaatagggggggtcacaaaagtaatatattgtgttatggaagataattttgtactgtgctgtttcctaaatcataccaatatcctaaagtcatgcacttcccagatgatcgtgatcctccaaatgctttgtaagatggggcagggcgtggaaatatatatatatacacacacacacagagacacacacacacacaagtatagtatatattttcctaacctttcttntgggnccttcctcagatctttgagtcacgatagaaaaggagctcgagttctttgtgtaggaaagttaagcttcctgcctgcggtgttcttgcaattgccttaggaattcacaagctcta

SEQ ID NO: 24039 - DNA, 271 bp, Homo sapiens
  misc_feature 13, 26, 44, 46, 47, 54, 64: n = A,T,C or G
aaaatagaacgcngttcggccctganggagcaggcatgtctgtnannccagggnggcgattccnctagacagactaatgaataagcaaactctgacaaatacgtaggcaactcagaaatatgaggaaaaataaacaaatgatacacacaaatatttggctaaatctcaaatatgtatttatgctaaagaaaataaaccagatacacactcacacacacatcctgtaggaattctaattattggaatttgaagatgaacaaaattaatcaat

SEQ ID NO: 24040 - DNA, 198 bp, Homo sapiens
  misc_feature 11, 19, 23, 31, 42, 45, 52, 71, 86, 110, 117: n = A,T,C or G
gtatgacggtngacccaancccnttccaaanaaaggtcctgnggngggcttngagcccgcagacaacaagngtctgttaagagctnccgatgggaagaagaagatcagcnctgtggngagctccaaggaagtgaataagtttcagatggcttattcaaacctccttagagctaacatggatgggctgaagaagagaga

SEQ ID NO: 24041 - DNA, 438 bp, Homo sapiens
  misc_feature 1, 7, 31, 32: n = A,T,C or G
natgtcnctatgttgcactggaggactgcgnngggtcagacttgaagccagcatagcactgggtcttgtccaaggcctgctgtaaccactatctggcaaggccctagatacctggccgtacttaaggtactgttcacttaaggcccaaggactcttcagtcagcttgtggtgaatgcagccaagtctgagactcatcccttctggctcagggcaggtccagaaatgccattcaagagtcaagccttggaactggggaccccaagagtctgcttgttgccctaacccaccatagctgagctggtacctgatttttggttcttctgaaggtgtgatttttgcctagatagttgttacatttggtgttcctgtggggtggggggacaatcagtggggccttctattccaccatcttgctcccaaaggagtaaatattatta

SEQ ID NO: 24042 - DNA, 492 bp, Homo sapiens
  misc_feature 6, 17, 152, 301, 408: n = A,T,C or G
ccgggncgagatgtctngctccgtggccttagctgtgctcgcgctactctctctttctggcctggaggctatccagcgtactccaaagattcaggtttactcacgtcatccagcagagaatggaaagtcaaatttcctgaattgctatgtgnctgggtttcatccatccgacattgaagttgacttactgaagaatggagagagaattgaaaaagtggagcattcagacttgtctttcagcaaggactggtctttctatctcttgtactacactgaattcacccccactgaaaaagatgantatgcctgccgtgtgaaccatgtgactttgtcacagcccaagatagttaagtgggatcgagacatgtaagcagcatcatggaggtttgaagatgccgcatttggatnggatgaattccaaattctgcttgcttgctttttaatattgatatgcttatacacttacactttatgcacaaaatgtagggttat

SEQ ID NO: 24043 - DNA, 500 bp, Homo sapiens
  misc_feature 15, 16, 35, 40, 46: n = A,T,C or G
gttcggccgcctganngagcaggcatgtcttgatntttcnaggggngcgcctcccccatatactaagtttctgtctgtttctattagcacttggaattacagttacctaaatttacatgtagattcaattttgaacttatctgtacagttagttccacaattctttttaaagcaagtactattctctaatgccttctcagacattcacttatttccaactttaatatttatagtaagttcctctttcacgtgatgtgtgtcacaagtcacgcaaatttctgcagaagtgagttacataaattgcagtcaagctgctgacctgtaaatcattcattcttgcccccgtgatgtcatattggggttgaataagaccaggcatgactacccacttgaggatgtctttgggatgccattttaattgggtgaaataacttttattattcaacttatgtgaccagttactgcaaacgtcaaactgttacgtttaacagctagaatga

SEQ ID NO: 24044 - DNA, 412 bp, Homo sapiens
  misc_feature 11, 18, 27, 34, 36, 37, 38, 41, 47, 48, 50: n = A,T,C or G
tggcccgggtnttatgcnttaaagccnaatttcngnnnagngtaatnncntacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacat

SEQ ID NO: 24045 - DNA, 349 bp, Homo sapiens
  misc_feature 10, 30, 67, 188, 348: n = A,T,C or G
gcaagctagnaaaggatatttttgctctgntcagcagttctaaaaattgctgaagtaggggccaggncactggtagttatagtatggaatgggagaagtgaaagttcagttatagaactttccatacttccaagtttactgcaagtttttatgcttgagagagatgctttctaatataagactgatgngttgattttactgattgtactgtacatctattaaagccttagattattacattacgggttggaacccataccaatgtaatttcaatcgtgttaagaaagtaatggtgacttcacatgttattgtagttagttacattatagaatattacttatttttctng

SEQ ID NO: 24046 - DNA, 288 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagt

SEQ ID NO: 24047 - DNA, 432 bp, Homo sapiens
  misc_feature 9: n = A,T,C or G
gcggccctntatggaccgggcaagctgtttttatgaataaatttttgtgaacttctaaaaagggaaaaatcaaataatctcccagtctttggtgtagattaagatatttgatgtaggaggtttgcttgaattgatgtgtgcataggcatatttaatggacatatttacacgtggggatggaaagactagaaaatctaatttatatgtctaattttcagcttctataagtaaacttagttattttaagtaattcactgtcattctttttacctgtataatgaaaacaaataccattactcttctgtttccgagtatctttatggaagtaaagaatgtaaggaaacaagttaagaaacaaatattctgaagtttcaaaaccaacttgaaaaattttttaaattccttgttatttacaaagttatgatttgctgg

SEQ ID NO: 24048 - DNA, 252 bp, Homo sapiens
  misc_feature 29: n = A,T,C or G
gggaggcagtaggttgcagggagccaagnatcatgccactgccctccagcctgggtgacagagtgagactccatctcaaaaaaaaccaaaacaaacacaaaaaaattagtcgagcatggtagtatgtgcctgtagtcccagctacttaggaggccaaggcaggagaattgtttgaacctgggaggcggaggttgcagcgagccaagatcgtgccactgcactccaacctgggtgacatagtgagactgtccc

SEQ ID NO: 24049 - DNA, 454 bp, Homo sapiens
  misc_feature 15, 382: n = A,T,C or G
gaggagagcaccgangaagtgaaaatagaagttttgcatcgtccagaaaactgctctaagacaagcaagaagggagacctactaaatgcccattatgacggctacctggctaaagacggctcgaaattctactgcagcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatattttttaaggaagaatgaccatgatgggngatggcttcatttctcccaaggaatacaatgtataccaacacgatgaactatagcatatttgtatttctact

SEQ ID NO: 24050 - DNA, 331 bp, Homo sapiens
  misc_feature 3, 26, 28: n = A,T,C or G
gcngctttttcatggtgtcccgctgngngttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgccttgatgccaggacagctgtgctctcagatgtaaatagagcaaccctatataaacctggatttttttttttttttttt

SEQ ID NO: 24051 - DNA, 441 bp, Homo sapiens
  misc_feature 3, 5, 6, 11, 17, 21: n = A,T,C or G
cgncnngatcnattggngagngagggcttctccatgacaccatagttctgcccaatactgcatttgggataagaaattctacacttggatgtctcgcttcacaataaaacacagcttaaaaataaaataactgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtgtcttgtgtttacagttctgatttattcctttgaaaagcctgctgttttggaaatgcacagttgacatgttgaaataaaaatgaata

SEQ ID NO: 24052 - DNA, 195 bp, Homo sapiens
  misc_feature 3, 4, 79, 132, 169: n = A,T,C or G
gannttagatgctacagctagctaactgtatccctagaaatgatgaataatttgccatttggacagttaacatccaggngttacaaagtcagtgttaattctaaagatgatcatttctggcccctttttaanaaaatggggccttttgggtccccccccctattcccanagcccaggagaaatggaaaattatgg

SEQ ID NO: 24053 - DNA, 186 bp, Homo sapiens
  misc_feature 7, 11, 25: n = A,T,C or G
gaccctntgcnggtcctccaaagcntcctcagtaggacctgcagaaggtcaaaaattttctgctttcacgttggatggaggtcaagactaagtcagctcaactgtaaagaaaatgatgcttttccctttgaaaactggtacaagacaaggatgtcctctctcaccactcctattcaacatagtatg

SEQ ID NO: 24054 - DNA, 366 bp, Homo sapiens
  misc_feature 3, 12, 13, 15, 26: n = A,T,C or G
ctntggaaagannancggtcttgacntataccaaaattttttaaaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaattatgtttcttatagctatgtgtggtttctgggtcgactgaaaacctaccatttgcttttctattcatctttataatggactttcagaagtgcattagacaaggcccctaaccactttgggatcctttctgttttgctgcaaccatattcctt

SEQ ID NO: 24055 - DNA, 500 bp, Homo sapiens
  misc_feature 6, 16, 29, 33, 35, 38, 39, 46, 56, 57, 60, 61, 456: n = A,T,C or G
aggggnaggtttgggngataggagggagngggngnggnngttgttngccaggcggnngtnngggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtanggtgattaaaataattttggaaggcgatcttttaaaaagagatt

SEQ ID NO: 24056 - DNA, 142 bp, Homo sapiens
  misc_feature 14, 20: n = A,T,C or G
gagtgccacagtanccgaancccgagctgccgccgcagccacagccgagggcactatggcttctggagttacagtgaatgatgaagtcatcaaagtttttaatgatatgaaagtaaggaaatcttctacacaagaggagatc

SEQ ID NO: 24057 - DNA, 500 bp, Homo sapiens
  misc_feature 2, 3, 39, 41, 44, 46, 53, 458: n = A,T,C or G
annagagggagtttggggggtgggggagcgggtgtgccngntcntnaacgggngcgcgttgcgcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatgggntatgtttttcttgtgtgtcagttttcatagtatccatatttt

SEQ ID NO: 24058 - DNA, 451 bp, Homo sapiens
  misc_feature 9, 14, 37: n = A,T,C or G
accgggcancaagnccccaagccaggagtaaacatgnaagcaaagttacaagaagacacatgataataaatttagcctaaaactagttatgaagagaaaatcttaaaagcagcccaagaagtcctgtcctgtagagaggaacaagattaaggatgacaacatattacaagctagaaggcagtagaccgatgtctttaaagcactggaagaaaaatgttgtcaatctagaattctttatccagtgaaaacatctttcaaaaatgaatatgaaataaagattttttctcacacctacaagagctgaaagaaatctttgccagcagacatgcctcgaaagaaatggtaaatgaagtccttcaagcagaagaaaaatggctctaaaaggaaatgtgtgtttacataaaagaatgaagagcactagaaataataaccatgtgggtaaatagaaagg

SEQ ID NO: 24059 - DNA, 244 bp, Homo sapiens
  misc_feature 14, 16, 39, 170: n = A,T,C or G
atatggcgcggggntngcgaagggtaatgtggcaagccntgccagtgtacctgctggtggggctgtagccgtctctgctgccccaggctctgcagcccctgctgctggttctgcccctgctgcagcggaggagaagaaagatgagaagaaggaggagtctgaagagtcanatgatgacatgggatttggcctttttgattaaattcctgctcccctgcaaataaagcctttttacacatctgag

SEQ ID NO: 24060 - DNA, 341 bp, Homo sapiens
  misc_feature 5, 10: n = A,T,C or G
cgctnccccngaaactcattttagaggggcttttaagataaattattcacaaaagtcaaatctaacggaggcctggcctttgtttcacttattctttattttaaaatgaaaatgttttaattagtttatgtttattaaactaaaacatgctcataaaaatgtagacacataggacatttaaaaacaccaaaatctcacccctcttcaagttaagctagtaatgtgtttgtgtatgtcctttaagatgttacatgtattttaaagtagaatcatcttattctcactgttttatatgtctgttcttgttttgagaatttttgtgaccatattttcaagtctat

SEQ ID NO: 24061 - DNA, 498 bp, Homo sapiens
  misc_feature 14, 21, 41, 44, 55, 57, 60: n = A,T,C or G
tatggaccgggggngcattgngcaatatggaggggggagcnggntcgccaccttngngantaccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttac

SEQ ID NO: 24062 - DNA, 309 bp, Homo sapiens
gggtgagaaaggtcctggtccgcgccagaacccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgtcaaagagaaggcagagaaactgaagcagtccctgccccccggtttggcaagtgaaggaactgaaatgaaccagacacactgattggaactgtattatattaaaatactaaaaat

SEQ ID NO: 24063 - DNA, 215 bp, Homo sapiens
  misc_feature 7, 8: n = A,T,C or G
actgcannatttactttaaggctcatattctccaagtctattctgctttaaaaagaagacaagaaaagaagtggtttatcaaaatcacgttataatcagattttgaccaagcattttgtaagattgccaagcatgcccacggacatggaacacacaggacattacctacatcttgcctttctgatgacaacagttttttctttgtctcctggaac

SEQ ID NO: 24064 - DNA, 498 bp, Homo sapiens
  misc_feature 6, 20, 29, 34, 469: n = A,T,C or G
atggancaggcatgcttttntgcaaggcngcgcngggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccctgaattaataccaatagaagggcaatgcttttagattaaaatgaaggtgacttaaacagcttaaagtttagtttaaaagttgtaggtgattaaaataattttgaaggcgatcttttaaaaagagnattaaaccgaaggtgattaaaagaccttg

SEQ ID NO: 24065 - DNA, 346 bp, Homo sapiens
  misc_feature 5, 14: n = A,T,C or G
tcgtncctcccatnttcttttcaggggaaaattttgggatgggggactcaggaggacctgtgaagcatgtagttatctagatctgggtaatttcatgtttattaaactcgaactttggctagttaaactcatattgaaacttcatctagtctcttaattttttaacactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgc

SEQ ID NO: 24066 - DNA, 367 bp, Homo sapiens
atggaccgggcaccattgttggaaacaacgttattaggaatttcccttgagcatagtctaatcacttagcaaaataaatgggttctctttcctgctgatatgaaatgacatttaacccaccccgagagattctagagaaagaggacttttgttaaatgttactgatcccagggtcctagaaaatcttcaaggactttatattttaaaatgtagttaattctagaatcgtagagggaccttacgccaactgagaaccattggttaaatagccaattacctttatcttagcccttgatatcacataaccccataaatccttaacaacaaatacgttctgttgtttacaaaggcaaaagagaggaaaaac

SEQ ID NO: 24067 - DNA, 388 bp, Homo sapiens
gaccgcagtatttctctgagtaggagtcaagcaacctggctacaagggcacgctcttccgatggcccacagagccaggttagaattgacttgctctgcacctgggcagggctgcagggagacacggtagtgttaactccaggtgcatgtaaaagccatcaatggggtgggaacccaagggcaaagagtaaggggacgcagactccatcctgggcccgagtctgatccagccagcaacctcggcctctgtgcatttcactttcctcacttgtccagcgacaaggctggctggagtcatgagcggagacagccttcatggaacagttgtgcgttcccgagactcagcaggaattctaagtcatggctttggaaaagaagcattatctaga

SEQ ID NO: 24068 - DNA, 288 bp, Homo sapiens
  misc_feature 6, 16, 31, 32, 33, 35, 40, 119: n = A,T,C or G
gaaggnaaaggagtanagaatataaaggggnnngnggganacacttccacccccaataagtcttttttcccgtcttttctttcttttcctttccttttttggggggtggggagggaganaaagggggtttgcaaaggcagcatctcagagtgatagcctagatgtattgaaggcatctcttattctgccaaatcggaaagtcagttctctaaagcccgggttagccagaccatagggttttattctggctgcagaataactggctggtgtggctttgcaaaggggggc

SEQ ID NO: 24069 - DNA, 500 bp, Homo sapiens
  misc_feature 13, 24, 35, 189: n = A,T,C or G
agaaatgtaagtntcggcgatganggagcaggcangtcttgaattttccgggaggcgtcgcaactcaaacaaattgcctccacaccttcactgaaccatgttttcaatgtggccaactttgatgcaattgtggatattcagaatgagatcatctcccaggtgtgctcaggtgttgatgaacaacttggngaattggttagtggagaagaagttgttgagcctccttcaaatttgattgccatggaagtctcttcaaaatatgttaagctaaattggaatccatctcctagtccagtgactggctacaaagtcatcctcacaccaatgactgcaggaagccgacagcacgctctgagtgtggggcctcagacaaccacgctcagtgttcgcgacctctcagcagacacagaataccagatcagtgttttcccgccatgaagggaatgacatccagtgaacccatttcaataatgggagaagactcagccaatgaaagttca

SEQ ID NO: 24070 - DNA, 215 bp, Homo sapiens
  misc_feature 5, 16: n = A,T,C or G
tgtcntgatttacacnaattgtgagcagtcttcttatgtgtcagctcattatttttgaaacatttgcctttaggctgctctttgaggtatcaatgaagtgattgaatttcaataccttaattcagtgcacataatactaatgtaacagcagatgaaaattgataaaacccaaaagagagtcatctaaatttgtagttcctatttctgtgggtttg

SEQ ID NO: 24071 - DNA, 401 bp, Homo sapiens
  misc_feature 5, 16, 41, 45, 49, 55: n = A,T,C or G
taagntcggcgatganggagcaggcatgtctgatatttcangtanctcncccctnccttaagcacaatgtcagaccaaattgcttgtttctttttcttggactactttaatttggatcctttgggtttggagaaagggaatgtgaaagctgtcattacagacaacaggtttcagtgatgaggaggacaacactgcctttcaaactttttaccgatctcttagattttaagaactcttgaattgtgtggtatctaataaaagggaaggtaagatggataatcactttctcatttgggttctgaattggagactcagtttttatgagacacatcttttatgccatgtatagatcctcccctgctatttttggtttatttttatcacaaaataaaaaaggtttg

SEQ ID NO: 24072 - DNA, 291 bp, Homo sapiens
  misc_feature 8, 19, 27, 36, 39, 41, 246: n = A,T,C or G
gcgggcantcgagggaacngcgaactntcaactccnaantnaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggnttctgtattatgtattttttggcaacgccaataaatttctttgat

SEQ ID NO: 24073 - DNA, 393 bp, Homo sapiens
  misc_feature 2, 11, 29, 39: n = A,T,C or G
cnatacgaacnggcattttggaacttcanggaaatgcanttatgataacgtttgtagacagtcacgtcatgttaggtgtctgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtctcttaagctattagaaatattcccactggggatgagggaaaaccccatgaatgcgggaaatgaggcaatatttttaagaaatgacagttcattgtacataagaaaatgctcttaggaatga

SEQ ID NO: 24074 - DNA, 354 bp, Homo sapiens
  misc_feature 15, 31, 34: n = A,T,C or G
cttatggaccggggnaggcatatgaggcagncancgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaat

SEQ ID NO: 24075 - DNA, 144 bp, Homo sapiens
  misc_feature 6, 11, 44, 76, 79, 84, 90, 94, 102, 109, 134: n = A,T,C or G
aatttngaaanaaaagaggtgactgtaactacacagactgcacntcgtatggtggagacactagggtaactgacantcntgggngaaggnaccncttgatanggtagcncgacaagagcctgaggtgccaactngggagaatgc

SEQ ID NO: 24076 - DNA, 292 bp, Homo sapiens
  misc_feature 3, 15: n = A,T,C or G
agnggggccatatanggaccggggttctttaaatgaaacacaaggaaattggccactggtaaaactctgcagcttcaactgtacttcatttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatggtggtgaaataaagaaataaaacacaatactttt

SEQ ID NO: 24077 - DNA, 395 bp, Homo sapiens
  misc_feature 49, 81, 178, 227, 263, 275, 392: n = A,T,C or G
aagactgttgttacatgtcagccttgcgacagcaatatattaaagacanctaaagattcccaaaggaaaaacatgccagcntactttccaactctccaaagctgaaaaatttgtcttttctggatgctcaagtactcagagttacaaacccactttttgtggaatatgcttggataanagatgctgtatccctaataagtctaaaatgattactattcaatttgatngcccaaatgaggggtcatttaaatggaagatgctgnggattacatctngtgtgtgtcaagagaaactgcagagaacctggagatatattttctgagctcaagattctgtaaaaccaagcaagtgggggaaaagttagtcaatcctgtcatataataaaaaaattnggg

SEQ ID NO: 24078 - DNA, 321 bp, Homo sapiens
  misc_feature 2, 3, 246: n = A,T,C or G
anntgcggcccttatggaccgggggtatgaggggcaaggaggaggatgcctttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggnttaagaatatttcagggatccttaatgttttgatttttgttttctgaaattggattttattttattttatcttat

SEQ ID NO: 24079 - DNA, 383 bp, Homo sapiens
  misc_feature 5: n = A,T,C or G
aaggnagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtaccgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaag

SEQ ID NO: 24080 - DNA, 500 bp, Homo sapiens
  misc_feature 4, 23, 30: n = A,T,C or G
catnatggaacgggctgtattgnattgccncacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactgggttaatgataacaatgcatcgtaaaaccttcagaaggaaaggagaatgtttttgtggaccactttgg

SEQ ID NO: 24081 - DNA, 348 bp, Homo sapiens
  misc_feature 3, 6: n = A,T,C or G
cgntcncaccattggaagtcaccacagattttctagtctagttaggaataatttctacaaaatagcgtggccagattggagagagaagttgcactcagttggctggctttttaatacttaccttatagccatttttagactgagagcttaaactgaacatataatcaaattttgtgttaaggaagtgagattttagcagtatttttcagttttgaagttcgaaaccatcccaaggcataggagccatagcctcaactgaaattgaatttttgtagggactgttaattgccatttgtacctaatactgtatatatacatatatatacgtgtgtgtgtgtgtatatatat

SEQ ID NO: 24082 - DNA, 500 bp, Homo sapiens
  misc_feature 8, 21, 60, 411: n = A,T,C or G
agaagggnagttgggggatgngggagcgggcgtgctgtggttgcgggggtaggcctgctnacagatttgtcatcagcaacactgaatgccagaagtcaatggatcaacatcttcagagcttaaggaaaatttttgtacctagaatttcatagtaaggcagactgtcaagaagaacatcaaagtgaagacattttctgtcaggcaaattttcagaaagtctcctttgcacccttactgaggaagtatcttgaggaaattctccagcaaaatgaggatgaaaaccaggaaagaagaagaaatgggatccataaaacagtggaccttacttaggatgtctcattctagagtgacagccaaaagggtatctcaccctagagtgacagctatccagcagactaatttcagatgagnagcatactgtctcgggctttctgggaagaatgtgcattcagtgccatagatagtatatttgaagagctgggatgcttggagaagattat

SEQ ID NO: 24083 - DNA, 436 bp, Homo sapiens
gttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaat

SEQ ID NO: 24084 - DNA, 340 bp, Homo sapiens
  misc_feature 10: n = A,T,C or G
caggacagcngcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgttt

SEQ ID NO: 24085 - DNA, 319 bp, Homo sapiens
  misc_feature 13, 20, 28, 32, 36, 37, 316: n = A,T,C or G
acatgccagcctncccattncagggggngccncctnnaaatcaccacgatcaaaagggacaagcatcaagcacgcaacaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgncac

SEQ ID NO: 24086 - DNA, 316 bp, Homo sapiens
  misc_feature 7, 8, 29: n = A,T,C or G
agtgcanntcggcccttatggaccggggnggcattgaggcagcgcagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagt

SEQ ID NO: 24087 - DNA, 500 bp, Homo sapiens
  misc_feature 2, 3, 497: n = A,T,C or G
cnnaataatgactttacacccttaccttacaccatatatgaaaattaacacaaaatgggtcatagatgtaaatgtaaaactataaaacttctagaagaaaacataagagaaaatttttgtgaccacaggttaggcaaagatttcttagatatgacaccaaagtatgatccataaaagaagaaaacaactgataaattggaccttatcaaattaaaattctttgcttttcaaaaaacatcattagaaaaggaaaagacaagccaccaactaggagaaaatatttgcaaatcatatatttggtaaagaacttgtatccaaaatatctatagaacttttataactcagtaataagataattcaattttttttaatggacagaaagttatttgagtaggcacctctccaaaaaggataaatgaatggctaagaaacatatggaaagatgctcaacatcattagggaaatgcaaattaaaaccacaatgagatagcactgcnctc

SEQ ID NO: 24088 - DNA, 175 bp, Homo sapiens
gttatacccgatgtatagatatcaacataggaacaaagaaaacatgaaaagtcaaggaaatttgacagctctaaaggaacactaattctgcaataacagattccaatcaaaaattcataaaatccaggggaaaaactggattctaaagcagctcagtgagatacacaaaaactct

SEQ ID NO: 24089 - DNA, 500 bp, Homo sapiens
  misc_feature 4, 6: n = A,T,C or G
tagntntaggaagatattaacaatatgaagcaagaaaaagaacacataatcaagaaccagatatttatttaggtcttaagatctgcataactggagagatacaccttgttcatgggtcagaagactcaatatcttaagatcggttttcttcaaattgtctatggattaaatactatctaaatcaaaatcccagcaggcaattttatagaaatggataagctaattctaaatttcatatggaaatgcaaaggacttagcccaaacaactttcaacaagaaaaataaagttgaaatgctaacactacgttatttgaagactttattataaagctatgttaattaagacagtctggtacagtcatgcaccacataaggacatttcagtcagtgacggatcacatatatgacagtggtcccagaagattacaataccatatttttactgtacctttcccatgtttagttatggttttagatacacaaatacttaccaccatatt

SEQ ID NO: 24090 - DNA, 471 bp, Homo sapiens
  misc_feature 13, 434: n = A,T,C or G
gtgtctatgaatncatgaaagctggaatcttatgaacttaatcccttcattaacaggagaaatgcaaataccttcatatcccctcagcagagatggagagctaaagtccaagagagatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcnctgcagtgagggtcaaaggagagtcaacatatgtgat

SEQ ID NO: 24091 - DNA, 210 bp, Homo sapiens
  misc_feature 5, 12, 18: n = A,T,C or G
ggtcntggaggnggccgnggaaggcagcaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattatcc

SEQ ID NO: 24092 - DNA, 315 bp, Homo sapiens
  misc_feature 7, 8, 38, 42, 45, 56, 251, 253, 285, 288: n = A,T,C or G
agtgcannttcggcccttatggaccggggggggccttnagcntgnttcgggacgcnccgagcttcgccgctcttccagcggctccgctgccagagctagcctgagcccggttctggggcgaaaatgcctgcccttcacatcgaagatttgccagagaaggaaaaactgaaaatggaagttgagcagcttcgcaaagaagtgaagttgcagagacaacaagtgtctaaatgttctgaagaaataaagaactntnttgaagaacgttctggagaggatcctctagtnaangggatttcagaagacaagaaccccttt

SEQ ID NO: 24093 - DNA, 149 bp, Homo sapiens
gaccgggatctaaactgctgggcaatccagttgacttttaaatgtaagaatggaattccaaacacttaacacattcagctatatgacagaaagtaaatctatggatatggtattttgtgaatgatcttttaaataaaagaaaaccttac

SEQ ID NO: 24094 - DNA, 500 bp, Homo sapiens
  misc_feature 3, 4: n = A,T,C or G
ccnnttttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatc

SEQ ID NO: 24095 - DNA, 452 bp, Homo sapiens
  misc_feature 2, 7, 44: n = A,T,C or G
gngctanaaattgagtggtagaagcaaactcatttatcataatncttgatttataacaaaggcaccattgcagttcagtggggggaaaactggcttcacaaatggtgctagatcagtcagatccatattttaaaaataaaacttaactcctatatcacagcatatatgcaaattagttggagctgctttgtagacctaaatgtgaaatgtgaaatgatagtttctaggagaaaatcttcttgcctttgggtttgaaatatttcttaaacagagcacaaaaaaacactaaccatggtgaaaaatccaagctgaactggatttcactaaaattaagatatttttagtcaccaaaagacaccattaagaaagggaaaagtgggagaaagtatttgtagtgcatataaccaaaaagagaactcatatccaaaatataaaaacttttaccaattaat

SEQ ID NO: 24096 - DNA, 441 bp, Homo sapiens
  misc_feature 3, 11, 40, 41, 43: n = A,T,C or G
atnatggaccnggcatggcttgcttccaaattttggctgnngngaatagtgctgcaacaaacacgggagtgcaaatatattttctatatactgatttcctttcttttgagtatatacccagtagattgttgggtcatatggtaactctatttttacttttatgagaaacctccaaactcttctccatagtggttgtactaatttacattctcatcaacaacatatgagggtttccttttctctacctcctctccagcatttgttactgccctggtgttattttgcttcttaagtattagaactatacttagtgttatatgttctgtgattataagtaaaactgcctttgctatatagtatgcatagaatattttaaagttattacctagaagctgacacattgttgttttctattacaaacaataaaattagtttccattc

SEQ ID NO: 24097 - DNA, 354 bp, Homo sapiens
  misc_feature 2, 11: n = A,T,C or G
tngaacggggnagacaggctttgggcaccacttctggggctggccgctccaacttcacaggccttcagaggcgatggctgggcgacagtgacgaaagcaaagcaaagcagggctgtggagacactcctcgcatttgtctcttccctccaaggattatctgagcaagtcgacttgttcattcaaaggcggggtctgccaagccctgctctatccaatggggatagcttctacgtaacggattccaattttaaaactgatccatctctgatggaattattaaacttagacgatatagaaaactaaaactaatctctagagtggaaagggttaaagtgaggaaggtgtacgtgaagg

SEQ ID NO: 24098 - DNA, 478 bp, Homo sapiens
aatgtaagggtcagctgtgttcctgagagttgagagagaagattatgaaagattatttaaagtgtgacttgtgtgatttctaaagctgtgttcattgtgttgtcagccagaaagctagtctaaatcaactcctagatcaaagcaagggctcctttttggcaatagactgctagattgaggaagcctgacttggttgtctgtataactttctcaaagtactaggtggccttggagcagttaccacagttagtcattaccttcttgattatgtgattgtgtggttaatagctatttcctccacttggtcacaagcttcatgaaggcacaagccttgctgttgtttcgaaaatcagcattgtggctgagtgtggggactcatgcgtataatctcagcactttggaaggccaaagtgagagaactgcctgagcccaggagtttgagaccagcctgagcaagatagtgagacatcctctctta

SEQ ID NO: 24099 - DNA, 347 bp, Homo sapiens
  misc_feature 5, 12, 38, 83, 231, 269, 276, 288, 317, 322: n = A,T,C or G
ctgtngcctgtnatagagcctgaggcctatcttctgtnataaaaaggaaaaaaaaatttcaagaaacattgaagacatgctancaccgtctacagtcttctcctttatttaatcaaaaaagatgcaaagcctgggcgtggtggctcatgcctgttatcccagcactttgggaggctgaggtgggtggatcacctgaggtcaggagtttgagaccagcctggccaatatggngaaaccacgtctccactaaaaatacaaaaatatgctangcatggnggccgcatgccntgtagtcccagctaccttgggaggctgangctgnagaatctctggaacccgggaagtgg

SEQ ID NO: 24100 - DNA, 498 bp, Homo sapiens
gaggtgggcagcagtgtagagtggttggtctacaactatcaaaatgagagaggcagctcttttttaagaaattgttttgtgatcactgtgagtctacgaagcagattgcaaaaagtagctgtagtagcaaatgaaagatcagtttgtctttgtgagatagatgggaaagacttttctttatatgatggcttttagccagacagaattattaacagttaaactcattgtaatctttagattaaaaaaaaataaaaaagcaacacgatgatcattttggtatttaaacagagagaaattagatagatgaagggtgtgtggtcgttcccactccaccccacccctaccatctttgtagagttctaggatctccacagtcaatgaagagttgaaaagtactgccaagtcctaggttgcttttggttagaatgtgtgagttaaagcacatcataccttcagattactagacagagtttacatttcttcagagctcagaatgtt

SEQ ID NO: 24101 - DNA, 154 bp, Homo sapiens
  misc_feature 129, 147, 151: n = A,T,C or G
catccgggaagaaatacgaaatggtcagcattgatgtaccaggtggcatattatttggtgcaaccatctccttctcatgtaacacagggtacaaattatttggctcgacttctagtttttgtcttattncaggcagctctgtgcagnggancga

SEQ ID NO: 24102 - DNA, 430 bp, Homo sapiens
  misc_feature 7, 16, 368: n = A,T,C or G
gctcttncggggacgntgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttccgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcncagagtcagaaagctaaataaaaaaatgaaacttttttgagtaataaaaatgaaaagacgct

SEQ ID NO: 24103 - DNA, 497 bp, Homo sapiens
  misc_feature 2, 11, 88: n = A,T,C or G
gnttcacccgngttagccaggatggtctcgatctcctgacctcgtgatccgcccgcctcggcctcccaaagtgccagtagataatgtnttaagaattcattttgtaaccaaatttatttggaaatcatttaatcagctgcatgcatgttttcagctgtattatgtctttcagtactaccctccctaaccaaatgaagtcaatggaaaactggagaaacaaatttcctcatttctgtttcttagataattcctaacatagaacccagtccctgatatttaactaagtagaccacaggatttatgcaataatctttaaaatgattcagtaacagaagaaagttaattctgcctactctgcccaaatgattgaaatgcagtcctctcaagacacttatcacaaagaacctactcaaaaacgattctattaaaatataaatcccattgtggttggcagaaaaaaaaatgctgttataaatcttgacaaaccctaacatatg

SEQ ID NO: 24104 - DNA, 494 bp, Homo sapiens
  misc_feature 3: n = A,T,C or G
agnggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaga

SEQ ID NO: 24105 - DNA, 500 bp, Homo sapiens
  misc_feature 8, 18, 34, 54, 55, 57, 58, 89, 96: n = A,T,C or G
gacaactngacgggcaanttcggcgatctatggngcgggggtacgtggcttccnngnnctgtttttctcttccttcgctaacgcctccnggctctngtcagcctcccgccggccgtctccttaacaccgaacaccatgccttcaattaagttgcagagttctgatggagagatatttgaagttgatgtggaaattaccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagac

SEQ ID NO: 24106 - DNA, 333 bp, Homo sapiens
  misc_feature 14, 26, 28, 30, 32, 33, 36, 38, 46: n = A,T,C or G
atggagcaggcatnctagaatttctnangngnncgntncaccgatnaacatctgtggtttccccaaccgttccaaaaggctatttcaaaggaaccagccaacgtatgagaaatgaatgtaacactgtggacattgacttcccgcataaggcagggtgaccccctgaactccagatgtctgcacagtatcttatgtgttgttttccgttgtgacgaatgtgattggaacatttggggagcacccagagggatttctcagtgggaagcattacactttgctaaatcatgtatttattcctgattaaaacaaacctaataaatatttaacccttgg

SEQ ID NO: 24107 - DNA, 497 bp, Homo sapiens
  misc_feature 2, 5: n = A,T,C or G
gntgngcgcccccacatacgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctggtgatgtttatccatgcatcgttgagacttcggaacctcaagaacaaactggagaataaaatggaaggaataggttttgaagaggacaccgatgggcattgtcctggatg

SEQ ID NO: 24108 - DNA, 500 bp, Homo sapiens
  misc_feature 4, 12, 394, 498: n = A,T,C or G
aggngcgggttnactttgaaaatgtatttctccaaattaatatagatatttgtctacagatgtcgctattacaaagaatgcaataaacattattttacctattctttcatacttatgcttgtatatctttggtataaattcctagtgctagatggcagggatcaaaacttttagcacatttaaactttaactgatatttgtgaaatctgcctaaattgcttttagcattctttattctcacccacagcttgggagggtatcttcttttctatccttaccaaaaatctataaacatcagtcatttgattctttgatgatgtgatgagtcaatagtgatagatcacttaatttgttttatcttaattattaagagaaggcaaaacattttatattntttcctgacaattggatattcacatgtacgtatttttatgggcctgcccccttttttttatttggatttgtagcagctttatattatgaacactagccctttgnca

SEQ ID NO: 24109 - DNA, 268 bp, Homo sapiens
  misc_feature 13, 17, 20, 33, 97, 267, 268: n = A,T,C or G
attgataagtaanggcnganaagattatatgtnatacctccattggggaataagcataaccctgagattcttactactgatgagaacattatctgcntatgccaaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaatnn

SEQ ID NO: 24110 - DNA, 500 bp, Homo sapiens
  misc_feature 8, 17: n = A,T,C or G
cagtggcntgcagcacntgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaaatttggttcagtttggatttaatctttggaaaagtaaattccttgttactgggttgactataattctctgtatcttacgaggaaaactgca

SEQ ID NO: 24111 - DNA, 430 bp, Homo sapiens
  misc_feature 4, 11: n = A,T,C or G
gcantatcganctgcgcccagcggacctgaagaagctccgagttaaagagctgaagaagattctggatgactggggggagacatgcaaaggctgtgcagaaaagtctgactacatccggaagataaatgaactgatgcctaaatatgcccccaaggcagccagtgcacggaccgatttgtagtctgctcaatctctgttgcacctgagggggaaaaaacagttcaactgcttactcccaaaacagcctttttgtaatttattttttaagtgggctcctgacaatactgtatcagatgtgaagcctggagctttcctgatgatgctggccctacagtacccccatgaggggattcccttccttctgttgctggtgtactctaggacttcaaagtgtgtctgggattttttttattaaagaaaaaaaatttc

SEQ ID NO: 24112 - DNA, 300 bp, Homo sapiens
  misc_feature 6, 8, 27, 30, 31, 32, 41, 42, 48, 49, 222, 254, 291: n = A,T,C or G
tgggangnatggagggggggggggganttnnnagggggggnngaaganntcctacatccgcattgctgataccaatatcaccagcattcctcaaggtcttcctccttcccttacggaattacatcttgatggcaacaaaatcagcagagttgatgcagctagcctgaaaggattgaataatttggctaagttgggattgagtttcaacagcatctctgctgntgacaatggctctctggccaacacgcctcatntgagggagcttcacttggacaacaacaagcttaccanagtacctgg

SEQ ID NO: 24113 - DNA, 100 bp, Homo sapiens
  misc_feature 13, 22, 25, 27, 35, 38, 42, 52, 93: n = A,T,C or G
gcccactatctcntttaatctntananctctcttncanggtnccctggatgngaaaacacatgaaataaatcctgagggccgttatcatcctncttgtgc

SEQ ID NO: 24114 - DNA, 236 bp, Homo sapiens
  misc_feature 11: n = A,T,C or G
gataaaatagnaaaataaagtagtggaaagtatgtgttgatgtttttgtttgttttggtaaacaccaataaaataaatgaaaccctaaaaagtttaaaggaataaaaggcaaacagagcatcagtgagaaaagataccttcagataaagaatttttaaatgacagaatatatacaactctgacaatacatttgaaaaactagaggaaagaaatagtttactagtgaactattattg

SEQ ID NO: 24115 - DNA, 427 bp, Homo sapiens
  misc_feature 3, 5, 6, 20, 27, 265, 306: n = A,T,C or G
gtntnnagtttgagagatancaagggnacagagatatctgcctttgtagaaagggcaagattatttgcttatatctgaagggaggtgggtggttttgctggatgtttggtctgaaagagttacttttgataaagttaatctaattgtagttatattttctgtgtgctttttttaattactaagaaaaaaattggtgagttcagtagctttggtattatgagtgcaaatcataatagctccaatgtgaaaaaaaaaatcaaaagtntaacttgtcacttaatgttagaaaattgcctaaaatgcagngtaataaataatctctgtaccaaatagtaatttaaatggggtaattttctgcaaggaaaatgtactgtttttatgtttccaaccctcttgaattaaaataaaaacaacttcttttctaagc

SEQ ID NO: 24116 - DNA, 496 bp, Homo sapiens
accgggctgagggaacaagcatgtggtctgctgcccaagaatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatct

SEQ ID NO: 24117 - DNA, 500 bp, Homo sapiens
  misc_feature 2, 17: n = A,T,C or G
anaccgggatgacggangttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaattcggagaagatagaagtttgaagtggaaaactggaagacagaagtacgggaaggcgaagaaaagaatagagaagatagggaaatttagaagataaaaacatacttttagaagaaaaaagataaatttaaacctgaaaagtaggaagcagaaga

SEQ ID NO: 24118 - DNA, 316 bp, Homo sapiens
  misc_feature 2, 12: n = A,T,C or G
tngcccgagatngttcttgcctggtgtcggtggttagtttctgcgacttgtgttgggactgctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcact

SEQ ID NO: 24119 - DNA, 489 bp, Homo sapiens
  misc_feature 1, 7, 20, 26, 33: n = A,T,C or G
natggcntatgaggcaggcngcgcangggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaaggtgattaaaagaccttg

SEQ ID NO: 24120 - DNA, 358 bp, Homo sapiens
  misc_feature 74: n = A,T,C or G
gtatgcttgatatttctgaactgtgtcaatttttctgctgtattccagctgaccaaaacaatattaagaatgcntctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattct

SEQ ID NO: 24121 - DNA, 126 bp, Homo sapiens
actggccaaaattgaagtcatatttgaggggggaaatggcatacgcaatattatattatattggatatttatgttcacacaggaatttggtttactgctttgtaaataaaaggaaaaactccgggt

SEQ ID NO: 24122 - DNA, 264 bp, Homo sapiens
  misc_feature 14, 15: n = A,T,C or G
aaatagaagtgtanntgcggccattatggaccggggtatcaaaagggtacaaggcatcaagcacgcaacaatgcagctcaaaacgcttagcctagccacacccccacaggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctcccc

SEQ ID NO: 24123 - DNA, 193 bp, Homo sapiens
  misc_feature 193: n = A,T,C or G
ctgctcagctgtctaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttn

SEQ ID NO: 24124 - DNA, 500 bp, Homo sapiens
  misc_feature 12, 24, 108: n = A,T,C or G
tgatttcctttnatttcttcccgnatttaaataactggaggaattttctccaatttttttttcctctctggcaggtatccccagcagtcaattaacaataagccagtntaaaacacctaaataaccaatctacaatctcccttcacaagtttttttactgtttttagatgaatgtacgatgagaaattcaacgttaataattctggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttccgacagtgaatattcaatctggtaccagttgaaatttttggttataaatgtaatacgaattggttcacaaacagaaaacatg

SEQ ID NO: 24125 - DNA, 482 bp, Homo sapiens
  misc_feature 2, 14, 32: n = A,T,C or G
ancgattacctggnggacaaggagctacatcnaggggtatgtgtcatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatcta

SEQ ID NO: 24126 - DNA, 468 bp, Homo sapiens
  misc_feature 130: n = A,T,C or G
gttttttctttttgagggagacgcggccgtaagggctgaggatttttggtccgcacgctcctgctcctgactcaccgctgttcgctctcgccgaggaacaagtcggtcaggaagcccgcgcgcaacagcnatggcttttaaggataccggaaaaacacccgtggagccggagggggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggg

SEQ ID NO: 24127 - DNA, 215 bp, Homo sapiens
  misc_feature 2, 5: n = A,T,C or G
gnaantgcggcccttatggaccggggaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgc

SEQ ID NO: 24128 - DNA, 485 bp, Homo sapiens
  misc_feature 1, 461: n = A,T,C or G
natggccggggtggtagataactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcnctgcagtgagggtcaaaggagagt

SEQ ID NO: 24129 - DNA, 228 bp, Homo sapiens
  misc_feature 1, 18, 19, 23, 25, 30, 31, 37, 41, 46, 63, 69, 78, 111: n = A,T,C or G
ntgctgattttcaagggnngcgncncgcannaatgcngctnaaaangcttagccctagccacncccccncggtaaaanagcagtgattaacctttagcaataaacgaaagntaactaagctatactaaccccagggttggtcaatttcgtgccagccaccgcggtcacacgattaacccaagtcaatagaagccggcgtaaagagtgttttagatcaccccctcccca

SEQ ID NO: 24130 - DNA, 500 bp, Homo sapiens
  misc_feature 7, 14, 31, 35, 43, 46, 47, 48, 49, 50, 52, 58, 62: n = A,T,C or G
aaaatanaacgcantcggccctgatggagcngggngctgctgngcnnnnnanggggcncaanagcatttttaccaattatgaggaagtttaaagtgtgagctacagaacactctaaactcaagaatcctttctattcttctctcagtatgctgtgacaaggtcctgtagccagctgtgttttgcgtgcagagagcacaaagccctaaaccaacattattgttaatcctcatggtatcctttggcagaaggagctggaaaacaagttatataaatatataactctttgtgacaacatattttacaattatttttagtttttaagctgcctcctaatttaaacatacaaaaaaactgatgcaatatggactagattaatttgaattaaatttcaatatgattttgatacttctaatgaatgatgagtttaaaatacaaaaattaaatacaaatacagtggttcaagatgacaaactgagtccatatgcctacctcctctcat

SEQ ID NO: 24131 - DNA, 316 bp, Homo sapiens
attgaaattttgcataaattaaaaagcaaacattgaaatctgaaacaccctgactttaagatttgagtaaatccatcctatattctgtacagaaagaatcaaagcaatgtatgaaattgtttcacaggttttttcaattatgtacaaaatgcttataaagttaaaaggtgcatcatttgccacttaatttcaattgtgatttagcgtgtgctttcttccagaaaatgaaatacaatggtatttcataatcagaggaaaatgtgaaggcttccaaattcattccttgaccataactaggatctaccatatatccatc

SEQ ID NO: 24132 - DNA, 499 bp, Homo sapiens
  misc_feature 2: n = A,T,C or G
antagcattacaagtattagaggcactgcctgcccagtgactaaagtttaacggccgcggtatcctgaccgtgcaaaggtagcataatcacttgttccttaattagggactagcatgaacggctaaacgagggtccaactgtctcttatctttaatcagtgaaattgacctttcagtgaagagactgaaatataataataagacgagaagaccctatggagcttaaattatataacttatctatttaatttattaaacctaatggcccaaaaactatagtataagtttgaaatttcggttggggtgacctcggagaataaaaaatcctccgaatgattataacctagacttacaagtcaaagtaaaatcaacatatcttattgacccagatatattttgatcaacggaccaagttaccctagggataacagcgcaatcctatttaagagttcatatcgacaattaggggtttacgacctcgatgttggatcaggacatc

SEQ ID NO: 24133 - DNA, 497 bp, Homo sapiens
  misc_feature 9, 28, 30, 44, 45, 55, 56, 57, 62, 66, 74, 77, 79, 80, 128,222: n = A,T,C or G
atctttccnaggggcgcgtccccccgananataagaagattctnnggagcttgannnctggntgtntgacatgngangnncagacaagtattaggaaaacagaatgaaaaggaatgaaaaagtctccnacaaatatgggattatgtaaagaggccaagcctacaaatcactggcatccctagaagggacagcgaaatagaaaacaacttggaaaacatattntcagggtatcacccatgaaaacctccccaacctcactagagaggccaacagtcaaattcagaagatacagagaacccctgaaagattctgtgcaagatcatccctatgacatgtaatcattacattttccaaggttggaatgaaagaatgttaaaggtagctggagagaaagcgcaggtcatttacaaaagggaaccctatcaggctaatagcagacctctcagcagaaaccctacaagccagaagagattcggagcttatacttcaacattctt

SEQ ID NO: 24134 - DNA, 137 bp, Homo sapiens
tccttccatcaagaaatggggtctatgtctcttccccttgtatcctcttgtgactgcttgaccaatgggatggggtagaggtgtcagtttctggtgcagaccttcagaaatgggtcgcttctactttgtgtatcctg

SEQ ID NO: 24135 - DNA, 500 bp, Homo sapiens
  misc_feature 3, 5: n = A,T,C or G
ccnantttaatgtaggggtaaatgaaggtgagctgttttcagcatcttagtttgaccatgaagatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggcagcttttaataaatcttgtcatatttgtactaacccaaatgattcacagtga

SEQ ID NO: 24136 - DNA, 326 bp, Homo sapiens
  misc_feature 4, 11, 28, 36: n = A,T,C or G
caanttcggcnatctatggaccgggcangggtaagnacagcggaaaagtgtatttcaagtgttgaaggaatactgctgagacagatgggccacttaggaacgacacttagaaggatggttgccttctctgtatcataagggaagacagtggaaaaatgtatttcaagtgttaaaggacagtaacaaccaatttagaatcaaatgcccaagaacaccatttctcaaagccaagagaatgtcaatgaagacatttatagataaagccagagagtttacaacaaccaagagacctacactaaaggaccttcacatggatttaaggaaga

SEQ ID NO: 24137 - DNA, 393 bp, Homo sapiens
  misc_feature 2, 10: n = A,T,C or G
anggcggcgntccccgagaacgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttatt

SEQ ID NO: 24138 - DNA, 240 bp, Homo sapiens
  misc_feature 3, 4, 30, 32, 44: n = A,T,C or G
atnnatggaccggggttgccttctaagtananagctgggtcagnccaatttattcaacagacatttagcatatataaatatgagccaggcaccatgctagatgcttaacatttaggaacaaagagcctgtttcctcatctgttaaatgtggataataaatgtacctagtactgtgtggagctggtgtgatgattaaatgtaacagttatcaaagcaataaataagacaatcaaaaattgg

SEQ ID NO: 24139 - DNA, 100 bp, Homo sapiens
  misc_feature 9, 10, 36, 50, 71, 90, 93: n = A,T,C or G
tcctcaatnnaatactggcaaaccaaatccagcagngcatcaaaaagctnatccaccaagatccagttggnttcatcctaaaaactctgngtnaactagg

SEQ ID NO: 24140 - DNA, 500 bp, Homo sapiens
  misc_feature 6, 13, 27, 34, 41, 58, 422, 439, 474: n = A,T,C or G
atggancgggcantactatacattcgnctggtgntggcagnaaaccctacaagccagnaagagaagtgggggccaatattcaacattcttaaagaaaagaattttcaacccagaatctcatatccagccaaactaagcttcataagtgaaggagaaataaaatcctttatagacaagcaaatgctgagagattttgtcactaccaggcctgccttataagaagagctcttgaaggaagcactaagcatggaaaggaataactggtactagccactgcaaaaacatgccaaattgtaaagaccattgatgctatgaagaaactgcatcaattaacaggcaaaataatgagctaacatcaaaatgacaggatcaaattcacacataacaatattaatcttaagtgaaaatgggctaaatgcccnagttaaaagtcaccggnctggcaaattggataaagagtcaagacccatgggngtgctgtattcaggagacccatttca

SEQ ID NO: 24141 - DNA, 168 bp, Homo sapiens
  misc_feature 140, 167: n = A,T,C or G
atggtaactgcaatggactgaatatttgtgtccccccaaactcttatgttgaaatcataactcccaatgtgatggtattaggaagtggagcctttgggagataattaggttttgaggttagaggggcattcatgaatggnattagtgaccctcataagaactttctna

SEQ ID NO: 24142 - DNA, 173 bp, Homo sapiens
  misc_feature 7, 8: n = A,T,C or G
aatatannggcaggcccctttcaacagctaaatataagaactggcctgaatctgtgtattttttcaagagaggtggcacgcattcagcagtatatttataaacaggaacctgtacagaagtgccctggaagaaggcctgctctaaattatccagtgtatggagaaacgacaca

SEQ ID NO: 24143 - DNA, 303 bp, Homo sapiens
  misc_feature 2, 6, 196, 236, 238, 266, 274: n = A,T,C or G
cnccgngagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagngtcaagacaacgacacatagctgggtgtcaggctgggggntngggagcaggttacacttaaaagtacttnagattgtntgacagcaggaactgagagaagcagggcc

SEQ ID NO: 24144 - DNA, 292 bp, Homo sapiens
  misc_feature 12, 33, 51, 56, 134, 245, 259: n = A,T,C or G
tagcaggggggnacgcaattttatgcacatagnaaacaaaaaaaagaagtnggagnagctatacttatatctgataaaataaccaaaactttaaaatgagataaagccattatataatgataaagaggccagtncagcaacaggatataataattataaatacatatgtactcaacataagagtaccgaaatatataaagcaaatataaatagatctaaaaggacaaatatactgcaataaatangggggggggggggnaaaggggggggggggggggggggggaaaccttg

SEQ ID NO: 24145 - DNA, 323 bp, Homo sapiens
  misc_feature 3, 10, 29, 41, 55, 56, 178, 243, 257, 270, 307, 309: n = A,T,C or G
tcnggtttgnagcctagcctttctattantctccctagtangaattacacatgcnngcgtccccattccagggggcgcaccctctaaatcaccacgatcaaaagggacaagcatcaagcacgcaacaatgcaggctcaaaacgcttagcctagccacacccccacggaaaacagcagngattaacctttagcaataaacgaaagtttaactaagctatactaaccccaggggtggggaatttngtgccagccaccgnggggacacgattnacccaagtgaatagaagccggggggaagagtgggttngntcaccccctgccca

SEQ ID NO: 24146 - DNA, 412 bp, Homo sapiens
  misc_feature 4, 7, 9, 10, 15, 16, 23, 111, 150, 196, 261, 310, 311, 318,347, 366, 377, 380, 406: n = A,T,C or G
catnctnannttccnncactatnttggccaggctggtcttgaaagcctgaccttgtgaaacacccgccttggcctcccaaagtactaggattacaggcgtgagccactgcncccagccaatgatagttaacatctacaacttcaaccaanttaaggataaaaccatgtgatcttttcagtagatgcagaataagcnttcaataacattcagcatcactccatgataaaaatcctccacaaactaggcatagaaggaacatntctcaacataataaagaccatatacaacaagcctacagccaacatcacnnttaatgnggaaaagttgaaagcctttcctctaacanctgggacaagacaaggatnccccactttanccnttcttattcagcatagtactggaagncctcac

SEQ ID NO: 24147 - DNA, 110 bp, Homo sapiens
ttatgcagggcagtcgcaggggcttttgctgagggggcaggcggagcttgaggaaaccgcaggataagtttttttctctttgaaagatagagattaatacaactacttaa

SEQ ID NO: 24148 - DNA, 368 bp, Homo sapiens
  misc_feature 6, 52, 312: n = A,T,C or G
aaaacnaaatgtcccttcggctcttatggaccgggcatagctcagtacttgngcttgtctagcaggtttttctgttagtttttcccccataacttttaattattactaaaattgtatttacaatagtggtgccaaatcaaatggtaatttaaataaaatctattctgtgtttatgtagggtggtataaaaaagaggtcttcatttagacatgtgatttctaaaattccagaaagcaaaattgataagatgttagaaatttggaccattatttataatcagggtagcattaaaatggagaaaagaaagttttntgaaaaaatgcggtgaatataagccacatttgtaaagtttatttttatgaaagctt

SEQ ID NO: 24149 - DNA, 100 bp, Homo sapiens
  misc_feature 5, 18: n = A,T,C or G
gtgcncgcgaaacctgcnctgcaggaaagtcaaacttacaaaaactgttgtgacaaatgttatgtacatatattgatatgtaactgcgttaggtggccat

SEQ ID NO: 24150 - DNA, 108 bp, Homo sapiens
  misc_feature 24, 71, 81, 101: n = A,T,C or G
ctttgaagagatgacaacaaattncggttttctactgttatgtgagaacattaggccccagcaacacgtgngtgtgtggtnaggaaaaataaaagtgctgncgtgggg

SEQ ID NO: 24151 - DNA, 195 bp, Homo sapiens
  misc_feature 5, 19, 31, 144, 157: n = A,T,C or G
ccacnaaaccacagggtangcagtactgtcntctgcattataacggactgtgatgggatcacatgagcaaattttcagctctcaaaggcaaaggacactcctttctaattgcatcaccttctcatcagattgaaaaaaaaaaancactgaaaaccanttactgaaaaaaaattgacagctagtgttttttaccat

SEQ ID NO: 24152 - DNA, 158 bp, Homo sapiens
  misc_feature 6, 8, 146: n = A,T,C or G
cataantntacaacctgcaaaagtaggaagcagaagaaaaaagacaagcctaggaaacaaaaagctaagggcaaaatgtacaaacttagaagaaaattggaagatagaaacaagatagaaaatgaaaatattgtcaagagtttcangatagaaaatga

SEQ ID NO: 24153 - DNA, 270 bp, Homo sapiens
  misc_feature 8, 23, 24, 61, 164, 202: n = A,T,C or G
catgtatntaaataacaggttgnnaaaagtacaagtacgaattacacttaaagaccatagnaggagcagatgacccacagaaagatggttctgtttcaggaagaatctggtaaattcaaacaatcagcagaggagtttcggaagaagatggaaaaattaatggngtccaaagtcatcactgaaaatgatatttcaggcattnggcttgacctttgtgtctcttcaacaagaaaactctagagcccaagaaaatgctaagctttgtgaaac

SEQ ID NO: 24154 - DNA, 155 bp, Homo sapiens
  misc_feature 115, 119: n = A,T,C or G
tcaatgccctcaagtaacttccataagccctgtcacctcgtaccaggtacccaggggctagagtgggaggaggggtctttactggccagtggttagtaaccccagtggggttcanggtncagggggggaagattttatgggggctaggacttgcc

SEQ ID NO: 24155 - DNA, 102 bp, Homo sapiens
  misc_feature 15, 25, 100: n = A,T,C or G
atggaccgggcatanctccattatnaaaataagagaataaaatctgttataagcaagtgatttaggtatccttcttttgtgtttatgcattatctgactnta

SEQ ID NO: 24156 - DNA, 149 bp, Homo sapiens
  misc_feature 10, 13, 38: n = A,T,C or G
caaagcaaanctnatgaaggaaggtaaagagggaaaanccagagaaagaaagtaaaagaggaaagaaggaaggaaggagagagagggagagagaaaagagaaagagaaaagaaaaggagaaagaggaaagaaaccagaaagagagagag

SEQ ID NO: 24157 - DNA, 154 bp, Homo sapiens
  misc_feature 2, 3, 122, 135: n = A,T,C or G
tnngaggtatgctgccccacaaaacccagcgaggccaggccgctctggaccgtctcaaggtgtttgacggcatcccaccgccctacgacaagaaaaagcggatggtgggtcctgctgccctnaaggtcgggcgtntgaagcctacaagaaagtt

SEQ ID NO: 24158 - DNA, 210 bp, Homo sapiens
  misc_feature 5, 6, 48, 139: n = A,T,C or G
atcannccacccctgcttcttttcccagatggccaccctagcatcacngttgagcaacagagtgaacaaatgttttaatttcactgctgagtagttctgcagagagggagacagcagagaggataatgagaagcatatnaggatgccaccattgatgaaagcttcccttccccactggctcaaatgataatgccagacaaattggatact

SEQ ID NO: 24159 - DNA, 248 bp, Homo sapiens
  misc_feature 4, 7, 32, 207: n = A,T,C or G
aacnggnccagggagtgtctggtgctgtgcanggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctncattcgtatgagaagcggcttttctgaaaagggatccagca

SEQ ID NO: 24160 - DNA, 236 bp, Homo sapiens
  misc_feature 10, 14, 27, 30, 32, 43, 180: n = A,T,C or G
gcacttcggngctnatggaccgggcanatntnaaatttggagnaaatatatatgtcaatatttagtaaagcttttcttttttaatttccaggaaaaaataaaaagagtatgagtcttctgtaattcattgagcagttagctcatttgagataaagtcaaatgccaaacactagctctgtnttaatccccatcattactgggaaagcctcatttgaatgtgggaattcaatacaggc

SEQ ID NO: 24161 - DNA, 195 bp, Homo sapiens
  misc_feature 9, 20, 28, 36, 72, 144, 184: n = A,T,C or G
catgtctcnttatgccaggnagtcgcangtcccttntgctgagggggcaggcggagcttgacgaaaccgcanataagtttttttctctttgaaagatagagattaatacaactacttaaaaaatatagtcaataggttactaanatattgcttacccgttaagtttttaacgtaattttaatancttaagatttt

SEQ ID NO: 24162 - DNA, 229 bp, Homo sapiens
  misc_feature 11, 12, 27, 51, 142, 161, 175, 183, 211: n = A,T,C or G
acactttcggnnctctatggaccgggngccctacaggtaggcggaaagcancttatgttaccagttaccagcattatgttcagatggttctacactcgtcatttgcccattgatctctcttatggaagactaattaatgggnttaaaacaattaggaattncagcaaccatgtgnaatgcttntagtgctaaggagcatgggaaatggggncatgctgaaatggggaat

SEQ ID NO: 24163 - DNA, 107 bp, Homo sapiens
  misc_feature 47: n = A,T,C or G
ccttcatttgacaccttaatacatttgctgactgttcttaaaacagnggggatgcctatattttccttgagtttttgtgactgactttggctatatatacctttctg

SEQ ID NO: 24164 - DNA, 113 bp, Homo sapiens
  misc_feature 76: n = A,T,C or G
gtgagatcggtgcgttctcctgatgttttgccgtggtttggggattgtacacgggaccagctcacgtaatgcattncctgtaacaatgtaataaaaagcctctttctttttgg

SEQ ID NO: 24165 - DNA, 497 bp, Homo sapiens
  misc_feature 5, 6, 34: n = A,T,C or G
gcggnntccgcttgggacgctagtaaccatgggnttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagat

SEQ ID NO: 24166 - DNA, 123 bp, Homo sapiens
  misc_feature 3, 78: n = A,T,C or G
ttngctatctagtactctaacagcttttgctttaaaattcttaaagtgtttcttaatgaaaaagaaaagatcttgctnaagttaaaataaggaacatttcaccttttaaatatttaattctta

SEQ ID NO: 24167 - DNA, 174 bp, Homo sapiens
  misc_feature 5, 101, 118, 139, 155: n = A,T,C or G
gtatntccacgagcaacaaagtacacaacataccagtaatctctgggacacattcaaagcagtgtgtagagggaaatttatagcactaaatacccacaagnagaaagcaggaaagatncaaaattgacaccctaacatnacaattaaaagaactngaaaagcaagagcaaacac

SEQ ID NO: 24168 - DNA, 152 bp, Homo sapiens
  misc_feature 22, 41, 53, 58, 66, 83, 89, 93, 118, 119: n = A,T,C or G
tcccctccttcactgaaaaagnatgactattttttgcccgngtgaaccatgtnaattncccacagncccaagtatagttaagngggatngagnacatgtaagcagcatgatggagggnnggaagatgccgcattggggatggggatgaatgc

SEQ ID NO: 24169 - DNA, 202 bp, Homo sapiens
  misc_feature 13, 15, 24, 32, 39, 157: n = A,T,C or G
atggccggcatancnccaaaatcnaggatatncggtatntaacactttgttatcaagcacattttaaaaagaactgtactgtaaatggaatgcttgacttagcaaaatttgtgctctttcatttgctgttagaaaaacagaattaacaaagacagtnatgtgaagagtgcattacactattcttattctttagtaacttggg

SEQ ID NO: 24170 - DNA, 128 bp, Homo sapiens
  misc_feature 37, 62: n = A,T,C or G
agtattatactgtcttgattactgtatattaggtggnaacctgaagtcaggtaatgtcaggncctccaactttgttcttcaaaatcatgttgactattatgggccttttgcctctcctataaatatta

SEQ ID NO: 24171 - DNA, 127 bp, Homo sapiens
  misc_feature 106: n = A,T,C or G
atacgatttcagaatccacattgcaactagcctttaaggaactctactacttgtcatattttggggtgggatcaaagagagtatccataattatcagacaaagctnttaaaatactcctggcctttt

SEQ ID NO: 24172 - DNA, 268 bp, Homo sapiens
  misc_feature 9, 35: n = A,T,C or G
gtcgcactnccattgccatctcccatgccacgcangctgcccaggggcctgagaacctgttcacatgcctgggaactgctgccactactgacatctgagtaagccacccgaaagcccaagaatcagcctgcttgaacccactaacactggggccattgtatgctcctctgaggtccaaagacaggcatgctctgtccactgctgctaccactggtgcctggagaatggcccacctggattccaggccttagcaaaattttaccatagg

SEQ ID NO: 24173 - DNA, 200 bp, Homo sapiens
  misc_feature 3, 8, 80, 99, 104, 107, 145, 155, 186: n = A,T,C or G
tgngcagnaccagtacttcgctcgtactcgtgcgcctcgcttcgcttttcctccgcaaccatgtgctgacaaacccgatntggctgagatcgagaaatncgatnagngcgaaactgaagaagacagagacgcaaggagaaaaatncactgccttncaaagaaacgattgaacaggagaagcaagcnggcgaatcgtaatg

SEQ ID NO: 24174 - DNA, 460 bp, Homo sapiens
  misc_feature 2, 7, 30, 32, 39, 44, 50, 102, 119, 134, 179, 243, 264, 305,344, 377, 379, 408, 415, 424: n = A,T,C or G
gncgccnactcaagagaaaatgatctcccntnccctcanctggnggcctngggaaaaaacagaaactttaaacactgaagaccctagctatccctaggcctnagtttatacagaatatnttaaaagttatgttncaatctctttctctgtattcatctctaaaactacacttaggtagngatttctagcacaagtggttttgaaaatattttggatttcctaccatactttcagaatgcaggncatcagggcagaacaaaatgngactttgctcacaacctcaatccaataacttcattgtaatngatatgggtaaaccactgaagtagtagataaatttcagnccaccaggagaatcatatttgttcaactatgangngggatcagattataatagtaaatcatgcnctctatngggcaagtnagatatcatctcatcaaaaatagagaacagctgggg

SEQ ID NO: 24175 - DNA, 500 bp, Homo sapiens
  misc_feature 13, 25, 270, 414: n = A,T,C or G
cgtgctgattttncaggagtcgtcntggcttaacttctggctgtaagcacccagtcacaccagccagatacaacccttgccagagccagggccaaatggggagttaaactggggggaagcagtgtgggagggtgcagggtatacctatgaaataataatgcaggtgttccaaggcaagctcagggagggtataaacctcctatggagcagaagggcaaaagctgacttgatcttgattttcagtataaatacagaccatgaaagcagagnctcacacaaacaaaaataacaacaacaacagcttcatgggagaaacacacggaaggtagggggacttctaatggtccagacagatgaaaacttcaactactaattggaaagattttgtgaagtcattctcagaacagcagcagnaaaatagagatgattctgtagattccaatttgtggatacaagaaaactgtagaaagtatggaggtgctggggatggtctagattct

SEQ ID NO: 24176 - DNA, 401 bp, Homo sapiens
  misc_feature 6, 9, 206: n = A,T,C or G
catgcngantactccggcgaaaataaaataaaagtttggatcacttaccctgtaaaatgtcctactttctggatttatcagattatttcctcatgatattgtttagcttgttcctcgtgcctctgtatatcctataaactaatagttaaatcatgaggtttgaatagactctgcttaaatatttttggtcagaatacttcatgggngattctgcatacttacatcatatgacatcacatcagaaggtattcagtctctggtcatctcactactagtgatgtcaagactgaccagcgttcaaaatagtgacacctagataaagagtaacttttaaaaagaggccgtgaacctgggcaatatagtaagacaccatctttaccaaaacgtaaaaaaattagttg

SEQ ID NO: 24177 - DNA, 447 bp, Homo sapiens
  misc_feature 12, 13, 32, 33, 36, 42, 43, 44, 45, 49, 54, 175, 254, 271: n = A,T,C or G
gtaatttcggcnntctatggaccgggcatgtnnagnaactcnnnngggngaaantcatcgaagaagccaatcagatcaaccatattaatagcaattaaaagaaaatagaatgtggccacttatttcactatcttcttcaaatacaaagtaaatacaagactgttgtgatcttgcnttcattttctgacatgcattgttggctatttgaaatactaaaagcaaatctacagatcctttttccatcattttacagngaccttttcttcatttnggtttatttttgtaatgtgaaaagtatcactctaaaaaacatttttaatttaacaaactaaaaatattcctccaaatctcttgcttgtcatttgactcttgcgtgtcaatttccctcaggttctattttcttaaaccaacctttaaaattgtcacctctgttaaggttgaactttg

SEQ ID NO: 24178 - DNA, 500 bp, Homo sapiens
  misc_feature 14, 22, 28, 29, 33, 34, 35, 46, 51, 52, 54, 60, 65, 66, 134,353, 415: n = A,T,C or G
aaaataaaacgtcncgttcggntctcgnnggannnggcatgtctgnctctnncnaggagncgctnnccaataattatagcaaaggtcatacatagaattaaaaataaaagacaaacaaatcagctttttctgtnctctaaatgattgagaaatataagttaaaaatccatacaaatatttttatgctaattggtgcatttccttgacatttttctttttgtttagaaattttgtatagaaataattatatatttctcttcctcccacttcctttcgtccaaaaattcgaatccttaaacaatttagagacatggcagcctggtggctaagtgagtgaactcctggggctgtgncgtgaggaaggagagcagctagcgtcatgtctgtggccatgaaggtgtgctttgtgagaggngaaattttgtggcctttctctcctccctcataggcagtacctgagccattatctgagattttgtaaaggtacagacttttgtggc

SEQ ID NO: 24179 - DNA, 500 bp, Homo sapiens
  misc_feature 4, 9, 38, 198: n = A,T,C or G
cganggagnaggcatgctgattttccaggggtgcggcngaaattttgtccttgtcagaaggaattggcaggtattcccgatctgccatgtattccagaaaggccatgtacaagaggaagtactcagccgctaaatccaaggttgaaaagaaaaagaaggagaaggttctcgcaacctgttacaaaaccagttggtggngacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaaagagggtggttttcctgaagcagctggctagtggcttattacttgtgactggacctctggccctcaatcgaggttcctctacgaagaacacaccagaaatttgtcatttgccacttc

SEQ ID NO: 24180 - DNA, 500 bp, Homo sapiens
  misc_feature 22, 26, 28, 31, 46, 53, 54, 63, 100, 311, 452, 467, 476: n = A,T,C or G
aaaataaaacgcgctttctgcnctcnanggnaaggatgctgatttnccagggnncgccggaanggaaacagcctccaactttagttgttccacctctggntgttttagtaaggacattgttggactaaggactagtgtctgttggcagcagcattgtgcttctccagcctttgcgtattgtggtcactcattttgttgtacagggaacagctttaagaactatgtcatcactcccagaatcttctgcaatgtgtagaaaagcagcaaggactagattgcctagggggaaagacttaatttactttgggagngaaaaatctgatcaagagactggacgtgtacttctgtttctcagtttatctggatgttatcagatcacagaccatggtctcagggttttgactctgggaggagggctgccttatttggagcaccttaatctctctggttgnctcactataactggngcaggcctnaggatttggtttcagcatgtcctt

SEQ ID NO: 24181 - DNA, 498 bp, Homo sapiens
  misc_feature 4, 27, 29, 33, 44, 54, 56, 417: n = A,T,C or G
aaanataaaatgtcactttcggcgctnanggancggggtgcttnatgtgctagngnggggacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagngactgtagttaccttaagagaaaatgctttgtagaacagagcagtagaaaagcagggaaccaagaaagcaatactgtacat

SEQ ID NO: 24182 - DNA, 327 bp, Homo sapiens
  misc_feature 4, 15, 44, 45, 226, 309: n = A,T,C or G
gccnttcggcctganggagcgggcatgctgctgtaaaaggagannctggaaagcttcaatgctgaaaatttcatccagtcacctgacagagctaattaaatttcttgggctgttgattagtatttattaaattacggaactaaagctttaactctgccattcttgcttcaataattaagaagttgtggagagagagcaataaccaaggtgtcagcttgctggactnttccaaaaagtggtactcagaactttatccaactcatgccacgaatccagtgatactggaagaaaaaaaaatgcaaatctagngtggcataaaatatgctt

SEQ ID NO: 24183 - DNA, 301 bp, Homo sapiens
  misc_feature 4, 7, 12: n = A,T,C or G
catnacnccaangtacgaggctgcgaaatgcatttctcctagaaagaagctgtttgcttttggttcttctgtccagatggtttggttgaatgctcaatttgatggtaacagtaagtgatttgggtagaggagaggacataaataaatacatggttgttaaagctgatgataatggcatctgtgagccagaaaactctccttggatacgttttctgagaaaaaatagcatgaagcctaaagccatttcttccaaaaacaacattgcaacccttttctttacccttttgtcttttaaaataat

SEQ ID NO: 24184 - DNA, 117 bp, Homo sapiens
  misc_feature 21: n = A,T,C or G
attactctcctgggctgaagncagcttttctgaaccattaaggtatttcatcacaagttatattttataatatcagtttaagaggcttttattcatgtgaacaccagtcccctttca

SEQ ID NO: 24185 - DNA, 500 bp, Homo sapiens
  misc_feature 15, 17, 28, 31, 39, 41, 43, 51, 58, 62, 63, 64, 437, 440,473: n = A,T,C or G
aaataaacgccctcngnctcgcgggagnagncatgctgntntnccaggggncgccctngtgnnngcactgcagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagtgagtgtcctaaatatcactgaaataaaaagtaggaaaaagaagcttgaattttaagactgaggctgctctnagnattctagtttggctttcagagttcaagagtggnggcatcttcacctgaattcttcaatgc

SEQ ID NO: 24186 - DNA, 115 bp, Homo sapiens
  misc_feature 77: n = A,T,C or G
tgacggggaatcagggttcgattccggagagggagcctgagaaacggctaccacatccaagggaggcaggcaggcgncgcaaaattacccactcccgacccggggaggtagtgac

SEQ ID NO: 24187 - DNA, 118 bp, Homo sapiens
  misc_feature 11: n = A,T,C or G
agagaaaaagnaagctctaaaacagtgtcattgattaaaaagaatatctggaatgtagccccactctttgagtgggattcatttcttactgcttatgaactttcaatttagtagtcag

SEQ ID NO: 24188 - DNA, 500 bp, Homo sapiens
  misc_feature 10, 26, 34, 35, 38, 46, 48, 58, 65, 67, 68, 69, 73, 191,218, 255, 324, 368, 428, 476, 493: n = A,T,C or G
aaaataacangtccgttcggcgctgngcgagcanncangtctgatntnaccaggtgcncgcggcncnnntaanagactcagttaaagaatttaggaatttctgattcatttaaaggatttacaaattcatcaacccctgaaaactaaagcaaattgaacaggaaaaaaaaaagaagatgggttttttaagnccaatatatgttattttcttctttttnggagtcaaagtacattgccaatatgaaacttatcagngggatgaagactatgaccaagagccagatgatgattaccaaacaggattcccatttcgtcaaaatgtanactacggagttccttttcatcagtatactttaggctgtgtcagngaatgcttctgtccaactaactttccatcatcaatgtactgggataatcgcaaactcaanactatcccaaatattccgatgcacattcagcaactctaccttcagttnaatgaaattgaggctgngactgca

SEQ ID NO: 24189 - DNA, 150 bp, Homo sapiens
  misc_feature 7, 19, 43: n = A,T,C or G
cgaacanacatctccatanttaatactaagaccaaacccaatncagaccaaactccaaagcccattgtgtttacaagtctgcctcttttgtgtgatagcaagtcagtcctttaaagtagaaaccccatttactaaccctacatcccaagt

SEQ ID NO: 24190 - DNA, 364 bp, Homo sapiens
  misc_feature 2, 43, 67, 266, 314, 348, 349, 359: n = A,T,C or G
cnatagaccgggggacgcaaaccgccgcggttgccggtacatnggggatttctggctctttcctctncgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagncaaaaaaacttgattaccgtcgatatgcagaaacactctttgacattntgggtggcttggggggggaattgcctgggccccnnggggggggcncctgg

SEQ ID NO: 24191 - DNA, 460 bp, Homo sapiens
  misc_feature 17, 27, 33, 35, 45, 47, 55, 87: n = A,T,C or G
aaaataaaatgtcaccntcggcctctnatggancnggcagtactngntttgggangaaataggcaaagcatatgcagccaaccaagnatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacatt

SEQ ID NO: 24192 - DNA, 145 bp, Homo sapiens
  misc_feature 7, 18, 28, 32, 92, 134, 142: n = A,T,C or G
atagaanaaacatatccnatttatcaanggcnggatgtctcattaatgactttttccccagaaagctgaatggatgacaacaacttgcaatnatgcactttatgcaatctgtgatgtattcactcagtatttanaagtactnagt

SEQ ID NO: 24193 - DNA, 304 bp, Homo sapiens
  misc_feature 6, 20, 27, 32, 45, 71, 260, 275, 286: n = A,T,C or G
cgaacnggcatgctcatcantactagncacangcaacagcaaaancaaatgccacatgttttcacttatangtgggagctaagtgatgagaacaaaggaacacatagaggggaacaacagacactggggcctgtctgagagtagagggtggaaggagggagaggatcaggaaaaataactaatggatactaggcttaatacctgggtgatgaaataattggtacaacaacagtcccccatgacacatggttacctatgtnacaaacctgcacatnctatacatgtncccctgaatttgaaacga

SEQ ID NO: 24194 - DNA, 386 bp, Homo sapiens
  misc_feature 8, 16, 37, 90, 115, 274, 296: n = A,T,C or G
catttctnattttcanggtgcgcgccgccaagaaaanaagctcctgcccctcctaaagctgaagccaaagcgaaggctttaaaggccaanaaggcagtgttgaaaggtgtccacngccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccntgaagaagatagaagacaacancacacttgtgttcattgtggatgttaaagccaacaagcaccagattaaacaggctgtgaagaagctgtatgacattgatgtggccaaggt

SEQ ID NO: 24195 - DNA, 399 bp, Homo sapiens
  misc_feature 6, 17, 71: n = A,T,C or G
ccccanagtggaaaccnaaagaagatgtgatgagcttaccagaaaaatgaggagagatgggtggcctgccntgggtatccatggtgacaagagtcaacaagagcgtgactgggttctaaatgaattcaaacatggaaaagctcctattccgattgctacagatgtggcctccagagggctaggtcctcaaaatgagcacatgaagaggttgctgtgaaactttaagtggcctactgcgcagaagcattcagatgtcacttgatgatcttgtgcaaaactccgtacattgctattttgccacactgcaacaccttacagatgtggaagatgtgaaatttgtcatcaattatgactaccctaactcctcagaggattatattcatcgaattggaagaactg

SEQ ID NO: 24196 - DNA, 208 bp, Homo sapiens
  misc_feature 5, 14, 32, 69, 171: n = A,T,C or G
ctganggagcgggngacccgaattccgtggtntatttccaaaatgtttggaaacagtataatttgacanagaaaaatgatacttctctttttttgctgttccaccaaatacaattcaaatgctttttgttttatttttttaccaattccaatttcaaaatgtctcaatggngctataataaataaacttcaacactctttatgataac

SEQ ID NO: 24197 - DNA, 306 bp, Homo sapiens
  misc_feature 2, 40: n = A,T,C or G
tngcggcctgcttagcagacagagctagaaaacatatacntatatatgttaaaacatgcaaatacaagcacctgaatttattattctatccatctgtatgttattaaaaaccgtgagccaggtatggtggctcgtgcctgtatcccaggactttgggaggccaaagtgggaggatcacttgagcccaggagttcaagaccagcctgcgcatcatagcaagacctcatcctccaaacgtttaaaaaataaaaaattagccaggcatggtggtgcattcctgtaatcctagctacgtaggaggctgag

SEQ ID NO: 24198 - DNA, 500 bp, Homo sapiens
  misc_feature 13, 22, 27, 28, 34, 35, 42, 53, 54, 59, 62, 64, 66, 67, 467: n = A,T,C or G
aaaataaaacgcnccttcggcnctganngagaanncatgctnattttccgganncgccnccngncnnatggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttactttgcttngtgctgttctgtgttggttttactaaaaaacgc

SEQ ID NO: 24199 - DNA, 261 bp, Homo sapiens
  misc_feature 11, 18, 30, 37, 41, 45, 47, 49, 54, 87, 229: n = A,T,C or G
aataaacgctnttcggcnctgcgcagaagncatgctnattntcangngncgccnccccattagagcttagtcaaagacgatatcacngtctaccttaaccaaggcactttcttaagcagaaaatattgttgaggttacctttgctgctaaagatccaatcttctaacgccacaacagcatagcaaatcctaggataattcacctcctcatttgacaaatcagagctgtnattcgctttaacaaattacgcatttgtatcac

SEQ ID NO: 24200 - DNA, 188 bp, Homo sapiens
  misc_feature 7, 8, 13, 14, 40, 124, 179, 187: n = A,T,C or G
gcgcctnnccaannataccatggtggaattaatcactttngaagcaatatcagttattttttgaataataacttttctaaagccttaagtcttaatattaaatatatgattagccaggcccggngggctgacacctgtaatcccaaccccttttgggggggccaaggggggggggattncccccggng

SEQ ID NO: 24201 - DNA, 500 bp, Homo sapiens
  misc_feature 10, 11, 28, 36, 37, 38, 43, 49: n = A,T,C or G
tcggcgctgnnccgagcaggcgtgtctnattttctnnngtgcnctcctngcaagaatggcgggtgaaaaagttgagaagcccgatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggacca

SEQ ID NO: 24202 - DNA, 379 bp, Homo sapiens
  misc_feature 13, 17, 376: n = A,T,C or G
caggagtcgctcnaccncagaatacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcaggtgagggtcaaaggagagtcaacatatgtgattgttccataataaacttctggngtg

SEQ ID NO: 24203 - DNA, 240 bp, Homo sapiens
  misc_feature 25, 26, 34, 36: n = A,T,C or G
atggaccggggtagcgccgtatatnngcgtcggntntttgttgttatttctttagaaccctccacagccacatgcaagaccatggagttaaagaaacccagagacctttatcaattaattgtactgtttgtgaatttgtataaataataacaaagatcctcttaaaacgtttatattcttacagtaaaaggttaaactgatatttatataataaaagaggaaatatgaagtatgttttgg

SEQ ID NO: 24204 - DNA, 435 bp, Homo sapiens
  misc_feature 10, 24, 29, 30, 38, 39, 43, 46, 48, 49, 50, 53, 56, 59, 69,375: n = A,T,C or G
aaaataaaangtcacgcttcggcnctganngagcgggnngctngtngnnntgnggngcncaaagcaagnaccacacatctacagccatctgatcatccgacaaacctgacaaaaacaagcaatggggaaaagattccctatttaataaatggtgctgggaaaactggctagccatatgcagaaaattgaaactgaccccttccttacaccttatacaaaaattaactcaagattaaagacttaatgtaaaacctaaaactataaaaaccctagaagaaaatctatttaataccattcaagacataggcacaagcaaaggtttcatgacaaaaacatcaaaagcaattgcaacaaaagcaaaaattacaaatgggntctaattaaactaaagagctcctgcacagcaaaagaaactatcattagagtgaacaggca

SEQ ID NO: 24205 - DNA, 408 bp, Homo sapiens
  misc_feature 4, 343: n = A,T,C or G
tgantacaggcagatgtccccttaaatatttaggagcacagattgacaagtgttccaaggatggtggttatcacaagaatggataattaggataagctttaaaaaaattctcacttcccatttccttctcccaaacagtttgtccttagaccataagaagaaagataaattaacaagtatctgtggaataggacagactgagaatactttatctggcataagtttgactaagtatcaaatggattccaataaggaagaaaagtaaaagtctaacaaactaaattatataaacatggaagggaataagagaatcacccacagtcacagacagatgtgaaagttncatggcactgtgaggaaagtgaaaatacaaccaaaggccaagggagctgaagactggaggggaga

SEQ ID NO: 24206 - DNA, 461 bp, Homo sapiens
  misc_feature 23, 26, 28, 29, 33, 35, 36, 37, 40, 44, 45, 46, 50, 62, 64,69, 70, 451: n = A,T,C or G
aaaataaaatgtcaccttcggcnctnanngagnannnatntccnnntttncaggtgttcggntncctgnntatgggattccgtgtacaatccataccacatctgacctcggcacttagcatcatcacagcaaactaactgtagcctttctctctttccctgtagaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctacctgtctagagcttgtctcaatggatctagaacttcatcgccctctgatcgccgatcacctctgagacccaccttgctcataaacaaaatgcccatgttggncctctgccct

SEQ ID NO: 24207 - DNA, 283 bp, Homo sapiens
  misc_feature 25, 28, 31, 36, 40, 44, 55, 56, 58, 66, 67, 283: n = A,T,C or G
taaaataaaatgtcactcttcggcnctnatngagcngggngtcngacatttccanngngaagggcnnagcaagttgaaaacttcgaaaaaaatttagaagaatgtataactagaataaccaatacagagaagtgcttaaaggagctgatggagctgaaaaccaaggctcgagaactatgtgaagaatgcagaagcctcaggagccgatgcgatcaactggaagaaagggtatcagcgatggaagatgaaatgaatgaaatgaagtgagaaggggagtttaccn

SEQ ID NO: 24208 - DNA, 483 bp, Homo sapiens
  misc_feature 6, 12, 29, 35, 42, 43, 44, 49, 50, 51, 52, 55, 56, 58, 83,406, 409, 442, 448, 464: n = A,T,C or G
tcggcnctcgcngcgagcaggcatgtctncatctntgcaggnnngcgcnnnnccnntntgctgagggggcaggcggagcttgnggaaaccgcagataagtttttctctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatganggngacttaaacagcttaaagtttagtttaaaagtngtaggngattaaaataatttgnaggcgatcttttaaaaaga

SEQ ID NO: 24209 - DNA, 278 bp, Homo sapiens
  misc_feature 14, 29, 32, 38, 41, 49, 54, 64, 75, 76, 84, 105, 118, 129: n = A,T,C or G
catgctgattttcnggggtcgccacccanttnacacanaangtggggcnatctnaagcacagtngtacccgctgnncgcactgnggggtactctgagtcttaaanaattaaaaatagnttttgggtaancaacagtgtaatagaaatggaaattactgattcacattgagccatgaagaatttattttcagcaatttttatagaagttgctttatgacaaagaaagctttggttaactggcatttggcatttcatgcccctaaattttctacatgagg

SEQ ID NO: 24210 - DNA, 188 bp, Homo sapiens
  misc_feature 30, 47: n = A,T,C or G
ctatggaccgggaattgccccagttagctnatttgagcataaagttnaatgccaaacactagctctgtattaatccccatcattactggtaaagcctcatttgaatgtgtgaattcaatacaggctatgtaaaatttttactaatgtcattattttgaaaaaataaatttaaaaatacattcaaaatt

SEQ ID NO: 24211 - DNA, 226 bp, Homo sapiens
  misc_feature 5, 7: n = A,T,C or G
gagcncnccactcattctctggaatcaacctctttctaataccctcttggaaaaagagcttgcccctcctccagcacactagagctctggccttgtgtgtatatgtatacatacgtgaacacatgcctgtgtgtgtgtgtgtacttgtatgcacgtaggcaccagcacaaagatctgaatgatgcaccccacccccaccccaataaagaaataacagaaaaccctc

SEQ ID NO: 24212 - DNA, 301 bp, Homo sapiens
  misc_feature 3, 22, 34, 38, 46, 47, 56: n = A,T,C or G
aanataaaatgtcactttcggngcttatggagcngggngtcttttnncatccttgnaaggatggcgggtgaaaaagttgagaagccagctactaaagagaagaaacccgaagccaagaaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggcg

SEQ ID NO: 24213 - DNA, 298 bp, Homo sapiens
  misc_feature 7, 10, 35, 40, 41, 52, 70, 72, 98: n = A,T,C or G
atgaagngantccatattatgctgacgacatccanggagnngcttcccctanagagcttaaaccttgggngngctgtgccccacaaggagacatgatntatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgaccccta

SEQ ID NO: 24214 - DNA, 439 bp, Homo sapiens
  misc_feature 7, 15, 63, 131, 148, 191, 431: n = A,T,C or G
tgggagntgtcattntcagggcctttacaatcagcaacccaaaatctacatgctgctgagggncctgcctcattaagatgcaataaatatgtaagtacataaaaacagcaatagaagaaacgtaatgcttntttctcaaatatgatgnctacatagaaaagccaaaattattaagaatagcaaagtgctgngattacaggtgtgagtcaccgcacctggcctgccctgagattatatactgaaatcaattgcttttctagacactagcaataagcttataaattatattcaaggattcagttatattcattttttaaaagatatttaaataagattaaaaattcttaagggttctaaaaataaatggaaggaaagatattcaaggcctatatacagaaaactataaaacttcattaaagcccatgactgtngatacaag

SEQ ID NO: 24215 - DNA, 143 bp, Homo sapiens
  misc_feature 14, 41: n = A,T,C or G
atggctgttttcantttagtttcacccgatcttgattctcngaattagctatgtttatatttttagttcttttttattcaactcagatttgtcaagaaatgtaacctctaaattgtgtagtacctctccaatcataaatttcc

SEQ ID NO: 24216 - DNA, 357 bp, Homo sapiens
  misc_feature 15, 25, 33, 36, 42, 47, 54, 61, 66, 67, 241, 244: n = A,T,C or G
aaaataaaaagtccnttcggttctnatggagcnggnatgctnatttnaccaagngcgcgcntatcnnaactagaaagttcatgaccaacccgcctacttcagaaggaaacaaatggtcattgatgtccttcaccccgggaaggcgacagtgcctaagacagaaattcgggaaaaactagccaaaatgtacaagaccacaccggatgtcatctttgtatttggattcagaactcattttggnggnggaagacaactggctttggcatgatttatgattccctggattatgcaaagaaaaatgaacccaaacatagacttgcaagacatggcctgtatgagaagaaaaagacctccgga

SEQ ID NO: 24217 - DNA, 241 bp, Homo sapiens
  misc_feature 176: n = A,T,C or G
atgaatctattaatgaatttcactcctttaccatttttatattttataattaatttctaattattttataatttaataattttaactttctatatggctgtgagaatatgatttgaaactcaaaatttttttgtgacttacagaatctctctagaggcccaattgtgtcatttggntaggtgcataaaagtatactcttgtgtgtataaatttacgtattcattcattctcttttccaacc

SEQ ID NO: 24218 - DNA, 500 bp, Homo sapiens
  misc_feature 3, 5, 486: n = A,T,C or G
atntnctttagtccctttcagtctgaagtagttcttcagactttaatttcatgaactggatacattggaaactacagttattttgtagaacgtttcttaatttgtctttgcctgaattttccttatgattagattgaagttgtacatttttggcagaaatattacggagctgatgctgtgtctttcttgctgcatcctatcaggtggtgcatgatttgtccctttactgatgatgatgttcactttgatcacatgattaaggtgttgtcagtcagacttcttcattgtgcagttacacttttccctttgaaattcgtaagtatttgatggggaaaaactttcaaactatgtaaatatccagtttatcatcaaactttcagtttatccgtttatttatttaaatcagtatggactcagagtttcctagtttattcaatatgttataacccattactatattcttttaattttggatattcaaattgnctatgctgaaacat

SEQ ID NO: 24219 - DNA, 452 bp, Homo sapiens
  misc_feature 1, 8, 24, 211, 376, 444: n = A,T,C or G
natacccntattactgtgaactcnaaactttgggagaaagaaaaacagctcgagccctcttgcaaagagaaaactgagtatctacagaaaatggttcagaggaatgaaagatataaacaagatgtggagaggttctatgaacggaagcgacatttagatttaattgagatgcttgaagcaaaaaaggccatgggtggaatatgaaaatgtncgtcaggaatatgaagaagtaaaactagttcgtgaccgagtgaaggaagaggtcagaaaacttaaagaagggcaggattcctataacatgtcgaattgaagaaatggaaaacgagcgtcacaatttggaggctcgaatcaaagaaaaggcaacagatattaaggnggcatctcaaaaatgcaaacaggagcaagatgttatagaaaggaaagataaacatattgagggacttnagcaggct

SEQ ID NO: 24220 - DNA, 423 bp, Homo sapiens
  misc_feature 3, 4, 30, 31, 182, 247, 329, 330: n = A,T,C or G
ccnnttagtctcgctccgtggccttagccnngctcgcgctactctctctttctggcctggaggctatccagcgtactccaaagattcaggtttactcacgtcatccagcaggagaatggaaagtcaaatttcctgaattgctatgtgtctgggtttcatccatccgacattgaagttgactnactgaagaatggagagagaattgaaaaagtggagcattcagacttgtctttcagcaaggactggnctttctatctcttgtctacactgaattcacccccactgaaaaagatgagtatgcctgcccgggggaaccatgtgactttgtnncagcccaagatagttaagtgggatcgaggacatgtaagcagcatcatgggagggttggaagatgccgcatttgggattgggatggaattccca

SEQ ID NO: 24221 - DNA, 500 bp, Homo sapiens
  misc_feature 2, 9: n = A,T,C or G
cncacccanatgggtataattgacatctatagactacttcaaataacagcagattacacattcttctcaagcttacacggaacattcaccaagataaacttcattctaggccataaaacaaaccttaacaaactagagatcatgccatatctgttctcaaagcacaataaaattaaatagaaaccagtaactgaaagatagctagaaaatcccaaaatatgtggaagattaaacaacttctaaataatacatagttcaaagaaggaatctcaaaaacacttaaaaatattttgaaataaatcaaaatgaaaatacagtttatcaaaatttgtgagatgtagtgaaaccagagcttagaggggaatttattggattgaatgcatttattagaaaagatgaaagatccaaaattggccgagcgcggtggctcatgcctgtagtcccagcactttgggaggcccgaggggggtggatcacgaggtcaggagattgagaccatc

SEQ ID NO: 24222 - DNA, 500 bp, Homo sapiens
  misc_feature 23, 27, 28, 29, 34, 38, 43, 45, 47, 52, 53, 58, 66, 99: n = A,T,C or G
aaaataaaatgtccccctcggcnctgnnngagcnggcntggcncntnttccnngggangcgtgccnccggtacacattcaaaggaatgaatgctttacncgttttggaaatgagtgcaaaccctcttgataataatgggatagagccaggggcatttgaaggggtgacggtgttccatatcagaattgcagaagcaaaactgacctcagttcctaaaggcttaccaccaactttattggagcttcacttagattataataaaatttcaacagtggaacttgaggattttaaacgatacaaagaactacaaaggctgggcctaggaaacaacaaaatcacagatatcgaaaatgggagtcttgctaacataccacgtgtgagagaaatacatttggaaaacaataaactaaaaaaaatcccttcaggattaccaggagttgaaatacctccagataatcttccttcattctaattcaattgcaagagtgggagtaaatgac

SEQ ID NO: 24223 - DNA, 498 bp, Homo sapiens
  misc_feature 5, 7, 63: n = A,T,C or G
cagcncntttcaacagctaaatataagaactggcctgaatctgtgtattttttcaagagaggnggcagcattcagcagtatatttataaacgggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttaccaagacaaaggtgtccttcataatgaagttaaagtgagtatactgtggagaggacttccaaatgtggttacctcagctatatcactgcccaacatcagaaaacctgacggctatgattactatgcctttctaaagatcaatactataacattgatgtgcctagtagaacagcaagagcaattactactcgttctgggcagaccttatccaaagtctggtacaactgtccttagactgatgagcaaagga

SEQ ID NO: 24224 - DNA, 225 bp, Homo sapiens
  misc_feature 7, 9, 51: n = A,T,C or G
gtaccgnanaacattgctgagaagaaattgaagaaaacctgaataaaagantatctaccatgctcatggaccggatgactcagtgtggttaagatatcagttctcggccgggcgcggtggctcacacttgtaatcccagcactttgggaggctgaggtgggtggatcacttgaggacaggagttcaagaccagcctggctaacatggtgaaaccccatctctact

SEQ ID NO: 24225 - DNA, 421 bp, Homo sapiens
  misc_feature 3, 35, 42, 61, 62, 67, 336: n = A,T,C or G
aanataaaacgtccgttcggctccgcgcgagcagncatgctnattttccaggggcgcgctnnccganaataatcttccagtatttgaaaactattatcagattcagcaataaagtcattcatatggttgataaatgagtgaagttctcgcatacattctgttgttttacctttcgtcttacttattaaagcaaataaaaatatcaaacaatgttcctgttggaagtatgcttgttcatcagttgcaaacactaggttggctacagatgtaagagtttagcaaagatccataaaaacattctttgaaagtcaatttgtctacatggaattttcagtnaagagcactatttcttattatttgaaaattgtgtgctagccacctttatatcagttaaagctcatgtatttgtatgtgcatgtat

SEQ ID NO: 24226 - DNA, 438 bp, Homo sapiens
  misc_feature 10, 11, 32, 34, 35, 37, 61, 413: n = A,T,C or G
catgtccgannttccaggggggcgccatcccnanngnctcaaaccttattcaacatcggcnaaactcatactggtgagaaaccctataaatgtaaggaatgtggcaagacctttagcttgcatggatatcttaatcaacatcagaaaattcatactggtgtgaaaccctatgaatgtaaggtatgtagaaaaacctttactttctatagaaatcttactctacatcaaagtattcatactgatgagaaacctttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggnaaaccttatgaatgtaaagaatgtg

SEQ ID NO: 24227 - DNA, 428 bp, Homo sapiens
  misc_feature 8, 10, 50: n = A,T,C or G
cacctctngngggcttctcagtggtatagagttaaaaccaggtactgtgngtactcacctgattcttggttcttatgaaggcactttcatttgtagttgttacatttgtgtccttatggggtggagggaaaatctgtgtagacttctagtctgccatcttgttctgccccaagtcccaactcatattttggagccagaatttttttctaatagtaaataaaacaaaaacagtataagaaaataaaactacagaataataccactcatgaccatacgcacgacaatactcaacaaatgattagcaagtcaatccagaaacatatacaaataattataaaccatgacctattacaagaaggcatgcctgttttaatatttcaaaacaatgcaatgcaatatataatatgattaataaaaagaagccaagc

SEQ ID NO: 24228 - DNA, 381 bp, Homo sapiens
  misc_feature 12, 18, 30, 32, 51, 52: n = A,T,C or G
cctcggctctcnatggancgggcataacanantcattaagggggccagccnnacagtaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaact

SEQ ID NO: 24229 - DNA, 358 bp, Homo sapiens
  misc_feature 2, 17, 38, 44, 73, 332, 343, 349: n = A,T,C or G
anggaacgggctaatcnccttccattatattttgcatnctccancacgttatagttttctaaaagtctgactngggtgttttgttttcttaaaatatcttctatatctctgcttaattcactcaatatttttcagctttcccaattatagggaatacagttagagtatcagttttaaaataggattctgtgaagatggcagagtaagaagtaccagaaatctgtctgcccacttagacaataattacactggcagaatctatttgatgtaactcctttgaaactctggaatccattgatgacttgcaactttcagggaaaggcttggctggnaatccgcagcnaattgngggaatgac

SEQ ID NO: 24230 - DNA, 248 bp, Homo sapiens
  misc_feature 11, 28, 29, 38, 42, 44, 183, 196: n = A,T,C or G
gagcaggcatnacaccattttcccaggnnttcgcctgncccngnttcgaagtattcaataccgctcagtcttttaaatgaagtgattctaagatttggtttgggatcaataggaaagcatatgcagccaaccaagatgcaaatgttttgaaatgatatgaccaaaattttaagtaggaaagtnacccaaacacttntgctttcacttaagtgtctggcccgcaatactgtaggaacaagcatgatctt

SEQ ID NO: 24231 - DNA, 157 bp, Homo sapiens
cagcctgaaggcatacttttgcctagaaataaaaaaaatactgatttggggcaatgaggaatatttgacaattaagttaatcttcacgtttttgcaaactttgatttttatttcatctgaacttgtttcaaagatttatattaaatatttggcatac

SEQ ID NO: 24232 - DNA, 441 bp, Homo sapiens
  misc_feature 2, 8, 33, 34, 47, 58, 63, 89, 437, 438: n = A,T,C or G
antgtccnttcggttcttatggaccgggggganngactattcgaggnaggagttgagnagtancggagcggacgccatggcgaccaacntcgagcagatttttaggtctttcgtggtcagtaaattccgggaaattcaacaggagctttccagtggaaggaatgaaggccagctgaatggtgaaacaaatacacccattgaaggaaaccaggcgggtgatgcagcttgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaaacaaaaagaggaanngga

SEQ ID NO: 24233 - DNA, 257 bp, Homo sapiens
  misc_feature 8, 10, 39, 40, 41, 128, 166, 194, 197, 215, 236, 240: n = A,T,C or G
accggggnanacccagcctctctgccctactgctgctannnaagaccctgagactgacctgcaggccgaaaccatgaagagcctgatccttcttgccatcctggccgccttagcgggagtaactttgngtgatgaatcacgtgaaagcatggaatcttatgaactnaatcccttgattaacaggagaaatgcanatncctggatatggccctcancagagatggagagctaaagtncganataggatgcgagaacgc

SEQ ID NO: 24234 - DNA, 500 bp, Homo sapiens
  misc_feature 4, 13, 40, 111, 447: n = A,T,C or G
cgcnactcctaanttgttttttattaacttttcttaactntatgtatagctcacatttatttcaatgcttgatattagaaatattttggtctttatttagtaaattttggngatgttgtgaccagaaatatgacataggaacttaaatcttgtttatgtcaattagcctgtggttaaattggtttcagtatatgtcatttcacataaagttgcagtttccaagaacctatccacaacattaagcgaagacttactgtattgaaccttgattgtgacctcacatcatccatagttatgcattgtataatgacattttgatgaacaacagtcctcatatataatggtggttccagaagattatgatagagctgaaaaattcctgtcacctaattgaggttgtagtcatcgtagcatcgtcagacagtgcattactcacatgtttgtggngatgctggtggaaacaaactcgtgctgccagcaaatataattatatgtagtac

SEQ ID NO: 24235 - DNA, 386 bp, Homo sapiens
  misc_feature 5, 7, 384: n = A,T,C or G
cgcgncngaacagagccctcggtgatgcggacatctcagggaaacttgcgtactcagcacagtagtggagagtgttcctgttgaatcttgcacatatttgaatgtgtaagcattgtatacacttgatcaagttcgggggaataaagacagaccacacctaaaactgcctttctgcttctcttaaaggagaagtagctgtgaacattgtctggataccagatatttgaatctttcttactattggtaataaaccttgatggcattgggcaaacagtagacttatagtaggattggggtagcccatgttatgtgactatctttatgagaattttaaagtggttctggatatcttttaacatggagtttcatttcttttcattgtgntc

SEQ ID NO: 24236 - DNA, 435 bp, Homo sapiens
  misc_feature 2, 8, 29, 41: n = A,T,C or G
anggagcngggtgtctctacaactcaggntggcgcattatnacaagacagattaatccctctttttgtgacacaagtacaatctaaaagttatattggaaaacatggaaatattaaaattttacacttttactagctaaaacataatcacaaagctttatcgtattgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggcttaaggattaga

SEQ ID NO: 24237 - DNA, 498 bp, Homo sapiens
  misc_feature 17, 22, 493: n = A,T,C or G
aattagctgggtgtggnggggngcaccctataatcccagctacttgggaagctgaggtgggaggatcaccagagcctgggaggtcaagggtgcagtgagtggtgacagtgcactgatttccagcctgggtgacagtaagagcccatcacaaaaactaaaattaaataaaatactatttttaaattttcatatatattaatgacccaggagtctactcttcattgattctaagtgattttcatgcctagaactgcatcttaggtattaaatatatttaaatattgagtaaccaaatatttactttcaaaaattgctgttaagactatgcctaggaacaatcttgacaaatgtactactggctaagcatcatttcataacatcattaggaaagtgtattgcatagcagaaagagtttcattttgacttggaggctcacgatattaatagatgcgtgtgacaatgccattatttgaagctcacacatttttgaagnggtgc

SEQ ID NO: 24238 - DNA, 500 bp, Homo sapiens
  misc_feature 2, 11: n = A,T,C or G
tncgcatgccngaaaatgaaatgataattttacattctagcaggatgtatttcttgatacctgttctgagaggacagaaacaaggctcaaaattcatgcaagaggctaataacaacttagttgatagtaaaatatggagcattggatgtagagtgcattaaccttcttgtttaatctgagttgacctataagtgggcatattgttttttggggaatcgggagttttctcaagtagaaagaagccccacttttcctttgatagggtaccagtcaaggaaataaatgctcttttttctacctgagttagatttgcctttcatttgctcaccctgatctgtgtggctttattgaccactacagtttaagcccatgcaacctgcatgctgtgcaagaaagaaaggtgatggacagatagtcccagagttaaacttctggtgcctttgccactccatgtcttgccatcttattatcatagtagctttgggtatggcctcctagca

SEQ ID NO: 24239 - DNA, 468 bp, Homo sapiens
atacaacagctaggctcttgctattagaagaaaaatagtatacagcatgaattcaattcctgagaaactcaaagcctaatatagagaattgagaaattgaaaaattggaggagagaaaaagcagcccgtaagtatttcagatagtttcaaaattgatatgactggctcttagtcttcaaaaatagaattatctcacttgaatatttaaaaagtacctagaattttcttctctgttctgtagtgaagatgggaagtcactgacatgaaattacccaagaatagaggccatgttatcaatcttttttcactgatgcttgactcatactcccggttaggacatccagtttctgtttgaacactgccattgatgacatatgagatgcagtctgctctagtttggaacagcttcttagaaagtcctttataatgtaacttccagccattgttcctggtccctgcctccggggc

SEQ ID NO: 24240 - DNA, 428 bp, Homo sapiens
  misc_feature 8, 16, 32, 36: n = A,T,C or G
tagtcatnatgcagtnatttcaagccagcatntgcngaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccaccggggatagaggatagtgaattgcgcagaacgctgcagtccctggcctgtggcaaagctcgtgtgctgattaaaagtccc

SEQ ID NO: 24241 - DNA, 339 bp, Homo sapiens
  misc_feature 7, 9, 62, 63, 72, 101, 134, 193, 194, 230: n = A,T,C or G
ccgcatnantttgaaactggggaaaaaagaagaaaccctaaacagaaagctgttaaaaaganngagaataanttgtaacctaagaagacttttagccaaanaccccagcagctgggtccaatccattttattantctgcatggaaaaagatggggaggacttcattttttttaaaggttttttagaatactgnnccaagaagtttagtgttttgcagctttgagctaggnggtaatgcaaatataaaatgctgggaacagaaaaggacaggttaattccaattgttgaggagttaagtcattgatggggggggcattgatgagttcttaaaggatggga

SEQ ID NO: 24242 - DNA, 151 bp, Homo sapiens
  misc_feature 4, 13: n = A,T,C or G
agcntgggcctgntgtcacgcacctgtagtcctagctactcgggaggctgaggcagaagaattgcttgaacctgggaggcagaggttgcagtgagctgagatcatgccactgcactccagcctgggcaacacagcaagactccatctccac

SEQ ID NO: 24243 - DNA, 197 bp, Homo sapiens
  misc_feature 5, 9: n = A,T,C or G
tggtncggnggccaatactggtccaagcttgtggctgaggacctctcccaggactgcttctggacaaaggtgaaggaggaccgctttgagaacaatgaacttttcgccaaacttacccttaccttctctgcccagaccaagacttccaaagccaagaaggatcaagaaggtggagaagaaaagaaatctgtgcaagg

SEQ ID NO: 24244 - DNA, 489 bp, Homo sapiens
  misc_feature 4, 5, 391, 439, 483: n = A,T,C or G
cganntgagccaaagctaagacccccgaaaccagacgagctacctaagaacagctaaaagagcacacccgtctatgtagcaaaatagtgggaagatttataggtagaggcgacaaacctaccgagcctggtgatggctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggnccaatctatcaccctatagaagaactaatgttagtgtaagtaacatgnaaacattctcctctgcataagcctgcgtgagattaaaacactgnactgac

SEQ ID NO: 24245 - DNA, 500 bp, Homo sapiens
  misc_feature 10, 12, 27, 29, 34, 36, 38: n = A,T,C or G
catgtctgancnttccaggggcgcgcngnccaananangtctcgctccgtggccttagctgtgctcgcgctactctctctttctggcctggaggctatccagcgtactccaaagattcaggtttactcacgccatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattgcaaattctgcttgcttgctttttaatattgatatgcttatacacttacactttatg

SEQ ID NO: 24246 - DNA, 497 bp, Homo sapiens
  misc_feature 18, 19, 29, 51, 410, 417, 439, 463, 473: n = A,T,C or G
attttccaggggctgcgnntccctatttntgtaagattaatattgttaaancgcccatattaatcaaagcaatctacagattttatgccatccatatcaaaacttcaatgacatttttcacagaaatagaacaacccgacaatttgtatggaactatagaagatgctgaatagccaaagtaatcttgagcaaaaagaataaaactggaggcgtcacatttcctgattttaaaatctactataaaattatagtagtcaaaacaactttatactagcataaaaacagacaaatagactaatggaacagaacagaaagcccagaaataaatccacacatttacagtcaattgatgtttgacaaaggtgccaagaacacacaatggggaaaggacagtctctttgataaatggngttgggncaactgggtatacatacacagnagaataaagaagaataaaattagntccttatttnacactatatacaaaatatcaattg

SEQ ID NO: 24247 - DNA, 338 bp, Homo sapiens
  misc_feature 2, 63, 183, 296, 316, 330: n = A,T,C or G
tntaaaatttgggcagatgcaggataactgaagcccgattctgggggttgttacaagcacagntacagggccttcctcacacccatgtcttcagatacccaaggcctttaatacccaagtccttccaggattctgcacatctcattggcttcatattccccttgatgcaatgaatcttttggnttcagagctacatgttgaagatgaaggagccatagtgtggaaaagccaaagttcctgaatcactgaccaggggagagttgcccattagccaagaagaccggctttagactttntgagaaaagggtttgctgtnaaaaggaaaagctntgagtcat

SEQ ID NO: 24248 - DNA, 342 bp, Homo sapiens
  misc_feature 18, 22, 249, 263, 303, 310, 319: n = A,T,C or G
ccattttccggggacgtntgcnttattaatataatgaatattgactgcccaatgatgtctcaatgacatttcgcagccctagagtaacttacaaataaagaagtagattaaggcctttgcaattctattgtcctgtgtttcttattgtaattctgtctgcctttctcccaccttcttttgctttttctgtttcaattaataacttgctagaagatcaacagaagccaactgtatagaaatatttgtggnaggccggacacggnggctcacgcctgtaatcccagcactttgggaggccaaggngggcggntcacgaggncaggagatcaagactatcctggc

SEQ ID NO: 24249 - DNA, 259 bp, Homo sapiens
  misc_feature 19, 25, 108, 161, 165, 179, 235, 240: n = A,T,C or G
actgtagtctcagctgctngggacnctgagataggaggattgctcgagccacccaagagttggaggctgcagtgacctgtgctcatgccactgtatgccagtctgggnaacagagtaagactgtgttaaaaacaaaaaagaaaatagattatctgtggaanaatngactgagaattggnacacggaaacttttgaggtgatattaacattctatatcttcattacggtgatggtnataanaaattattgatctggaaaa

SEQ ID NO: 24250 - DNA, 179 bp, Homo sapiens
  misc_feature 33, 166: n = A,T,C or G
gaagacagcaataaccacagtacatattactgnagttctctatagttttacatacattcataccataactctgttctctcctcttttttgttttcaactttaaaaacaaaaataaacgatgataatctttactggggaaaaggatggaaaaataaatcaacaaatncaaccagtttggg

SEQ ID NO: 24251 - DNA, 104 bp, Homo sapiens
  misc_feature 25, 85, 92, 95: n = A,T,C or G
atgctaccctgggactttggggccntgtacttatactcttggagcctctaggtccttatctacaaaaggaaaatgtgagaaactnatgaagnatnaaatgtagc

SEQ ID NO: 24252 - DNA, 177 bp, Homo sapiens
  misc_feature 19, 25, 31, 33, 55, 59, 62, 64, 75, 78, 82, 93, 142: n = A,T,C or G
agcggggtgcccattaacnaggggntcgtgngncattatttaactagatgccctnatanacncnatttgctagtnatnctangtgtactttanccaaaccttataggtaaaagtctgaattaacagaatggatatagtgagncatacaaaagatacactgtgggaattattaaaata

SEQ ID NO: 24253 - DNA, 310 bp, Homo sapiens
  misc_feature 13, 21, 30, 43, 306, 307: n = A,T,C or G
caagtcggcgatnatggaccnggcatccanaagtctggggcanctgtccttagactgatgagcaaaggaggagtcaactaatgaagaaatgaatgataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtnnaag

SEQ ID NO: 24254 - DNA, 383 bp, Homo sapiens
  misc_feature 12, 14: n = A,T,C or G
aaccaaacgggncntccaaatatacaaagtgtcttatttagagagaaatcacaatctaaaagaggctatctttgatcaatggcaacactcaacatcaagggggctttggataaacccacaaattgcctccattcctcatttattctcatgaaaaatttcaaagtcatgataattatagcagagagtcattcaatctaaaacccacacaatgctgcactgtggttcatcaaaaacatggttagcaaatttcagctttacacttaagaaaactcagtcaatttcaaataattgagataaaacttataccctgcttgattctgcttatcgctgataattttagtctgttcagattctgatgattctaaatattttcatttagttgc

SEQ ID NO: 24255 - DNA, 499 bp, Homo sapiens
  misc_feature 16: n = A,T,C or G
acaatgctcagatccntttgactaatggacttgactctcacagtatcacaagtagtaggaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttc

SEQ ID NO: 24256 - DNA, 225 bp, Homo sapiens
  misc_feature 6, 11, 70, 89, 91, 94, 97, 112, 122, 152, 166, 188, 209: n = A,T,C or G
caggcngcgcncgggcttctgctgagggggcaggcggagcttgaggaaaccgcagataagtttttttctntttgaaagatagagattantncanctncttaaaaaatatagncaataggttnctaagatattgcttagcgttaagtttttancgtaattttaatancttaagattttaagagaaaatntgaagccttagaagagtaccntgaggaaggaaaagat

SEQ ID NO: 24257 - DNA, 480 bp, Homo sapiens
  misc_feature 8, 10, 81, 402, 417: n = A,T,C or G
gctgacantncaggatgcgcagcacattagcaagtgctctggctgggcttattgccaaacaggaattgttggaagctttgntggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagtaagcagtgatcaattctttaaaatgtcaataaataagggagctaattttcttttattttgaattatttgaaatttgggggcaattggngattttacatgagcncttgatatcatgaaatactttctagaaggaatacgtgtgctcaagtattgtagaaacttattt

SEQ ID NO: 24258 - DNA, 130 bp, Homo sapiens
  misc_feature 13, 31: n = A,T,C or G
accgggcatgttntgctctgggggcgctagncgataccctatctcttaaaaaagaagaagtttttaaatttgaaataataataggtactggatttatgcaaatgtcttttctgcgtcttttgagatgagt

SEQ ID NO: 24259 - DNA, 151 bp, Homo sapiens
atctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccac

SEQ ID NO: 24260 - DNA, 329 bp, Homo sapiens
  misc_feature 3, 5: n = A,T,C or G
ccncnaaggccggggcaaggcatttttttatatatatttttgtgcacatttttttttacgtttctttagaaaacaaatgtatttcaaaatatatttatagtcgaacaattcatatatttgaagtggagccatacgaatgtcagtagtttatacttctctattatctcaaactactggcaatttgtaaagaaatatatatgatatataaatgtgattgcagcttttcaatgttagccacagtgtattttttcacttgtactaaaattgtatcaaatgtgacattatatgcactagcaataaaatgctaattgtttcatggtataaacgtc

SEQ ID NO: 24261 - DNA, 219 bp, Homo sapiens
  misc_feature 7, 10: n = A,T,C or G
tgagganggngcgaggggcttctgctgagggggcaggcggagcttgaggaaaccgcagataagtttttttctctttgaaagatagagattaatacaactacttaaaaaaaatatagtcaataggttactaagatattgcttagcgttaagtttttaacgtaattttaatagcttaagattttaagagaaaatatgaagacttagaagagtagcatgagg

SEQ ID NO: 24262 - DNA, 494 bp, Homo sapiens
  misc_feature 7, 12, 22, 31, 35: n = A,T,C or G
cgcgggngtgcncgatttgcgnggggcgcgntttncctcttttcctgctttcaaaaacctgttactgcaaagacctcggatttgtgggtcaatggatttgggtactatattcttcttaccgtatctttttttcttgctttcttcagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttta

SEQ ID NO: 24263 - DNA, 221 bp, Homo sapiens
  misc_feature 3, 9, 93: n = A,T,C or G
tgncaccanggaagggtgcctggtattttgaaatcactgtggatgagatgccaccagataccgctgccagactgggttggtcccagcccctangaaaccttcaagctcctttaggttatgataaatttagctattcttggcggagcaaaaagggaaccaagttccaccagtccattggcaaacactactcttctggctatggacagggagacgtcctggga

SEQ ID NO: 24264 - DNA, 189 bp, Homo sapiens
  misc_feature 2, 77, 172: n = A,T,C or G
cnaagagattattagaatttgagttagctcagcttacgaaacagtatagaggaaatgaaggacagatgcgggagctncaagatcagcttgaagctgagcaatatttctcgacactttataaaacccaggtaaaggaacttaaagaagaaattgaagaaaaaaacagagaaantttaaagaaattccgga

SEQ ID NO: 24265 - DNA, 217 bp, Homo sapiens
  misc_feature 2, 4, 34: n = A,T,C or G
ananaaaagaccgggccagggtaccacaagaaangaatgggtttatccagcctggccaacatgtcgaaagcctgtgtctactaaaaatacaaaaattagtggtggcagatgcctgtaatcccagctactcggaggctgaggcaggagaattgcttgaacctgggagacagagttgcattgagccgagattgccccattgtaatctagcttgggtgac

SEQ ID NO: 24266 - DNA, 451 bp, Homo sapiens
  misc_feature 10, 13, 449: n = A,T,C or G
tgaggggttntgnggaaaattggttttactgggtaaattaatacttttatttcttcccctatcccttccttcctagttgtgataaacatgggagaggagtgactttgactgctggggaatttcctcctaagaaccttattcccaaaataagccaggggttatgtcaaggcttctttcaaggaggctcataaaagcagtgacctcatccggggctttggatagagtgagaattccccaactaaattggacttctctgctttatccccttctcttccttcaccatctgcactacatttctggctgatcccaatcagattcccgctaatggaagaagtttagaatctttcaggtggaataaagtcacatgaaaacaaaacacaactatatattttttcaggttttttttgccttattggattttttttccaaaaaaaaaaaaacctcctaantt

SEQ ID NO: 24267 - DNA, 479 bp, Homo sapiens
  misc_feature 5, 14, 25, 27, 65: n = A,T,C or G
aggtntggaaagtnggggggagagntntgggcgatggaagtgggcattgaagattgtctacatantagaatttgaatataataaatcaaagtatcatttaaaggatgtgattgttggaaaaatttacttcttattagtaagaataaaaatacaacatatggagttacagctgatcaaaaaagagatcacaggaattggacccagtaccacaacagaaacagaaacaatcgccaaatatgaaataatggatggtgcaccagtaaaaggtgaatcaattccaataaggctatttttagcaggatatgacccaactccaacaatgagagatgtgaacaaaaaattttcagtaaggtactttttgaatttagtgcttgttgatgaggaagaccggaggtccttcaaacagcaggagataattttatggagaaaagctcctgaaaaactgaggaaacagagaacaaactttcaccagcgatttg

SEQ ID NO: 24268 - DNA, 452 bp, Homo sapiens
  misc_feature 6, 16, 29, 31, 33, 38, 39, 43, 47, 48, 62, 67, 68, 69, 421: n = A,T,C or G
aaatcnaagaagggtntgtttgggggatngngnggagnngganggannagttaaaggggggngtttnnnaactccataggaaacttgttaatcaacaaagaagtgttagtgctgcaagtaatctctttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccaacccaatagcctgttgcccattgacctctagtgggngagtttctagaatactggtccattcatgaga

SEQ ID NO: 24269 - DNA, 365 bp, Homo sapiens
  misc_feature 7, 31, 39, 40, 41, 47, 48, 54: n = A,T,C or G
agagggntgttggggtggtggagagggatgntgattggnnnggggcnntcttgntggaaaatattttttacacaatacaacaggccaggcatggtgcctcatgccctgtaatcccagccctttgggaggttgaggcaggtggaccatttgatgttaggagtttgagaccagcctggccaatatgatgaaacctgtctgtactaaaatacaaaaattagccagtgtggtggtgccgccttgtaatcccagctacacttgggaggctgaggcaagagaatctcttgagcctgcaagacagaggttgcagtaagccgagaacgcatcactgcactccagcctgggtgtctcaaaaagatcctgtctca

SEQ ID NO: 24270 - DNA, 356 bp, Homo sapiens
  misc_feature 4: n = A,T,C or G
aagnaaggaaagaatattctgctaaagtttttattactagtcactctagtatgtattatacaaaaagatactggaaataattcagtatagttagaagttcaaaactaccttttcaaatcacacagtcataattactacctgattagaaaaggtcatttacaatcaactaaatttttaaagttactatttattgacaagcatataagttcactagaaacaagttttcatctctatgaaatattgcaggtgtctctccaaatgatttacagagtaagatgtctctcacacaaactgtatctgcagattattgtcatctaaaactaggctaaagagtctaacatctgttaccccacact

SEQ ID NO: 24271 - DNA, 184 bp, Homo sapiens
  misc_feature 5, 14: n = A,T,C or G
gtttncgtttgganttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatc

SEQ ID NO: 24272 - DNA, 214 bp, Homo sapiens
  misc_feature 2, 18, 28, 29, 30, 34, 44, 50, 52, 53, 56, 57, 58, 61, 62,65, 69, 131: n = A,T,C or G
ancatgaaagaagggggnggtgggatannnaggngagggaagantgaggngnnggnnnggnnttnagancagttctttgttagcctggtttctagttggttatctagttaccaatgcctgcagtccctgcngtcaccctatacattatttaaatgtatttaactgttaaatgcgctacccaccaataatgaaatagacctttatgaaaactttt

SEQ ID NO: 24273 - DNA, 404 bp, Homo sapiens
gatgctaagtccatttcagtccacccatctccagctcgcagaattactgaagtttggggtattccttcccccattgatactgtttttactaggtgcaacctgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtattggagaaacgacacaggttaggagacgtcgcttt

SEQ ID NO: 24274 - DNA, 444 bp, Homo sapiens
  misc_feature 156: n = A,T,C or G
agaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcnctatcacaaggaatataggcagatgtacagaactgaaattcgaatggcgaggatggcaagaaaagctggcaacttctatgtacctgcagaacccaaattggcgtttgtcatcagaatcagaggtatcaatgggagtgagccccaaaggttcgaaaggtgttgcagctttcttcgccttcgtcaaatcttcaatggaacctttgtgaagctcaacaaggcttcgattaacatgctgaggattgtagagccatatattgcattggggggtacccccaatcttgaagtcag

SEQ ID NO: 24275 - DNA, 434 bp, Homo sapiens
ggttgtacccgaagcctgacaatgaagagtagaaccctacctaagataaactaaaagaaatgttatttggtgtttaatgattatatcaagagcaaaaagacaaaaaaaggaagaggataccacctcttggatctgggtgatgccaacagatgccagagaaaacttcagttttgcttaatctctttgggcttccattttctctttcaaggaaaaagaagagcccatacaggttagtactaaactggatgacctagtcaagcctccttagtttgaaagaagctaccagctaagaaatgacatagtaggggatggctgtagggatgcctcaagaatctcagacagccagggtaatcagaaagatgttaacaaaataattgtcctctccaggtctcagggaaaaaatgcctagctcggggggttttggcattgttgga

SEQ ID NO: 24276 - DNA, 374 bp, Homo sapiens
  misc_feature 328, 372: n = A,T,C or G
tctacaaatatggtcaatgggttttttttaacaaaggtacaaaaatcaatttaatggagaaaagacagtcttttcagcaaatgttactggaatagttgtcatccatatctaaaaaacaacacctcaacctcacatctcatacacagctgaacttaaaattgatcatagatctaagtgtgtgaaatgtaaaactataaacctccttgaaaaaatcatagaaaatcttcatcacctggacttgggcaaagactttttactctaaaagcgtgatccatagcagaaaatgttgataaattgaatttcatcaaaactaaaaatgactgctctncaaaaggatgatgctaagagaataaaaaagacaagctaagattngg

SEQ ID NO: 24277 - DNA, 347 bp, Homo sapiens
  misc_feature 14, 23, 36: n = A,T,C or G
tggaggggatcttngtttggggngggagagtgggancctatctcaaaaaaagaagaaagaaaagaggcccggcgtggtggctaacaccctgtaatcccagcattttggaagactgaggcgagcggatcacgaggtcaggagtccgagaacagcctggccaacatagtgaaaccccatctctactaaaaatacaaaaaaaattagccgggcatggtgacttgtgccagtagtcccagctacttgggaggctgaggcaggagaatcacttgaacccaggaggcggaggtttgtggtgagccgagatcacgccacttgcactccagcctggcgacagagcgagactccat

SEQ ID NO: 24278 - DNA, 227 bp, Homo sapiens
  misc_feature 7, 17, 18, 30, 32, 38, 49, 50, 51, 68, 75, 87, 88, 90, 101,144, 205, 223: n = A,T,C or G
catgaanttgttcctgnngtgccagaactncnaccctntctctgagagnnntgatcgtgcctataaanagtaggnccaatgtgaganntnaacattcatcnggcttggaatgaattctctctaaaaataaaatgatgtatgatntgttgttggcatcccctttattaattcattaaatttctggatttgggttgtgacccagggngcattaacttaaaagatncact

SEQ ID NO: 24279 - DNA, 497 bp, Homo sapiens
  misc_feature 3, 14, 38, 43, 46, 47, 60, 62, 63: n = A,T,C or G
aantgaagaggggngctggggaagggggggagggaggnagaangtnngggggggtggaananntgctgcattatctgaggttttctccttttcctggcctatgagaacttcatcagggactggttctggtcaggggctggcatccagttccacagatcctgctgatgacattgtccatgccttccccaaccatgaggaccaacaatgttggcaccagttctgcaagctcagctcccaaccacaacacacaagactcgagcaggagatggtttgctccccatcctaggggttctaggatacttggtaaggagctcagcccaagagctacaatgccgttgtgagagtttctgaagccaggagtcaaggctttactttgagcacatggttttggcggtcaagcagaatgggctgggcaaatccaggaaggcttcatgggggaaatgaattttgaacttggccttaaaggatgggtaggtgtaaggaagaaggttgtagga

SEQ ID NO: 24280 - DNA, 443 bp, Homo sapiens
  misc_feature 13, 14, 27, 36, 37, 49, 56, 57, 62: n = A,T,C or G
aaaaagaagggtnngtttggggatggntggcggggnnttggggaactanggggggnntaacnatttataggctgtgaatagacacattttacctaagagtatatactatctgtaagtagcttgaaataaaatcattaatgtttttgattttctatttccaaagaaccagaatatgtcctggtcatggacattcaagccagtactttccgtaatacctaactatggcaagagtgttagagagcaaattattcttcctaagaacgatattccatgcaggaagccagagttaccttccatagaaacacaattgctcaaagaagaagagctttcaactccctggccaagccttctttgaaatgattctgtttttctgttacttattgggggatctggggaaaggcaggatatttgcttacttgtttctcaaatttaagattaaatat

SEQ ID NO: 24281 - DNA, 377 bp, Homo sapiens
  misc_feature 11, 29, 36, 42, 51, 53, 236, 357: n = A,T,C or G
gtttggggttnatggagagggggtggaanaaaaaangggtgngggttagananttctacctgcgctactacgtaggggcacaagggcaagtttgggcacgagtttctggagttcgaatttcggccggacggaaagcttagatatgccaacaacagcaattacaaaaatgatgtcatgatcagaaaagaggcttatgtgcaccagagtgtaatggaagaactgaagagaattattgntgacagtgaaatcacaaaagaagatgatgctttgtggcctccccctgatagggttggccgacaggagcttgaaattgtaattggagatgagcacatatcttttaccacatcaaaaataggntctcttattgatgtaaatca

SEQ ID NO: 24282 - DNA, 479 bp, Homo sapiens
  misc_feature 4, 8, 65, 157: n = A,T,C or G
tgtntgtntttgaggggggtgttttgagggggctgcggtgtctgctgctattctccgagcttcgnaatgctgcctaaggaccgacaagaagaagaaaggacgctggaaagtcggccaagaaagacaaagaccccagtgaacaaatccgggggcaagnccaaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagccttcagggaagcctccttagtaaaggacttatcaaactggtttcaaagcacagagctcaagtaatttacaccagaaataccaagggtgggagatgctccagctgcctgggggaagatgcatgaataggtccaaccagctgtacatttgg

SEQ ID NO: 24283 - DNA, 167 bp, Homo sapiens
  misc_feature 85: n = A,T,C or G
agccatctcccgagaaaaatatctcattaaaaagcccataaataataggggagaagaaagccttaggtatcaattccaaaacagngattgaaatttcccaaaataattatggcttctgtcatctccagagataatctggcttggtttaccccataatctaatttcag

SEQ ID NO: 24284 - DNA, 493 bp, Homo sapiens
  misc_feature 218, 360, 393, 396, 452, 487: n = A,T,C or G
gaacccataggcagaggcatgagctggacttcatgtttcccccaaagaactctcccgtggatgacggatgaggactctgggctgctggaataggacactcaagacttttgactgccattttgtttgttcagtggagactccctggccaacagaatccttcttgatagtttgcaaggcaaaacaaatgtaatgttgcagatccgcaggcagaggctctncctttctgtatcctatgtatgcagtgtgctttttcttgccagcttgggccattcttgcttagacagtcagcatttgtctcctcctttaactgagtcatcattctcagtccaactaatgcagtcgatacaatacgtagatagnaagaagccccacggagccagggatgggactggncgnggtttgtgcttttctccaagtcagcacccaaaggtcaatgcacagagaccccgggnggggtgagcgctggctttctcaaacggcccgaagntgcctt

SEQ ID NO: 24285 - DNA, 391 bp, Homo sapiens
  misc_feature 6, 31, 34, 38, 43, 45, 52, 57, 58, 60, 61, 64: n = A,T,C or G
tagaantgtgttttcggggatttatggcgcnggnatancttcntntttcgangggcnngnncancgagaatagcagaaataagagtaagactcaggggagaaatgggacgaaaaaacaggaaagccagagaggtaaggaaaggagaaagaggagaaaggagggaagctgaagaaagaagagaaagaaaatggagagaggaagggaggaaggaaaagagtgagggagaaattaagggaaggtgggggaaagaaatgagagaaggaaatgaaagaaagaagaaagaaaagaaggcaggaagagagacaggaaagaaggaagaacgaaagaaaaaacaggaaagccagagaggtaaggaaaggagaaagaggagaaaggagggaagcttgaaga

SEQ ID NO: 24286 - DNA, 153 bp, Homo sapiens
  misc_feature 82, 129, 147: n = A,T,C or G
tatagtcaataggttactaagatattgcttagcgttaagtttttaacgtaattttaatagcttaagattttaagagaaaatntgaagacttagaagagtaccatgaggaaggaaaagataaaaggtttntaaaacatgacggaggtngagatg

SEQ ID NO: 24287 - DNA, 499 bp, Homo sapiens
  misc_feature 13, 29, 31, 33, 37, 39, 41, 43, 49, 51: n = A,T,C or G
gaaggtagttggngatgagggagaggatntngntttnangnantctcancngcatacaatgaattgagaaatatttatttttgaaaaactgcatgaacttcagtaaaagcaactatactgtggcctccttgcctgaggctgctctgtctacactgccctcagcttggttagtgagaacagtagttttatcactgtggaactggctgcaaaaaccagctggtttactgctattgggacagatgatttcaccgaggtgtaaagatccatggctctcctggccaaaagtgatggaggccgttgggaattaacaagcagaacctacagctttgctagctcaaggtttgatccctgatgaagcaacggtgatcagccataagtttagcagggagatcctggaaataatctgggagaagagcatcattggaagggctgagataagctctctacatatccctagttgattgggaaaccatgcatgtgtcggggggagacctaaaag

SEQ ID NO: 24288 - DNA, 372 bp, Homo sapiens
  misc_feature 3, 14, 15, 22, 27, 32, 39, 41, 43, 111, 133, 175: n = A,T,C or G
tcnaaaattgagtnntctcacntctcnagagngctgtancntncccctcttaaccattatgctgtgctgcttagagtggttttctctttgccccaggagaactctcactanataaaccaacagcatattcagnacatgtgtgttgcttctcagcggaaaagttctcagctttgtngggcatttgttgctgttgcaaattgagttgtttagtttcctttcattattggcacatgcttgtgatcccagcacttcggaggctgaggcaggaggattgcttgaggtcagcagtttaagaccagcctaggcaacatagtgagacctttatctctatttataaatgtatataatttatttcacattaaaaatttgggt

SEQ ID NO: 24289 - DNA, 143 bp, Homo sapiens
tatatgtgcccttccccatggaacttttttagggcactaagaatttcaaattctaagaatgaaatgttttcatgtcttttttattcggggaaatgaaaaagaaaaaacttccaagtgactcaggagatttagaagcgttagag

SEQ ID NO: 24290 - DNA, 120 bp, Homo sapiens
tgagaacacctcagattcctcgtgtaaccggagaatcgataacaaatcaaatatttactgagtgcctgtgatgtctgtggcactgggcaggaccaagttttacctcttataaattttaac

SEQ ID NO: 24291 - DNA, 316 bp, Homo sapiens
  misc_feature 2, 17: n = A,T,C or G
cnggctggtgttgaggntggcatacgtatcaaggaacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactatgatgtcatgaaagattttgaggagatgaggaaggctggtatctttcagagtgtaaagtaatcttggaatataaagaatttcttcaggttgaattacctaga

SEQ ID NO: 24292 - DNA, 392 bp, Homo sapiens
  misc_feature 3, 14, 28, 29, 38, 43: n = A,T,C or G
ganacgaaaaggcntatctagaacctanntatggcgcnggtanccccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagagg

SEQ ID NO: 24293 - DNA, 445 bp, Homo sapiens
  misc_feature 1, 3, 24, 26, 78, 436: n = A,T,C or G
nanatttggggggtgggtaatggntnccgcaaagaagggtggcgagaagaaaagggccgttctacccatcaacgaagnggtaaccccgagaataccacccatcaacattcacaagccgcatccatgggagtgggcttcaagaagccgtgcaccctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgagggatgaagattcaccaaataagctatatactttgggttacctatgtacctgttaccacttttcaaaaatctacagacagtcaatgtgggatgagaactaatcgctgatcgtcagatcaaataaagttntaaaattgc

SEQ ID NO: 24294 - DNA, 270 bp, Homo sapiens
cacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccct

SEQ ID NO: 24295 - DNA, 214 bp, Homo sapiens
gtagttagccgggcacggtggctcacgccctgtaatcccagcactctgggatgccgaggcaggtggatcacctgaggtcaggagttcgagaccagcctggtcaacatggtgaaaccctgtctgtactaacaatactaaaatcagaggttgcttgcagtgagccgagatcataccattgcactccagcctgggcaacagagcgagactctgtctc

SEQ ID NO: 24296 - DNA, 498 bp, Homo sapiens
  misc_feature 3, 13: n = A,T,C or G
tanaagaagcctncttccgcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttc

SEQ ID NO: 24297 - DNA, 466 bp, Homo sapiens
  misc_feature 16, 21, 390, 393: n = A,T,C or G
tggttccctgaagccnttganaattagttgtttcttattcaggttacttttaattgagttgtgcatgcaaacccacatgtatccctctctgcctctgaggagaatggggcctttcttggagaacacaaaagtaggaattctgattttattttgtgatcttagtcactttacaattataaaaattttggagctaatgagaaacctgaaaaattctgaagtcttcaaggagtgtgatcctggtgctgtctctcaggcatttctcccagagaacgggacggcagagcaatgactgttccccagcccacaggtaggagcttggtgggcagcaccagcagcagtagacctagaagtcttagacttagatgtgattttgaaatatggcttttattnttngggagcagcacacataagaccatcattggttctcatatgggaaaaacccttgaatattggctctaggacagat

SEQ ID NO: 24298 - DNA, 253 bp, Homo sapiens
  misc_feature 2, 10: n = A,T,C or G
anatcaaagnataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaaga

SEQ ID NO: 24299 - DNA, 498 bp, Homo sapiens
  misc_feature 1, 3: n = A,T,C or G
ncncaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattca

SEQ ID NO: 24300 - DNA, 463 bp, Homo sapiens
  misc_feature 14, 18, 27, 29, 31, 33, 35, 41, 47, 49: n = A,T,C or G
aaaggtgtttgggntganggagcaggntncntnantttaangggcgngnttatacactaccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtaga

SEQ ID NO: 24301 - DNA, 318 bp, Homo sapiens
  misc_feature 6, 24, 38, 39, 42, 43, 47, 48, 53, 104, 222, 317, 318: n = A,T,C or G
aaaaanaatgtaatttggggattntggcgggggataannaannaagnngggcnttgtggtaaacgcctgtagtctcagcctccccagtagttgggattacaggngcgcaccaccatgcccagctaatttttgtattttaactagagacgggtttcaccattgttggccaggctggtcttgaacccctgaccttgtgatccacccgcctcagcttcccaaagngctaagattacagacaggagccgctacagctggccatcttttagtggtcgcaccactccagcctgggtgaccctgtctcaaaaaatgaagaagtnn

SEQ ID NO: 24302 - DNA, 499 bp, Homo sapiens
  misc_feature 14, 420: n = A,T,C or G
agaggaccccgtgngggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggcacacnagatgtattacatgtttggcctcctatttctggggttatcaattttgggtattacctgttctgaagcaactatacttct

SEQ ID NO: 24303 - DNA, 474 bp, Homo sapiens
  misc_feature 1, 11, 15, 20: n = A,T,C or G
ngtgtagtgantacncattnacctcattagcactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcacctgacctgcctgtagccccagtgacagctaggatgtgcattctccagccatcaagagactgagtcaagttgttcctttaagtcagaacagcagact

SEQ ID NO: 24304 - DNA, 447 bp, Homo sapiens
  misc_feature 145, 147, 173: n = A,T,C or G
ggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatnantccaattcccaaggacaggcttcagnatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacaggaagaaaagc

SEQ ID NO: 24305 - DNA, 466 bp, Homo sapiens
  misc_feature 6, 9, 11, 27, 28, 37: n = A,T,C or G
aggtangtnangaaggggggggggtgnnataagaganactttctcttaatgatttagaatgcctcatttattatcagtaaatatagggtagatattccactgatacttacaatatgactatagcccttattaaaatcttaaaatgcttccatgctgattggtaaatatctgctgctctaagtgtcccctcctttccttccccctcagttcagacccttctctatcaatttaaaggggcttctctggtgcatttaaaggagtgagtgtggtattatgtcttccagactggagctccagggacaatgtaggtgtcaattctgctattttgaatagccaccctaactagggatatataggcacatggctttctgttctgttccattgattggtcgatctagtttgattctcttactgcatgattttaattgctatggctgtataatggggttttaattaataataaatc

SEQ ID NO: 24306 - DNA, 288 bp, Homo sapiens
  misc_feature 3, 16: n = A,T,C or G
ganctgtggagagggnttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaaattttgacactgaaaaacattttattaataaaggaatattgacatg

SEQ ID NO: 24307 - DNA, 493 bp, Homo sapiens
  misc_feature 5, 14, 29, 33, 432, 471: n = A,T,C or G
catgntgttcaagnccgaggaatcagaancctnctggatgccttaaaaaataagcaatgttaacaatgaactgtgtccatttaagctgtattctgccattgcctttgaaagatctatgttctctcagtagaaaaaaaaatacttataaaattacatattctgaaagaggattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtggaagatgtcaaaaaaagattttagaagtgcaatatttatagnggtattttgggttcacccttcaagcctttgccctgaggngttacaatcttgtcttgcgttt

SEQ ID NO: 24308 - DNA, 489 bp, Homo sapiens
  misc_feature 424, 429: n = A,T,C or G
taacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattgggaattaactgagccaaagtgattatgcattcttcatctattttagttagcactttgtatcgtntatancagtttacaatacatgtattaaccttgtagctataaacattttttgtgccatttaaagct

SEQ ID NO: 24309 - DNA, 449 bp, Homo sapiens
  misc_feature 2: n = A,T,C or G
gnaaaatagtagtgatgtgttcataatttactatttgcatggtatattatcaaggctgtaaaagcttgaatttgccttttccacatcttcatttcaaattaatttttgtgaggacccagagaagtgggtagaaccaaatgcccatgtggttttgttatggttatttagatcatttcagggtggggagtattttcagcaccataatatttctgtaccagggagattatagtattctaatttttttagggaaaaattgcttagctctagggatttctaaactttgaacaataaaagttaattttagaaataccttcagggtcatcattaagctttagcgtggcttttgttactgccctgttaagtaggttttgttggttagtatggacagtacagcaaacccattatgattcctttacagtgagaaaaatatgaaatagtccagaaagaat

SEQ ID NO: 24310 - DNA, 320 bp, Homo sapiens
  misc_feature 7, 16, 28, 33, 35, 57, 108, 111, 114, 279, 303: n = A,T,C or G
gaggggnggtgttgtngccggggggccnggcgntnatgctgagggggcaggcggagnttgaggaaaccgcagataagtttttttctctttgaaagatagagattaatncanctncttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaancttcttcatggagtaaaaaatgtntttaaaagaaaattgag

SEQ ID NO: 24311 - DNA, 399 bp, Homo sapiens
  misc_feature 16: n = A,T,C or G
aggtagcgctatgcantagtggaagtttatgctaatattgtgtaactgatattaaacctaaatgttctgcctaccctgttggtataaagatattttgagcagactgtaaacaagaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatataggttgtcacagtaaatatcttgttttttctatgtacattgtacaaatttttcattccttttgctctttgtggttggatctaacactaactgtattgttttgttacatcaaataaacatcttctgtgga

SEQ ID NO: 24312 - DNA, 170 bp, Homo sapiens
  misc_feature 169: n = A,T,C or G
agagatgacacaaacaatagaagaacattccatgcttatggataggaagaatcaatgttgttaaaatgaccatactgcccaaagcaatttatagattcaatgctatttctatcaaactaccaatgacattcttcacacaactagaaaactgttttaaaattcctatggnt

SEQ ID NO: 24313 - DNA, 370 bp, Homo sapiens
  misc_feature 6, 7: n = A,T,C or G
tgggtnnaagaaccaggcagaaggtaagtagggaaatagaatatagtacttgaacaatataagaaaccaagtagatcttacagacatacacggggcattctactcaacaacagaatgcatcttcttcttaagtggacttaggaccttctttaggatagaccatacattaggccagaaattaagattcaagagatttttaaaaatacgataccaagtattttctttgacaaaatgggatgaagtgagaaatcagtaacagaaggaaaactggagactttatgtaaattaagtaacaccctcttcaagaaccagtggtcaaaggagaaatcacaagggcaattagaaaaaaaaggattagaaacaatttaac

SEQ ID NO: 24314 - DNA, 351 bp, Homo sapiens
  misc_feature 24: n = A,T,C or G
tatggccgggcatatgacacctanttcttccctctcaggcacgaggtgatggaggtacaaattattgtctcttaagacagcttgtgggaaaaggagaaatttattatttaaacataaacagacacagatagaaccatcagcaatttgtgactgtaatgttaaagataaaagagagctgcccccagcacttagcaagtacctggcatcagctccttctcaaaaatacatgtggggctgggtgcggtggctcacacctgtaatcccagcactttgggaggcagaggccggtggatcacctgaggtcaggagttggagaccaggctggtcaacgtggtgaaacccgaccccact

SEQ ID NO: 24315 - DNA, 341 bp, Homo sapiens
  misc_feature 5: n = A,T,C or G
ctttnacagttcctttgaagcaggtatcttgcatggcccaccggggtgaagtccctgccatgctacctctgaaagtcaaaggccgacgcttctatttcctcttggacaaaactggacacttccctaacacaaaactctttgacaatactgtgggtgcctaccggagcttgtgaagaaatgacctcaagtcactcacctctccaagaggaggataaaaactgaaccttggggagccaggtgtgttggttcacacctgttgtaatcccagcactttgggagggtgaggcaggagcactgctcgagcccaggctgggcaacatagcgagaccttgtctctattt

SEQ ID NO: 24316 - DNA, 405 bp, Homo sapiens
  misc_feature 2, 5, 18: n = A,T,C or G
gnctngacatcaatttgnctaatcttgcagcagtacagtacagtcctgattattgcaactttaggaaaaggtctgataaaaaccaagatgcctccacattttgtcataattgtaaccaatttcacctctgtctccagtatcaccacaaaattgttcttccttggagtgtcttggctattcttagccaactgttcctccatattacttctagaattagaccaacaatttataaatcaaacaaacccaagagcattgaaattttgattggatttgtattgaatttatagattaatctggtaaaccatgtcatctttacaatgttgtcttccaatacatgaatatggtacagctcttcatttacttaggcctttgaaatatctttcaataaagtttataattttctgc

SEQ ID NO: 24317 - DNA, 387 bp, Homo sapiens
  misc_feature 4: n = A,T,C or G
gagnggaccgggcattcttaaaatggttggcttcttgtcctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgttttttattttgaaatgggagcttttttgtttacaagttcattaaaaactaaaaactg

SEQ ID NO: 24318 - DNA, 171 bp, Homo sapiens
  misc_feature 5, 140, 141: n = A,T,C or G
actgnttctgaaattcttaactattaagaatattttaatagcagcatgacttttagcagttatccattaagggcagttcctctaacaaggacgccttccagcttcagctgtgttacttacgtttgatgctaccttaaagnntgaatgacgttttaaggaatccctaaccct

SEQ ID NO: 24319 - DNA, 301 bp, Homo sapiens
  misc_feature 13, 42, 43, 54, 76, 81, 91: n = A,T,C or G
gtgaagaaacaantcacaccattaataatggtaagaattggnntatgtgatgcntagtggtctttttggcaccctnatatntgttttccanactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttg

SEQ ID NO: 24320 - DNA, 442 bp, Homo sapiens
  misc_feature 436: n = A,T,C or G
ttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtgggggngggacg

SEQ ID NO: 24321 - DNA, 471 bp, Homo sapiens
  misc_feature 7, 27, 36: n = A,T,C or G
cgtttgntgatagtaaggggggggttnaaaagagangttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatgtaagaaagaacccacactctatgatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcag

SEQ ID NO: 24322 - DNA, 180 bp, Homo sapiens
  misc_feature 49, 51, 169, 175: n = A,T,C or G
tgctgagggggcaggcggagcttgaggaaaccgcagataagtttttttntntttgaaagatagagattaatccacctccttaaaaaatatagtcaataggttactaagatattgcttagcgttaagtttttaacgtaattttaatagcttaagattttaagagaaaatntgaagncttag

SEQ ID NO: 24323 - DNA, 275 bp, Homo sapiens
  misc_feature 2, 15, 31, 40, 44, 46, 51: n = A,T,C or G
gnagggcatttcggngattatggcgggggtngttggcttncgangngtgcncccaatgctgtggtgaacttcttatccagaaaatcaaaactgtgatgacccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaagcttaagaat

SEQ ID NO: 24324 - DNA, 428 bp, Homo sapiens
  misc_feature 8, 11, 28, 33, 50, 53, 54, 57, 60, 69: n = A,T,C or G
aaatctanaangggtagtttggggattnatggnggggggtgttgttttgngcnnggntgncgtatttgnggtgcgttctgagccgtctgtcctgcgccaagaatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagcctgcctgtaaatttcagcaagccgtgttagatggggagcgtggaacgtcactgtacacttgtataagtaccgtttacttcatggcatgaataaatggatctgtgagattt

SEQ ID NO: 24325 - DNA, 488 bp, Homo sapiens
  misc_feature 373, 406, 478: n = A,T,C or G
acacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgcaatggtttatggatacaatgctgcctataatcgctactttcaggaagcgccgagggaccaaatgagactgagggaagaaaaaaaatctntttttttctggaggctggcaccttgattttgtntccccctgtagcagcattactgaaatacatgggcttatatacaatgcttctttcctgtatattcttttgggnggggctgcac

SEQ ID NO: 24326 - DNA, 463 bp, Homo sapiens
  misc_feature 3, 15, 17, 41, 118, 229, 230: n = A,T,C or G
tgnttttaagcaatnancaagaattttctttaaaataaatnattgtgtccctgtgtgttgaagatggctttggtcagtctgtatttatgtttttcttcaattcttctagaatgcaganccaagccagatgcagattccaaaagaaacggtaagagctttgtcttttgaaggatgcagagatgttggaaagatacatggaactaacttcttactaatttaatacgaagtnncttgtcctgccttttcctggctcgtaatatttaatacatgggtttattaaatgccaaagtggtcttattttaaggtgacttactgttaccaccccaaatggagtatattttgtgattaattttggtcagatagacgcaaaaaagagagagacttcctattcacttgcaaagtgaggaccaaagcttagttgtttggcatatatgcaaagtatttcatggagttgtgaaatgct

SEQ ID NO: 24327 - DNA, 345 bp, Homo sapiens
  misc_feature 5, 20, 48, 343, 344, 345: n = A,T,C or G
tcggnccttatggaccgggnatccaaacacttctgctttcacttaagngtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacnnn

SEQ ID NO: 24328 - DNA, 346 bp, Homo sapiens
  misc_feature 28: n = A,T,C or G
gcctttccggcggtgacgacctacgccncacgagaaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttaga

SEQ ID NO: 24329 - DNA, 498 bp, Homo sapiens
  misc_feature 12, 29, 31, 36, 37, 42, 51, 61, 62, 63, 64, 66, 68: n = A,T,C or G
aaaaatagaaanggtcgtttggggtgcgncnagaanncatgnctgattttncggggcgcgnnnncnanaaaataccatgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactgtatgtagtaatgaaatttcagggacccagaacataatgtagtatatgtttttaggtgggagatgctgataacaaaattaataggaagtctgtaggcattaggatactgacatgtacatggaaaattctagggacaggagcatcattttttccttacctgatgccacgaaccagtgacaacgtgaatgctgtattttaagtggttgtatgtttattttcttgagtaacaaatgcatga

SEQ ID NO: 24330 - DNA, 446 bp, Homo sapiens
  misc_feature 4, 14, 383: n = A,T,C or G
tgtntgctctctancttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttaccgtaggngctgacaggacccactctttcattgaaaggtgatgaaaatcaaataaagaatctcttcacatg

SEQ ID NO: 24331 - DNA, 500 bp, Homo sapiens
  misc_feature 11, 18: n = A,T,C or G
tgccaactganaaaaagnactcctggctttgaatggaaacttacagcagagagtcacaggccacggcaacaacaacgacaacaacaaacatttggaatattattctcaactcacgttttaataatacatcttattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaaagcatttaacttcctttctagaaaaatgcacaggctaaggcatagacaaaacaaagagaaatgctgagaaatttgccactggagacaagcaatctgaataaatatttgccaaaagttctttttatgtcatatagtgtcaggatttgaaggagctat

SEQ ID NO: 24332 - DNA, 498 bp, Homo sapiens
gcggcccctctatggaccgggatacttcaggtatagctggttagctagcaaaagaattaacatttgtgatatttacttgcaaactttactgaagccatattcattatcttccttgtcaccaaggctgttgaccttaaataaacattaagttgattttgcacaacactgtatttgtgtgtgtgcatgtgcctgtttttgtgtgtgtatgtttgtgggaaataattatgtttgtttccgcatatattcatttttaatgcattctgtaacttttctcgagtggtggtcattgagggtagggaagattttatttttttaagttgtcgttaaggtatttcattagtgttcctgagtgtaaaacagttttttcccaaatacttatggcagataagagcatttttgtaaataataaactagcaccgtttgggtaaatttgcattattttttggacaggttcattgtcatgtaaaacaaatatctcaaaattcattttacatttag

SEQ ID NO: 24333 - DNA, 495 bp, Homo sapiens
  misc_feature 2, 4, 43, 50, 52, 54, 59, 83, 115, 162, 165, 210, 251, 307,319, 331, 393, 415, 448, 451, 454, 484, 490: n = A,T,C or G
tngnagggcaatttcggcgattatggaccggggtggcttatgntgcagcncngngcggngcttatgctgagggggcaggcggngcttgaggaaaccgcagataagtttttttctntttgaaagatagagattaatacaactacttaaaaaatatagtcaatnggntactaagatattgcttagcgttaagtttttaacgtaattttaatngcttaagattttaagagaaaatttgaagacttagaagagtngcatgaggaaggaaaagataaaaggtttctaaaacatgacggaggttgagatgaancttcttcatggngtaaaaaatgtntttaaaagaaaattgagagaaaggcctacagagccccgaattaataccaatagaagggcaangcttttagattaaaatgaaggngacttaaacagcttaaagtttagtttaaaagtngtnggngattaaaataatttgaaggcgatctttttnaaaaanagatt

SEQ ID NO: 24334 - DNA, 469 bp, Homo sapiens
  misc_feature 109, 173, 403, 420, 447: n = A,T,C or G
gaaaagggagctaaattgcagctctaactaagggtttctgctactgacatcacaacacagaaatgcaagtgtggtacttccagtgaaagcacatggcacctttctaggngtgtagccactgagaagggacagtgaaactgttatttttgatatcagaatgtcatttttatgtncatatccctaaaattagggttatttctacatacactagttacacttgtgaattttttttaaggtctcttttaatttccagacagttaaaaacaatctagttatcttaaagcattaagaaagttactatctggagagggcagagatttcagtccatacacctttctccacaaagcagagcaggaagtaactgactattgtgcctaaaactgtttcatttttaaaaacaagngccattaaaatggaatntctaatgataagcatatgaaataatgngtaattagctcaatttaactat

SEQ ID NO: 24335 - DNA, 301 bp, Homo sapiens
  misc_feature 8: n = A,T,C or G
gtgaaaanttaatttgtggaccaatgttttgtgaaagctaaagagggcaggggttaaaatagggcttgaatttctcattctgtatagaccagcaaacttccctgtgcaaggcaagtttacatcacaaatccaagaatgtttgcatcctaaatgctagtttgcttcagcccctagttaacctcaggacttggtttgcatataaaaggtagacagctgatatgttttcatgaataaatattgtcagccagaaaaggttggtgtcaggtaatgcatatttttttaagctttgttttatatttat

SEQ ID NO: 24336 - DNA, 288 bp, Homo sapiens
  misc_feature 35: n = A,T,C or G
gctttccaacttggacgctgcagaatggctcccgnaaagaagggtggcgagaagaaaaagggccgttctgccatcaacgaaggggtaacccgagaatacaccatcaacattcacaagcgcatccatggagtgggcttcaagaagcgtgcaccttcgggcactcaaagagattcggaaatttgccatgaaggagatgggaactccagatgtgcgcattgacaccaggctcaacaaagctgtcttgggccaaagggataagggaatgtgccatacccgaatccgtgtgcg

SEQ ID NO: 24337 - DNA, 282 bp, Homo sapiens
  misc_feature 1, 2, 108, 142, 154, 176, 220, 242, 257: n = A,T,C or G
nngtaaattatctctggaatttttgctaaaattcagagatacgggaagttcacaatctaccttattgtagacatgaaatgcgaacacttacttacatattaatgttanctcaaccttagggacctggaatggttgcattaangctataatcgtnggatcgccacatttcccaaaantaataaaaaaatcactaaccttttttaaggaaaatatttaaagntttacaaaattcaatattgcanttatcaatgtaaagnacatttgaatgcttattaaaacttt

SEQ ID NO: 24338 - DNA, 186 bp, Homo sapiens
  misc_feature 12, 17, 97, 135: n = A,T,C or G
tctgtacttccnctttnaactggtaaaagtgatgacacccagtagactgtgacaagttattgtaccctataatgtaaatatctaaagcgacccactnaaagaaagctataccaaagggatacacctcaaaaaacnactgtacataaataaaagtaagagtctcaaaaagtgtttaaatccacagga

SEQ ID NO: 24339 - DNA, 100 bp, Homo sapiens
aattgataagtgaggaagaatcctaaatagctgtcttcctaccctaaaagaaagctgattatgttctttcaattttgttatacttttgctcattaatggg

SEQ ID NO: 24340 - DNA, 437 bp, Homo sapiens
  misc_feature 2, 7, 254, 405: n = A,T,C or G
tntggcncgggggcttttccaaaatggcgcgggtgctgaaggctgcagcccgcgaatgccgtagggcttttttccagacttcaagctcccattccaacagtaagagcttcttccacatcacagcccttggatcaagtgacaggttctgtgtggaacctgggtcgactcaaccatgtagccatagcagtgccagatttggaaaaggctgcagcattttataagaatattctgggggcccaggtaagtgaagcggnccctcttcctgaacatggagtatctgttgtttttgtcaacctgggaaataccaagatggaactgcttcatccattgggacgtgacagtccaattgcaggttttctgcagaaaaacaagggctggaggaatgcatcacatctgcatcgaggnggataatattaatgcagctgtgatggattttg

SEQ ID NO: 24341 - DNA, 463 bp, Homo sapiens
  misc_feature 2, 4: n = A,T,C or G
gngnagagagaagagaagagaagagagagagcacatcccaactaaataacacataatgggatagatggccttgatagataaggttcagataagatacttgggagcagagaggagggcctgtctatttcacctagaggcctgggccagcctctcaaaagaagtatcactggagccgtcctggaagggaaggagatatgaagggtgtatagaggaggggccatgtgtgtgaatttataatcattatgagggaggcaactccatgcatttgaaagagcagctaacatccgttaacaacatacagaagatatccctggagccatatttggcggtgatgacacctggccctggtaaaagcacatattggacaaggtgagactagaaatggagtttcgaagggaaagcagagtagagcttgagttagaatttggtacatttaggtcccatggactttttcatgttagac

SEQ ID NO: 24342 - DNA, 489 bp, Homo sapiens
  misc_feature 5, 421: n = A,T,C or G
aatgnttttttctttaccttttgttaaaaaatgtgacaattgtcaaaaaatgcactaaaatgtaaatggagattgaacaagttcactttccagcttataggcaactttatacagacttgaacattttctccagttgtttagtaaaagtgaaagagaaagggtttttcctgccacaggatataacttttttatataacaagcataacacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagnctggatttctgataccttgtcatttggggggatttattttacttttgtgctttaaaatcaatgcagag

SEQ ID NO: 24343 - DNA, 442 bp, Homo sapiens
  misc_feature 46, 51, 152: n = A,T,C or G
gtttgctggcacagtagctacatataatacaatcctattatactgntaggnaaaagatatctgttatttctatttgcaactcatgatatatgaagatggagtcattctttcaggatgtatgtcctagactcagaagctaaattgatacattntcacccagcttatattataaaatacgtatttattgaataggtgactagtaatatttaagcactccaaactaggctatttctatacagtcgaaaatatttttatggtggcaaaaccccttcaattagagtatcttagaaatgctagttgaaggtctaaaatagcattgtcatttaactcaatgatgcatctattaagtggaattacaccttagcttcatataagttttctagataatacttctcaaagttgatggaacagtgtgtcatctcagctcaattactaaagttgt

SEQ ID NO: 24344 - DNA, 262 bp, Homo sapiens
  misc_feature 3, 8: n = A,T,C or G
aanagcgncaatccctcttcttaagaggtccatattcgacgaagggggtttaccgaaccctcgatgttggatcagggacatcctaatggtgcagccgctattaagggttcgtttgttcaacgattaatagtcctacgtgatctgagttcagaccggagtaatccaggtcagtttctatctgtaaagctattttttcctagtacgaaaggatcggaaaaagggggcccatactaaaagcacgccccaccctaaatttatgaat

SEQ ID NO: 24345 - DNA, 329 bp, Homo sapiens
  misc_feature 1, 20, 27, 28, 34, 37, 41, 133, 136, 173: n = A,T,C or G
nggtaaagaaggcgcggganagttgtnnttgttnacnaganccgtttaattaacactttcctccgtttattccctcctctccctcccattgcatggctcacaccctgtaaaaagaaaaaagaatcaaattgantantattcttttaagaattcaaaaactagtgtattcactntacccctagttcattataaaaaaatatctaggcattgtggatataaaactgttgggtattctacaacttcaatggaaattattacaagcagattaatccctctttttgtgacacaagtacaatctaaaagttatattggaaaacatggaaatatta

SEQ ID NO: 24346 - DNA, 231 bp, Homo sapiens
  misc_feature 9, 14, 31, 50, 54, 69, 85, 111, 114, 152: n = A,T,C or G
cgacgggcnaaatntaaaatgacgaggccantcctgaaatttgggtaccnagancctcagtaaaaaganaaaggcagtctgaaantttgggtaaagtttaggtgaaattantantagtgaatcatggccttttaatcctggtaaattaaganattgtatgtgttgttatggaaggcctttcatgttagtttttgaaatttagtttgctgcttaacatttaacttttagtgg

SEQ ID NO: 24347 - DNA, 481 bp, Homo sapiens
  misc_feature 13: n = A,T,C or G
aacatttcttagnattttctaaatatgttgacacatctgaaagttgtattttcattaaagtaacatattgctaaatgtctaagataaaagcatgtgaattatcagaggttttgttacctcctaaacgtccttaaagtgtagatagagataatgtgtattggtcattgccactggccagagtcacaatccacccaagtctaaggaatgctatgtgtgtgtgtgttttcttatctgtaggtattcttatatagcatgcatgagatgggggctgaagcaaagaaaaagaaaagaacacttgttagaatatcagtgaaccatctcatggaataaagccaaaccttctcactcacctctatgtaattgtacatggataggtctgaaatcgcgtgatcatctgggattctcaatcttgagaacacaggaagacacaaacctgtaagttaaataatacatctttccaaaaccttctataaaaatgtgc

SEQ ID NO: 24348 - DNA, 380 bp, Homo sapiens
  misc_feature 3: n = A,T,C or G
atngaccggggcttttcctgtggcagcagccgggctgaaaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaa

SEQ ID NO: 24349 - DNA, 409 bp, Homo sapiens
  misc_feature 4, 5: n = A,T,C or G
aaannaggccggggatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttgggattgtataataacgccaagcccagttgtagtcgtttg

SEQ ID NO: 24350 - DNA, 359 bp, Homo sapiens
  misc_feature 3, 11: n = A,T,C or G
aangaccgggnagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggaagaaggttgcagtgagccaaga

SEQ ID NO: 24351 - DNA, 436 bp, Homo sapiens
  misc_feature 11, 19: n = A,T,C or G
gaggcgaaganctgcgaanggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggaattaagaagaagaaaagggccaagtgatccagttctaaactttgggatatttttcttcaattttgaagag

SEQ ID NO: 24352 - DNA, 490 bp, Homo sapiens
gataagtaattctcaagaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaattttt

SEQ ID NO: 24353 - DNA, 482 bp, Homo sapiens
  misc_feature 105, 108, 111, 300, 344, 478: n = A,T,C or G
gaggcattgaggcagcccagcgcaggggcttctgctgagggggcaggcggagcttgaggaaaccgcagaataagtttttttctctttgaaagatagagattaatncanctncttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtntttaaaagaaaattgagagaaaggactacagagccccgaattantaccaatagaagggcaatgcttttagattaaaatgaaggggacttaaacagcttaaagtttagtttaaaagttgtagggggattaaaataatttggaaggccgatccttttaaaaagagattaaacccgaaggngatt

SEQ ID NO: 24354 - DNA, 490 bp, Homo sapiens
  misc_feature 469: n = A,T,C or G
ctctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtgggattagatggaaaacaagtggattgagggtctgccaatgaaagcgacccatactgaagtccactggctctggttgagacccagaagagtcatgcatcagaataaaggtggacaggaaataccctggcctttgtagggactgagcctgcaccgacgacctcaattgcagcctgtnttggagggacccctgaccatc

SEQ ID NO: 24355 - DNA, 345 bp, Homo sapiens
  misc_feature 2, 13, 342: n = A,T,C or G
anatggaccgggnattgaagaacaatgaggacatttgtaacaccacctccttggagaattgcacagcaaaatgagcgggggtgtttgtgcctgtttctcttatcctttcccgacattaggttaacacagctttataaacctcagtgggttcgttaaaatcatttaattctcagggtgtacctttcagccatagttggacattcattgctgaattctgaaatggtagaattgtctttatttttctctgtgaggtcaattaaatgccttgttctgaaatttattttttacaagagagagttgtgatatagtttggaatataagataaatggtattgggtggggnttg

SEQ ID NO: 24356 - DNA, 391 bp, Homo sapiens
  misc_feature 38: n = A,T,C or G
gaccacgattccatttaagtctgagtggactctcaganattacagttcagccccttcattttaaagatgagaaagctgaggccaagagaagcacagcaatgttgcccaaagacctaattagtctcagagccaggaccataagccaagtccctggctctggttccagtggcttttctactactactctgggccatctgggtcctgctctgctctccatttcaccttgtgtgcaatcagccttagggaagggtacaacgtgtcttttctgggtttgggtccaaggaagcccctaagtcctgtatctctaacaaggcctagcattgtgcacggagcacaagttaaattgtttctcagaaattgtaacagtccgtcaggcgccggtggctcatgc

SEQ ID NO: 24357 - DNA, 469 bp, Homo sapiens
  misc_feature 14, 15: n = A,T,C or G
gaggaaataaaagnngacacaaacaaatggaagaacattccatgctcatggataggaagaatcaatatcatgaaaatgaccatactgcccaaggtaatttatagattcaatgctgtccccatcaagctaccactgactttattcacagaattgggaaaaactcctttaaagttcatacagaaccaaaaaagagccctcatagccaacagaatcctaagcaaaaaggacaaagctggaggcatcacgctacctgacaccaaactatactacaaggctacagtaaccaaaacagcatggtacttggtaccaaaacagagatatagaccaatggaaaagaacagaaccctcagaaataacaccacacgtctacaaccatctgatctttgacaaacctgacaaaaacaaaccatgggggaaaggattccctatttaataaatgatgctgggaaaactggctagccatatgtag

SEQ ID NO: 24358 - DNA, 346 bp, Homo sapiens
  misc_feature 223, 243, 252, 280, 305, 317, 343: n = A,T,C or G
aaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtccctgcagatgacaggaaagtcaagagcnccataaccttagatgggggngtcctggtncatgtgcagaaatgggatggaaaatcancccccctaaagagaaaacgagaggntgataaactggngggggaatgcgtcatgaagggcgtcnctt

SEQ ID NO: 24359 - DNA, 479 bp, Homo sapiens
  misc_feature 475: n = A,T,C or G
ctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggcttgacatctgcaggccgaaagagccgtggccttggaaagggccacaagttccaccacactattggtggctctcgccgggcagcttggagaaggcgcaatactctccagctccaccgttaccgctaatataagtaaaaagnttgg

SEQ ID NO: 24360 - DNA, 361 bp, Homo sapiens
tatttcctcatctttttgttgttgtcattgatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaaccttagcccatctgcgggcagagaaggtctagtttgtccatcagcattatcatgatatcaggactggttacttggttaaggaggggtctaggagatctgtcccttttagagacaccttacttataatgaagtatttgggagggtggttttcaaaattagaaatgtcctgtattccgatga

SEQ ID NO: 24361 - DNA, 473 bp, Homo sapiens
  misc_feature 19, 392, 393: n = A,T,C or G
gatgcacagtattattgtnaaagaagcttattgtcacattcttcttgggaattactgtgttgctgttgctgatgcaaagaagtctctagaactcaatccaaataattccactgctatgctgagaaaaggaatatgtgaataccatgaaagaaactatgctgctgccctagaaacttttacagaaggacaaaaattagatagtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagnngactgctttggttaaacttccttctggagaggattacaatttgaaactggaacttcttcatcctataataccagaacaga

SEQ ID NO: 24362 - DNA, 398 bp, Homo sapiens
cataaatgagggctgcacattgcctgttctgcttcgaagtattcaataccgctcagtattttaaatgaagtgattctaagatttggtttgggatcaataggaaagcatatgcagccaaccaagatgcaaatgttttgaagtgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaatttgtatttgaaaacacttagtatgcagttgataaga

SEQ ID NO: 24363 - DNA, 452 bp, Homo sapiens
  misc_feature 9, 17: n = A,T,C or G
accgggggnaatgaagnaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcaga

SEQ ID NO: 24364 - DNA, 360 bp, Homo sapiens
  misc_feature 24: n = A,T,C or G
gaattcggcccttatggccgaggnaacgtagtactttgataatagaagataacagtgaacagacctaagatgtgtaattaactgcttgctcctggagattattttaccttggtagaatagagaccttcatgagactcactccatccaatgctgtgctcttcagatgcagaaaagagtccaagtctctcctttgggccacaagagggcaccctgcagctagctaaccctccccttcttcagaacagcgttttccaaagagtatgtcattttcagaggactgatttaagggtgagttaaggtgcttaagcttaagtattgccaaaataaatttgttagaccagtgcataaggtaaaattctc

SEQ ID NO: 24365 - DNA, 472 bp, Homo sapiens
tatggccggggcctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagagggaggaagacgaggattaaatttcatttatctggaaaattttgtatgagttcttgaataaaacttgggaa

SEQ ID NO: 24366 - DNA, 411 bp, Homo sapiens
  misc_feature 23: n = A,T,C or G
tctggccggggtgttttaaaatnaaacataacatttaagtgtgaaatatataattgaaactaaaaactatttagattaaacagattagatacagccaaagaaagaattagtagctggaagcatagatcagagaatttacccacagtacagtacagtaagataaagatatgaataagttcatgtggaatagagactagaatgagaaggtatacatcacataaaattaaagttttagaaagtgggaatacagagaatggatgtacaatatcaaaaaatataatagctgtaaaattttccagaactgatgaaagatatgaattcacaaatagaagcaatacaacatatttcaaggatggtaaataaaaaagaaatccacttctaagtacattttagtgaaactgcagaatactg

SEQ ID NO: 24367 - DNA, 288 bp, Homo sapiens
tatggccgggaaagtatgtgaatgaatcaaacactagtaaagcagaaaaaaaagaagaaaataattattttgaacagtctgacaaagactttgaaataagcatgtttagaagctcagaaaggtaaatgaagatatgatttccactgaaaagagtgacaaattatgaagcaaatccaagcagaagtaaaacaaaagactttgaaataagcatgtttagaagctcagaaaggtaaatgaagatatgatttccactgaaaagagtgacaaattatgaagcaaatccaagcg

SEQ ID NO: 24368 - DNA, 129 bp, Homo sapiens
  misc_feature 126: n = A,T,C or G
attgagtttcaacagcatctctgctgttgacaatggctctctggccaacacgcctcatctgagggagcttcacttggacaacaacaagcttaccagagtacctggtgggctggcagagcataagtncat

SEQ ID NO: 24369 - DNA, 445 bp, Homo sapiens
  misc_feature 8, 298: n = A,T,C or G
aacaaagnacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaacttgataaatgctactcataagagctggtttggggctatagcatatgcttttttttttaattattacctgatttaaaaatctctgtaaaaacgtgtagngtttcataaaatctgtaactcgcattttaatgatccgctattataagcttttaatagcatgaaaattgttaggctatataacattgccacttcaactctaaggaatatttttgagatatccctttggaagaccttgcttggaagagc

SEQ ID NO: 24370 - DNA, 473 bp, Homo sapiens
caagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgataccaaagcattctatcagaagatgtatggtatctccctttgccaagccatcctggatgaaaccaaaggagattatgagaaaatcctggtggctctttgtggaggaagctaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataact

SEQ ID NO: 24371 - DNA, 362 bp, Homo sapiens
tccattgatgattataaacataatcatccttcatgattttaaaaactctcagaaaaattgtagtgggagaacttgataaacttgtatctgtaaaacttgagaaagagcatctacaaaaatcctatagctaagattattcttaatggtgaaaaactgaataattttcttcctaagatcaggaacaggacaagaatgtccactcttgccatttttattcaatataataccaaagttctagccagtgcagtaaggcataaaaaagaaataaaagacatacagatcagaaagaaagaaaactgtcccagtttccagataacatgactgtttacatggaagatcccaaggaatctatttaaacttct

SEQ ID NO: 24372 - DNA, 494 bp, Homo sapiens
  misc_feature 2, 25, 38, 39: n = A,T,C or G
cnagagcctaagtccataccagggngcgcttccccgannaacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagt

SEQ ID NO: 24373 - DNA, 319 bp, Homo sapiens
  misc_feature 183, 205, 209, 231, 239, 287: n = A,T,C or G
agaactgagtagctgtactgtgtggcgccttattctaggcacttgttgggcagaatgtcacacctgccgatgaaactcctgcgtaagaagatcgagaagcggaacctcaaattgcggcaggggaacctaaagtttcagggggcctcaaatctgaccctatcggaaactcaaaatggagatgtntctgaagaaacaatgggaagtngaanggttaaaaaatcaaaacaaaancccatgantgtgggcttatcaaaaactcaaaatggaggcatgtctcaagaagcagngggaaatataaaagttacaaagtctccccaga

SEQ ID NO: 24374 - DNA, 484 bp, Homo sapiens
  misc_feature 93, 466: n = A,T,C or G
tatggccgggggcgcagctcttagtcgcgggccgactggtgtttatccgtcactcgccgaggttccttgggtcatggtgccagcctgactganaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacattggaagaacaagtaatcttaactgaaaaagatctgctagaagatggtttttggagagcaccccttttaccactgcctggttgcagaaagtgccgaaagagcactggactccggaaggacacagcattgttgggttttgccatgtactattttacctatgacccgtggattggcaagttattgtatcnttggaggacttcttcgtg

SEQ ID NO: 24375 - DNA, 487 bp, Homo sapiens
  misc_feature 484, 485, 486: n = A,T,C or G
atcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggnnng

SEQ ID NO: 24376 - DNA, 294 bp, Homo sapiens
gtggacgaaaggcaatgaaattgaaagggtgtcaaataggcctttaacaatattggtaactaattttgcaaggagaatataatttaaaaattaattttagaaagaggaaagcatattaaaagttgcaaataaaaagaggcagagcttaaaactaggtagtctagcaaaactaataagccgggcatggtggctcatgcctgtaatcccagcactttgggagcctgatgcgggaggatcacttgaggccaggtgtttgagaccagtctgggcaacatagggaaaccctgtctctac

SEQ ID NO: 24377 - DNA, 489 bp, Homo sapiens
cacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaacctggaagcttaatgtggtttgaggaaagcatcagatttgtccctggaagtgaagagaaatgaacccactatgttttggccttaaaattcttctatgaaatttcaaaagtgtgaactttttattcttccaaagaattgtaatcctccccacactgaagtctaggggttgcgaatccctcctgagggaga

SEQ ID NO: 24378 - DNA, 496 bp, Homo sapiens
  misc_feature 5, 18, 58, 60, 484, 490: n = A,T,C or G
aaacnggaaccctgtacnagaagtgccctggaagaaggcctgctctaaattatccagngnatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaagggaggagtcaactaatgaagaaatgaataataaaatttttgacactgaaaaacattttattaataaagaaantttggncatgag

SEQ ID NO: 24379 - DNA, 491 bp, Homo sapiens
gaggtaggaggtcctgggtgactttggaagtccgtagtgtctcattgcagataatttttagcttagggcctggtggctaggtcggttctctcctttccagtcggagacctctgctgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgtttggagatctc

SEQ ID NO: 24380 - DNA, 307 bp, Homo sapiens
  misc_feature 7, 29: n = A,T,C or G
ccaatcnttggcccgggggatcatcctcnttctatagcatttgcagattcaagggggagaggtagatgctgagatcaaaatgacagttgttacttatttttccaggtgctgttagtataaacattgtttcctcttcacccctgctaactacctctttaaagtatttctaccaaactgtgaacccaatctcagggaaaagaaattaaaaagtaatataaattctgcatatattaaaaacaatattgtaatatgttataatttcaggaccagaattttctggtctttacctacaagggttttcattatc

SEQ ID NO: 24381 - DNA, 224 bp, Homo sapiens
  misc_feature 4, 10, 43, 45, 50, 53, 56, 58, 69, 70, 83, 104: n = A,T,C or G
tggncggganatctatgtttcattgtgtggatggtgggttgcncncactncgnggngngacaccagtannggggtgtaaaatncccggagcgtccgtggttcanagtaaacttgaagcagatctgtgcatgcttttcctctgcaacaattggctcgtttctcttttttgttctcttttgataggatcctgtttcctatgtgtgcaaaataaaaataaatttggg

SEQ ID NO: 24382 - DNA, 288 bp, Homo sapiens
  misc_feature 27: n = A,T,C or G
tatggccggggaaatagaaaccacagngaatcaataaacccaaaagctggctctttaaaaaacttaataaaccttgggtaaatttgatcaagaaaaacaaaagcagaaaaaggcaaaataaggttaagggatgttaaaaagcagttgagaatgtgataaactaggaaaatttagaaaaaatggataattagaaaattgaaataaatttacaatcttgaaagaaattgacttatcagtttaaaatataccagtcaaaaaacaacaaacactaggcccaggttatttcag

SEQ ID NO: 24383 - DNA, 290 bp, Homo sapiens
  misc_feature 16, 31, 39, 198: n = A,T,C or G
cggccctctatggccncgggttatgccaganaccaaggnaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattggtcagcatgggngaccaccagaaagtaatcttaagccatctagatgtcacaattgaaacaaactggggagttggttgctattgtaaaataaaatatactgtttc

SEQ ID NO: 24384 - DNA, 330 bp, Homo sapiens
  misc_feature 2: n = A,T,C or G
gnggccgggaacagctaaggactgcaaaaccccactctgcatcaactgaacgcaaatcagccactttaattaagctaagcccttactagaccaatgggacttaaacccacaaacacttagttaacagctaagcaccctaatcaactggcttcaatctacttctcccgccgccgggaaaaaaggcgggagaagccccggcaggtttgaagctgcttcttcgaatttgcaattcaatatgaaaatcacctcggagctggtaaaaagaggcctaacccctgtctttagatttacagtccaatgcttcactcagccattttacctcactcaaag

SEQ ID NO: 24385 - DNA, 401 bp, Homo sapiens
  misc_feature 14, 19: n = A,T,C or G
agaccgggttaggnaaagnaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcatttggggg

SEQ ID NO: 24386 - DNA, 402 bp, Homo sapiens
  misc_feature 2, 9, 40, 83, 84, 90: n = A,T,C or G
anggaaatntaaattttaaaaaatttctctccaacctccnttcaaattcagtcacccactgttatattacccttctccagganncctccngaggggaaggctgcgatattagatttccttgtatgcaaagtttttgttgaaagctgtgctcagaggaggtgagaggagaggaaggagaaaactgcatcataactttacagaattgaatctagagtcttccccgaaaagcccagaaacttctctgcagtatctggcttgtccatctggtctaaggtggctgcttcttccccagccatgagtcagtttgtgcccatgaataatacaagacctgttatttccatgactgctttactgtatttttaaggtcaatatactgtacatttgataataaaataatattct

SEQ ID NO: 24387 - DNA, 435 bp, Homo sapiens
  misc_feature 3, 5, 71: n = A,T,C or G
atngnggccgggattggaatacagtgtaatgtagtactggagtcagtgcagtagggcaagaaaagaaggcntatggccaaaggaagtaaaactaacattcacaaacaacatggttatgcatgtagaaaatcctaagaaataataaatggagagagatatatcaggttcatgactgttagactctatattgtgaagatatcattctccaaatttacttatagattcaacacaatcccagtcaaaatcacggtaggcatttctgggaagacagtaaattaattcctaaatttatatggaaatgcaaggaatctaaaataaactcttttgcaaaagatctaagttgtagaacatagacttaccaggtttttaaaacttcttatttcaaagtggattacagacctaaatgtaaatgccaaaacaaaaaaacttctaaag

SEQ ID NO: 24388 - DNA, 500 bp, Homo sapiens
  misc_feature 2, 12: n = A,T,C or G
cngcggccatcngtggccgggatatgttgaaacctttatcccctgtgatggtatttgaagatggggcctttgggaggtaatgaggtcataaggacaaagcactcattaataggataacaccattttaaagagataggagaaagataatctttctttttactgtatgagggtacagcaagaagttggccatctatgaactataaagagagccctcaacagtaatggaatctgctggtatcttgatcttgaacttctcagcctctagaactgtgagaaatattttctgttatttaagacactcagtctatagtggtagttacagcagcctgaactgactaaaacaaagctctgacactagtactaaaatatgggacatagagttaaatcatgatctgtttcccagttgcatctgtgtctaacaaagattctagatgattatatcttgaataactaaggtaagatctctctcaacaatcttgagtacattaggaatacttaca

SEQ ID NO: 24389 - DNA, 497 bp, Homo sapiens
  misc_feature 3, 5, 179, 182: n = A,T,C or G
atngnggccgggatattaagctggcgacaagctggatgaaggcttttttttttagacagggtcttgctctgttgcccaggctggagtgcagtggtgtgatcatggctcattgcagctttgacctcctgggctcaagtgattctcccatctcagcctcccaagtagctgagactacaggngtncaccgccatggctggctaatttttaaattttgatcttgtagagacggggtctccctatgtcacaccggctggtcttgaattgctgtgctcaagcaatcctcctgcctcagcctccggaagtgctgggattattgtggtgtgaaccactctgcccaacaagaccctatttttaaagttttcagattagcaaacattctttaagcatccttaatccttcatggacacttgaaaaactagtaactctttttggatgaaagtgagcccgagattgaaccaccacactccagcctgggtgacagagcgcaactccgtctt

SEQ ID NO: 24390 - DNA, 399 bp, Homo sapiens
  misc_feature 2, 5, 180, 190, 222, 275, 326, 340, 357, 375: n = A,T,C or G
anagnggccggggaaaagacagggagacagtactgtcatctgcattataacggactgtgatgggatcacatgagcaaattttcagctctcaaaggcaaaggacactcctttctaattgcatcaccttctcatcagattgaaaaaaaaaaagcactgaaagccaattactgaaaaaaaatngacagctagngttttttaccatccgtcattacccaaagactngggaactaaaatgttccccagggggatatgctgattttcattgggcacatggnctgaatcacatagattctcctccgtcagtaaccgggcgattatacaaattntgtcttccaaagtntggaacactccaatcanaaaaaggttatcattggncgttgagttatggggaagaactta

SEQ ID NO: 24391 - DNA, 485 bp, Homo sapiens
ggacccggggaggcattgaggcagcccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttggaaggcgatcttttaaaaagagattaaaccgaaggtga

SEQ ID NO: 24392 - DNA, 469 bp, Homo sapiens
  misc_feature 11, 84, 315: n = A,T,C or G
tatcaaaaacngctcttaaaaatcaaaggaagcatgaagctaagaaagctgcaaagcaggaagcaagaagtgacaagagtccanatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtntttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaat

SEQ ID NO: 24393 - DNA, 195 bp, Homo sapiens
  misc_feature 82, 90, 110, 161, 171: n = A,T,C or G
ccggggcaccagatggcctctgttgtgtaccatgcaggttctcaatgccatggagtgcaaatgctcccccaggaagtgcacncaagtgangctgctgcagctgcctgggngcctgctgctgcctgccttggcctgatggccaagccattagtgctgccaancctctgcatnttctgctcttgtgcccttctgaac

SEQ ID NO: 24394 - DNA, 500 bp, Homo sapiens
  misc_feature 2, 18, 457, 460, 464: n = A,T,C or G
cnaggggaattccggccnttatggcccggggaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgnggngggnttacaatacagcaagcctgatggtttgtcttatttc

SEQ ID NO: 24395 - DNA, 122 bp, Homo sapiens
  misc_feature 47: n = A,T,C or G
atgcctgggtgtggtggctcatgcctgtagtcccagcactttgagangccaaggcaggcggattgcctgaggtcaggagtttgagaccagcctggtcaacatggtggaacctcatctctact

SEQ ID NO: 24396 - DNA, 368 bp, Homo sapiens
  misc_feature 19: n = A,T,C or G
tatggccgggggaaacagnaatttgaactgtaagcaagcatttctcaggaagtcctggaagatagcatgcgtgggaagtaacagttgctaggcttcaatgcctatcggtagcaatccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaaccctgtggcctgatctgtaaataaaacttacatttttc

SEQ ID NO: 24397 - DNA, 472 bp, Homo sapiens
  misc_feature 8, 9: n = A,T,C or G
gcggccanngtggccgggataagtagaatacatgtaagaatcacctagtcttcactatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaattttgaagacttgggttactaatgattgtatctttgctagtcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatgtaaaaccagtatgaccttgtctagtctccaaacttaaaataaacttttgaaaagctgggattctt

SEQ ID NO: 24398 - DNA, 499 bp, Homo sapiens
  misc_feature 3, 451, 455, 463: n = A,T,C or G
ganaaggatttcaccattactaattgtatttgagagcattgaagttcctacacaatgcagaaagaaatttttttaaaaagttaatgaaaggtgttagttttggaaaggaagaggaaaaaaattgtcattttatagattttgaatatttatttatttattttgactactatttacattttttagtatgttttcttctatttaaattctgtatttctgtttgtgtcaacttgtaattttatagtctaggaacttatgcatatcttctatcttaaaatttactagcatatagctgatccaaaaactggcttataattaaaaaaacttacatatctaattacttcccctttttacttaattttatttgtatcatatgccttttcattctcatcagtattagacattttggtatcttaaaatatttttcaaaggactgtcttctctattttatggngggntgctctgntctactctttcatttggtaaaatctttctagtgaat

SEQ ID NO: 24399 - DNA, 465 bp, Homo sapiens
  misc_feature 4, 6: n = A,T,C or G
atangnggcccggggatgtgaaaagggttgctgctgtcagcccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatcctttttgtatgggaaagactattatttttgtacttaaccagatatatttttaccccagatggggatattctttgtaaaaaatgaaaataaaggttttttta

SEQ ID NO: 24400 - DNA, 474 bp, Homo sapiens
attgctaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattc

SEQ ID NO: 24401 - DNA, 499 bp, Homo sapiens
  misc_feature 4: n = A,T,C or G
attntggaccgggcatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcaccgaaacacactggggaatggagcaaaacagtctttgaatatcgaacacgcaaggctgtaagactacctattgtagatattgcaccctatgacattggtggtcctgatcaagaatttg

SEQ ID NO: 24402 - DNA, 499 bp, Homo sapiens
  misc_feature 7: n = A,T,C or G
gctcacnataatgaaaatttaaattaattcttagatttgtgattctttaagagtatcatggctgatttctctctcttttcaatcttcagttgtactgagttccctgacacatgtgtagaaatgggaaaagtgtttttagaatgtgactttagccattatataaatgggggagaaagtggaaacaacacatttactaacccaatgacgtgggttagtaacaaaaattaaaacaacattatttttaattcagattattttcttaggaggtattatattatgatcatattttataatgagaaactctccaaacttccttaatttttgtttaattgctagtcccaaacccataattttcttgtataatttgattaaatttttatgagtttactaacagtatggtttataatctttgttttccaaaaatacttttgaaaaacactaggcgatgaacattgaaggtcattagccaaaggaaatatttgaggacataactggaagt

SEQ ID NO: 24403 - DNA, 258 bp, Homo sapiens
  misc_feature 110: n = A,T,C or G
cagtgagctgaatggaaaaaaattgaagacgtcattgcccagggtattggcaagcttgccagtgtacctgctggtggggctgtagccgtctctgctgccccaggctctgnagcccctgctgctggttctgcccctgccgcagcggaggagaagaaagatgagaagaaggaggagtctgaagagtcagatgatgacatgggatttggcctttttgattaaattcctgctcccctgcaaataaagcctttttacacatct

SEQ ID NO: 24404 - DNA, 420 bp, Homo sapiens
  misc_feature 5, 7, 259: n = A,T,C or G
cggcntngtggccggggttactgcagaacctgaaccgagattcctgatgttgcacccattgtaagtgatcagaaaccatctgtatcaaagtccggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtnaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcat

SEQ ID NO: 24405 - DNA, 497 bp, Homo sapiens
  misc_feature 454, 471: n = A,T,C or G
gccggggacatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtcttgtgtgctggcccatcactttggcaaagaattcatcccaccagtgcaggctgcctatcanaaagtggtggcttgggnggtggcttaatgacctggcccacaag

SEQ ID NO: 24406 - DNA, 470 bp, Homo sapiens
  misc_feature 25, 26: n = A,T,C or G
agtcttcactggtgatacctccggnnctggaaaatctgaggcaactatggacttgagcagacccacagcaaactacagcatccctatgaaacgggggcaagactattaaaagaaaaacaacccccccaacccaaaagttccatccaaaggtcagcatcctcaaagatcaaaggtacataatcctacaaagatgagaagtaatcagcacaaacactgaaaattcaaacagccagtgttctcttttttccaaatgacaaaaacacctttacagtaagggtttggaacttggctgaggctgagatgactgaaatgacagaagtacacttcagaatgtaaataaaaatgaactttactgagctaaaggcgcacattgtaacctaatgcaaataagctaaaaatcataatgaaacaatgcaaaatttgatagcccaaatagccagaatagagaagaacataactgacctgataga

SEQ ID NO: 24407 - DNA, 399 bp, Homo sapiens
  misc_feature 5, 6: n = A,T,C or G
ccccnngtggaccgggatttctggatgctaagtccttcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacga

SEQ ID NO: 24408 - DNA, 319 bp, Homo sapiens
  misc_feature 2, 13: n = A,T,C or G
gnggcccgggaancttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgaca

SEQ ID NO: 24409 - DNA, 500 bp, Homo sapiens
  misc_feature 2, 21, 469, 475, 477: n = A,T,C or G
gnggaccgggaagcagaagangtgttttatataccttcttgcatgagtggatcaagaaactttaagatggctaaactagaggatacaagaaatgtaggcatgccagtagcccacatggagtctcctgagagatatcttcacttgaagcctaccattgaaatgaaagattctgttccaaataaagcaggaggaatgaaggatgtacaaacatccaaagcagctgaacatgacttagaagtagcatcagaagaagagcaagaaagggaagggagtgaaaataaccagccacaggttgaagaagaaaggaaaaaacacagaaataatgaaatggaagtatcagcaaacatacatgatggtgctactgatgatgctgaagatgatgatgatgaatgatgggattaattcaaaaaagaaagagtgggagaaactgatcatcagcaatttcccaggaaggaaaataaagagtatnctagtnangggggccctgcctttgcaaatga

SEQ ID NO: 24410 - DNA, 115 bp, Homo sapiens
ccggggcaaaggatagactggaagagaatatttgcaatatttaaaacaggctaatggtcagtgctcacaatatataacatgctctcatgtatcaattttaaaacaacacccttgt

SEQ ID NO: 24411 - DNA, 323 bp, Homo sapiens
  misc_feature 2, 7, 27, 44, 48, 51: n = A,T,C or G
cncggcnattgtggcggggggaaaaanctgattgattgattttnttanttnaagtttagattatgttgagcaggtgtccctttgagaaacaacgttgttgattctctagctgtgtgtaaatttgagtaatattaaccctacacttaaaattctgcttctttgaatggatctccattatgataccttgaaaaattaccaacatccacttagtttttgcaaatgatgcaacacatccattgtgccacattttacatatagtctgtggtttcttgttctgagtttgaaaattagcacgtttttaaaaatccactgtcattatatga

SEQ ID NO: 24412 - DNA, 213 bp, Homo sapiens
  misc_feature 3, 25, 40, 43, 45, 179: n = A,T,C or G
tanaaaccccgggtaatttcggccnttatggaccggggcntcncntttcccacctgtgctatctatctggctggcagggaaggaaagaaacttgcatgttggtgaaggaagaagtggggtggaagaagtggggtgggaccgacagtgaaatctagagtaaaatcaagctggcccaaggngtcctgcaggctgtaatgcagtttaatcagagtg

SEQ ID NO: 24413 - DNA, 330 bp, Homo sapiens
tatggccggggaagagtgattaaaatatttatgctttgaaaagtactttctttcagtttctcaatatagcactctgcagaataatccattgattcaggccattgagtgtgtgttctatcattaccaatattttagagcatgcattattcatttttatgggcattagagaagagctaaactgcagctggatacctcagcacacaagtagccccataatcatttcattgaaatcctcatttttgagcgggataagaaaggggacacaagtaacttggatattttaggtatgggaatctcatttaaagcatgtgtggctaactactccactgc

SEQ ID NO: 24414 - DNA, 208 bp, Homo sapiens
  misc_feature 1, 11, 24, 105, 124, 129, 147, 157, 167, 187, 201: n = A,T,C or G
nattgcggccnttatggccggagnaggcattgaggcagccagcgcaggggcttctgctgagggggcaggcggagcttgaggaaaccgcagataagtttttttctntttgaaagatagagattantccanctccttaaaaaatatagncaataggttnctaagatatngcttagcgttaagtttttancgtaattttaatancttaaga

SEQ ID NO: 24415 - DNA, 357 bp, Homo sapiens
  misc_feature 23, 129: n = A,T,C or G
tacacacatgttgattaaccggngcaagacacaatcctattaattcagctttttaggataaagggtagacaaaagaaagctcacatcaataggtgagtaacaactactttgtaaaagccactctagggncagaatacatccagtttagtggtccatattgtagaatttccctgtgctgttagggaagagggctggcaattgaggcacagtgatggccttaaggacaaggaaggtaaagcttaggagaagagagtctataaaacctctgacatggcatgcagacatttttcttttgagtacattttactggggagaggatccatgtcttttatattctccaaatgactcaatattcca

SEQ ID NO: 24416 - DNA, 471 bp, Homo sapiens
  misc_feature 344: n = A,T,C or G
gttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggnggagtgtgtcatgaacaatgtcacctgtactcggatctatgaaaaagtagaataaaaattccatcatcactttggacaggagttaattaagagaatgaccaagctcagttcaatgagcaaatctcca

SEQ ID NO: 24417 - DNA, 415 bp, Homo sapiens
  misc_feature 99, 144, 153: n = A,T,C or G
gaacagagaccagaaagagtaaaaccttttatgacaggggctgcagaacaaatcaagcacatccttgctaatttcaaaaactaccagttctttattggngaaaacatgaatccagatggcatggttgctctattggactaccgngaggatggngtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtagggttgtctaaaaataaaatgcatttaaact

SEQ ID NO: 24418 - DNA, 152 bp, Homo sapiens
  misc_feature 150: n = A,T,C or G
atcactcaaactgacaaaatgaattcagtagaccatgataagttacataaatataataactagaacaaccactaagaaagctatacaaggagatacatttaaaacattatagataaaatggaatcctgaaatatgttcatgtaacaggcngg

SEQ ID NO: 24419 - DNA, 347 bp, Homo sapiens
gtggaaaagtagctagcacaatacctaatctgtaattattattcagtaaatatttgacttcaaatgtgaatttgcaaaggccacctcagtaagattatttcaaagcatcagcatttatagaatacctactatgtgccagacactgttttaaatactctgggtaagtcatagttcatcaccttaggggcctctgagtataactgaaccaaatatgtaaatatactaataacagaagtgtagttggctgcagtggctcacacctgcaatcccaccactttgggaggctgaggcaggaggctggctcgcttgagcctggcctaagcaacataatgagaccccatctctac

SEQ ID NO: 24420 - DNA, 223 bp, Homo sapiens
  misc_feature 20, 26, 47, 71, 127, 216, 222: n = A,T,C or G
agagccgaaagccttttgcnaagaantgttttcatttaatcaagaancgaaaagtcggaggttcgaaagancgatcagatacccgtcgtagttcccgacccataaaccgatgcccgacccggcgatncggcggcgttattccccatgaccccgccgggcagctttccggggaaaccaaagtcttttgggttccgggggggagtattggttgcaaanctgaanc

SEQ ID NO: 24421 - DNA, 117 bp, Homo sapiens
ctgggcgcggtctctcaagcctgtaatcccagcactttgggaggccgaggtgggtggatcacttgaggtcaggagtttgagaccaggctggccaacatggtaaaccctgtttctaca

SEQ ID NO: 24422 - DNA, 497 bp, Homo sapiens
  misc_feature 2, 9, 52: n = A,T,C or G
cntcagtantgaagctttgtgcctgtgctattcccgcaggaacccgcgaganggtctagagtcagcttacattccctgagcaggaaagtttacccactgaagaattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaattttttttgtctttaaatagatacaaatgtctatcaactttaatcaagttgtaacttatatttgaagacaatttgatacataataaaaaattatgacaatgac

SEQ ID NO: 24423 - DNA, 481 bp, Homo sapiens
  misc_feature 448: n = A,T,C or G
gaggcgcgggtggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacacggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaanggaggtggtcttaaataaattaaacaaaaatag

SEQ ID NO: 24424 - DNA, 471 bp, Homo sapiens
gatatttagtgtaattacatctcagctttgagggctcctgtggcaaattcccggattaaaaggttccctggttgtgaaaatacatgagataaatcatgaaggccactatcatcctccttctgcttgacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttac

SEQ ID NO: 24425 - DNA, 264 bp, Homo sapiens
  misc_feature 39, 46, 56, 58, 94, 116, 203: n = A,T,C or G
gatggaccatctcccaacaactacaggctactccaaacntaacagntgctgcacgncnagtccagctaatgaggaaattctcttttgtgttttnggagcatggttctttgggaagnggcatccactgcaggaaagcagaatgagcagagccagcagaactgatggagtggcacaaattcccagtgtctggatggtgccacacntggcgcctaatcacccgtttaacaagcagaaattaaatgttgctcagcaacatgtgtcttt

SEQ ID NO: 24426 - DNA, 327 bp, Homo sapiens
  misc_feature 9: n = A,T,C or G
ataataacnaaacataacattatacacaaagaatactttcattatttgtggaatttagtgcatttcaaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgcagaatttttacaccg

SEQ ID NO: 24427 - DNA, 487 bp, Homo sapiens
  misc_feature 2: n = A,T,C or G
anctgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttctttggtttccacttgcaatggttaattaagtccaaaaacagctgtcagaacctcgagagcagaacatgagaaactcagagctctggaccgaaagcagaaagtttgccgggaaaaaaaaagacaacattattaccat

SEQ ID NO: 24428 - DNA, 355 bp, Homo sapiens
  misc_feature 1, 279: n = A,T,C or G
natttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattngtttttgtgactgaaggatttattcagactgctgtactcttcatttgatgtaacaaaatgctattaatctaaatat

SEQ ID NO: 24429 - DNA, 363 bp, Homo sapiens
  misc_feature 11, 25, 29, 34, 39, 46, 50, 59, 60, 63, 64, 67, 68, 70, 72,77, 78, 84, 85, 97, 98, 99, 101, 161, 167, 201, 225, 254,340: n = A,T,C or G
tagcagtggcnacttaggcgcaaangcangggcntcccnattggancggncaaagtaannctnncgnntncntagannacatgnncttgtatctagnnnancttaatgacttcactaaaaattactaggactaataaatgtgctcatcaaggggatgaacntaaganccatatacaaaaatcaattgtatttctatacttncacaacgaaccatccaaaaatacnacattctttaaaaaataattccatttacnatagctttgaaaagaataaaacacctaggaacaaatttcacaaaagaaatttacaatatacacttctgaaactataaaacattgtnagaacaaaagttaaagaagatgt

SEQ ID NO: 24430 - DNA, 477 bp, Homo sapiens
ctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacccgcaaaacaacaaaataaccgaaatcaaagatggagactttaagaacctgaagaaccttcacgcattgattcttgtcaacaataaaattagcaaagttagtcctggagcatttacac

SEQ ID NO: 24431 - DNA, 249 bp, Homo sapiens
gaattatattccagtaattctgggtatttctttaaggtgctttgtatttcttgaagtgccattttgatactttcagtgttctgaactgtacctagaacgtactttttataaaaaggaagcagagtccatccaggcagagagagtactgtgtgcctgtagtcttgtctattcgcaaggctgaggccagaggatcccttgagcccaggagttcaagtccaggctgggcaacacactgggaccatgtttctt

SEQ ID NO: 24432 - DNA, 183 bp, Homo sapiens
aatttaggtaattattaataggaaaaagcatcaaactcggagttactagatgtaaggccttactctagcctctagctctgcttccacatgccccaggttttcttgactgtaagatgcagtaggcctatggtagtttcctgttgtaatgagaatattctgttgccattatatttaaatctgttt

SEQ ID NO: 24433 - DNA, 398 bp, Homo sapiens
gttatacagtaggtgaattatgggatcgtgcattcatggatatttctgcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaaattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaac

SEQ ID NO: 24434 - DNA, 400 bp, Homo sapiens
  misc_feature 2, 18, 102, 310: n = A,T,C or G
antttgcgcccactgaangaaagtgctttccagaaataatatgaagtatctaaaagtgtcaccttttcttgcctgatcaacaatttgggcttcctgtttgtncaaggggccatttggcttacctttcacagcttttatcaggccaagttaaaggctggctacattttttcatcacgaggaaagcagttgaaatgaggcatgagttactgtgcattgggattttagaacaattttcttgtgacagctctttttgtgaagttaggttcttaaaagtgcccatgatggtcacttaaaatgtgcagtaatagcnctgccaggatcaaagcatgaaaggcttttaaattagatcatcccacagacaatacgtttgataatagttttttctttttaaccctcttta

SEQ ID NO: 24435 - DNA, 244 bp, Homo sapiens
  misc_feature 1, 163, 168, 207, 210, 218: n = A,T,C or G
nctgccggaagtgactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcnctttncccggagaccaagaaggcgccccgatgcggggtttccgnggncgggtctnctgttgacttatcccgtagcttagta

SEQ ID NO: 24436 - DNA, 465 bp, Homo sapiens
  misc_feature 396, 400: n = A,T,C or G
aggtattaagtcctggaactctttaacatttaattgattacattggtttttttcttttgtttctaaacctgctaatttgttttatgggaatgggagcaggggagtctaggaatgggtttgctctttgattagagcattcaaggaagtattaaagtgaaggaatgtttgcctaaggcctagataattaatgggaagaaactgagtttgaattttttttaatgtgaggtgtactaaagtagtttccaatagatgattttccagtttcaatagcaaaatactgaatgcttttcagaaggcagtgcgaactttttgttgttgttgacacagagtttcacctcttgtcgcccaggctggagtgcaatggcattgatctcagctcactgcaacctccgcctnccanggttcaagtgattctcctgcctcagcctcccaagtagcttgcgggtacagacacctgccaccaca

SEQ ID NO: 24437 - DNA, 389 bp, Homo sapiens
  misc_feature 1: n = A,T,C or G
nctgatgttgtcaccctggatcacgtaacacattcagtttttcagcatttgcttgaatttctttacacatcagaattttttgtgtacaaatatgaaatacctcttgttttagaggctgcaaaatttttggacattatagatgcagtgaagttgttaaataacgaaaatgttgccccttttcattcagagctaactgaaaagtcatcaccagaagaaacactaaatgaattaactggaagactatcaaataatcatcagtgcaaattctgtagtagacatttttgttataaaaagtctttagagaatcatttggctaaaacccataggtcccttttattagggaaaaaacatgggttaaaaatgctggagagaagtttctccgcaagaag

SEQ ID NO: 24438 - DNA, 335 bp, Homo sapiens
  misc_feature 17, 18, 82, 281: n = A,T,C or G
gagctgcgaaggcgagnnctgcgagggccaggtgtcgggcgctgtttctcgttttcatcatatagacaaaacagccctgctnaaagatggtcaacgtacctaaaacccgaagaaccttctgtaagaaagtgtggcaagcatcagcctcacaaagtgacacagtataagaagggcaaggattctttgtatgcccagggaaggaggcgctatgatcggaagcagagtggctttggtgggcagacaaagccaattttcccggaagaaggctaagaccacaaagnaagattgtgctaaggctggaatgtgttgagcctaactgcagatccaagaggatg

SEQ ID NO: 24439 - DNA, 354 bp, Homo sapiens
  misc_feature 1, 9: n = A,T,C or G
nccataggnagaatgtaaagcttgtctgatcgttcaaagcatgaaatggatacttatatggaaattccgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttt

SEQ ID NO: 24440 - DNA, 252 bp, Homo sapiens
  misc_feature 113, 150: n = A,T,C or G
cttcctcaaccaaataagtattttattagtgcttgagagaatctgaatgtaggatgggttcaactgcacaaaaggaaaagatttttaccactttttttatatagatataaagngaagcaaccgccttagtgctgaaatatgtagtacatngaatatgccttgtttaattacagaaaattccaaaacttgtactatttttttttccatgtagaaaggcaggaatgtctcctaagctttcctggacagcagatg

SEQ ID NO: 24441 - DNA, 381 bp, Homo sapiens
gaaataatgaaattatatacaaataataaaaagggataacatagagattaatattttaaaatagatttttaaaattaacctgccacaaactttcaaaattatcagctgggtgtggtggctcacgcctgtaatcccagcactttgggaggctgaggtgggcagatcacttgaggtcagaagttcgagaccagcctgaccaacatggagaaaccctgtctctattaaaaatacaaaattagcaaggcatgatgacgcatgcctgtaatcccagctacttgggaggctgaggcaggagaatcgtttgaacctgggaggcaaaagttgcggtgagcttagattgtgccactgcccttccagcctgggtgacagagtgagactctg

SEQ ID NO: 24442 - DNA, 496 bp, Homo sapiens
  misc_feature 1: n = A,T,C or G
ntggcccgggggcctgtagtggcttcgtcttcggtttttcttttccttcgctaacgccctcccggctctcgtcagcctcccgccggccgtctccttaacaccgaacaccatgccttcaattaagttgcagagttctgatggagagatattttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggg

SEQ ID NO: 24443 - DNA, 396 bp, Homo sapiens
tagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaaagagaagatctacgtgctccttcgtcggcaggcccaacaggctgggaaataattgtgtttggaagcactg

SEQ ID NO: 24444 - DNA, 293 bp, Homo sapiens
  misc_feature 122, 128, 163, 185, 199: n = A,T,C or G
gattttgaccttgaacatgacccaggttgcttggctgattatgttgaaatatatgacacgttacgatgatgtccatggctttgtgggaagatactgtggagatgagcttccagatgacatcntcagcncaggaaatgtcatgaccttgaagtttctaagtgangcttcagctgacagctggaggnttccaaatcaaatntgttgcaatggatcctgtatccaaatccagtcaaggaaaaaatacaagtactacttctactggaaataaaaactttttagctggaagatttagc

SEQ ID NO: 24445 - DNA, 355 bp, Homo sapiens
agagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctt

SEQ ID NO: 24446 - DNA, 173 bp, Homo sapiens
  misc_feature 85, 110, 112, 135, 163: n = A,T,C or G
tgcgttaaagtgtatcctgcatgtgttctatggaacaatatgtggactgttagtattgtatgagaaaagagttccgtggtctggnagtttttggggaatacaggttgatntnccctatcagaaaatgagaatgtnccaagcctgttttggggctgcctgagcncaaggaaggc

SEQ ID NO: 24447 - DNA, 445 bp, Homo sapiens
gaatatggataagtaccaatcacatgaaagatttttataagaacttgcatataaggcagctccatttttatgaggaaaaattgggaggagaaaacccttatcttgtatttgggtatatatggtgcatttctgtgcatgcatgtatgtttgttgtaggtatatttttagcacaagtggtaacatactatatatctccttttttattgtgtttctgtgttttagagatggttctatgcttgtacctcatactttttaaacagatgcagtgctttgttatttgaatagtaccataatttattgaactaggccctaaatggacatagacatttaatttgtttttgatgttttgctattataaacaaggcttctgtgaagatccttacaaataaaccattttatacaaagttatcattagaatagattcctaaaagtggaattgttatgt

SEQ ID NO: 24448 - DNA, 472 bp, Homo sapiens
  misc_feature 1, 2: n = A,T,C or G
nnctcccattgcatctcccagtcttagtacttctgagcattcttaatcttactattcttttcttaatgtattcaaaccaaaagacagcaatttttagagcctgaataggttttggagggaaaagtaattacgttcaacttcgattgaaactcttgcctcaagaatgaagaacagcaaaaattaaatcacagtttcttagctttttggttaaagatgtaagttaaattcttggccgggtgcggtggctgacgcctgtaatcccagcactttggggaggccagggcgggtggatcacctgagatcaggagtttaggaccaacctggccaacatggtgaaaccccatctctactgggtgtggtggtgtgtgcctgtggtcccagctgtttgggaagctgagtcaggagaatcacttgaacccgggaggtggaggttgcagtgagccggggattgtaccactgcattccagcctgg

SEQ ID NO: 24449 - DNA, 475 bp, Homo sapiens
  misc_feature 456: n = A,T,C or G
gaaggcaggattgtagtttatgcgctggtacacacgcccacatttatatacattatagccatatctatatccaggtaaattagaaaaatgtttaattttattttcatattactttataaggagatatacaaatattttagggatcatggaatctattccagaggaaactaaccaacagtgagcatcttcaactaaaactacccctggatgtaataagtgtaagtattaaaattaaacattatatgtggtcatgaagagaaaattgtttcagggtctgtccaaactacacttcatagaaatttcataattatttttcattttagcatgtgaatgattgataaattggactaggtactgggttaaaaggacttttccaccatctaagagaaaggaagttcagagccttagcttcaacaccacaatttcttaactggaaaaggatcaatctaaaacggnggacttaaattttcaaact

SEQ ID NO: 24450 - DNA, 461 bp, Homo sapiens
  misc_feature 60, 72, 78, 107, 132, 196, 257, 285, 295, 308, 411: n = A,T,C or G
aacaagtatccgacccatcaaggcttctgtcatcactcaggtgttccatgtacccctggnggagagaaaatncaaggntatgaaccaccttggagaaggtgaacaancaaaaatctgccttgagatcatgcngagaactggtgctcacttggagctgtctttggccaaagaccaaggcctctccatcatggtgtcntggaaagctggatgctggcatgaaagctcggaaggacattgttgctagactgcagactcangcctcagcaactgttgccattcccaaanaacaccatcnctttgtttttggnttaaatggagagaaactgcaagacttggagctaaaaactgcaaccaaaatccagatccctcgcccggatgaccccagcaatcagatcaagatcactggcaccnaagagggcatcgagaaagctcgccatgaagtcttactcatctctgccgag

SEQ ID NO: 24451 - DNA, 127 bp, Homo sapiens
  misc_feature 90: n = A,T,C or G
gaagtcccagctactcaggaggctgaagtgggaagaatggcttgagcccaggagttgaaggatgctatgagctctgattgtgccactgcncccctgcatgggcaatagagtgagaccctgtctctgt

SEQ ID NO: 24452 - DNA, 445 bp, Homo sapiens
  misc_feature 31: n = A,T,C or G
gatgttattgtgtattgaatgagttcttttngctctctccaggttgtttaaatataagtacaaatgacttcagtcaagaaggtaaagtcattattagtatatagaaaaatgaatctaaaaatatgtagtcgtgccccaaaacaacaggattaaagatctccgtggactagaagtgcagcatggatccacagtttaagctgtagtcccaaggagaattaagggctaaaaaaatacacaatgggggctgagatttcagcatgtgcagaggaatagggaatgaatgcatttcacatgtagtacatcagtagatctagtctacttgaataaagcaaggaaccggcatcttattgccctacctgtgaaccaaaatggataaaaaaatatttgatcaactatctagggttatggttagaaattagcaaattgtcatatccaggttgtatgt

SEQ ID NO: 24453 - DNA, 129 bp, Homo sapiens
  misc_feature 7: n = A,T,C or G
cggcgcntagcagccgacttagaactggtgcggaccaggggaatccgactgtttaattaaaacaaagcatcgcgaaggcccgcggcgggtgttgacgcgatgtgatttctgcccagtgctctgaatgtc

SEQ ID NO: 24454 - DNA, 471 bp, Homo sapiens
atacattgggaattacttggcaaagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgctgcccctgcaacgtagcctttgttacatgaagtccgctgggaaatagatgttctgtctctatgacaatatattttaactgactttctagatgcctt

SEQ ID NO: 24455 - DNA, 472 bp, Homo sapiens
  misc_feature 108: n = A,T,C or G
gatctgctttaaggaattaacgaaagcagtgtcaagcacagtaaggattcaaaccatttgccaaaaatgagtctaagtgcatttactctcttcctggcattgattggnggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttt

SEQ ID NO: 24456 - DNA, 468 bp, Homo sapiens
cattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatat

SEQ ID NO: 24457 - DNA, 425 bp, Homo sapiens
  misc_feature 417: n = A,T,C or G
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaaggtgacttaaacagcttaaagtttagttaaaagttggnaggtgatt

SEQ ID NO: 24458 - DNA, 334 bp, Homo sapiens
atttgaaataatcctaattggcccatatagtcaacttaactttgacaaagatataatggtaattcaatggagaaagcatagccttttcaacaaatagtgctgggataattggatgtccatatgccagaaaataaaaataaaagaacatatttttgtatgttcttcacaccttatacgtcacatacttcacaccttaaataataattaaaatacttcacaaacttaaatgtaaaatatgaacctatcaaacttctagcagaaaataagggaaaatgtacccagtcttgggtttggcaatgaagttttagatatgacaccaaaagcatgatccatg

SEQ ID NO: 24459 - DNA, 475 bp, Homo sapiens
agaagatgaaaatgaaaataaaatagagtttaggaagaaaggaggatttgaagggggaggattccttggaagaaagaaagttccctatctggcatcatcaccaagtacttccgatggaggaactgactcacctggtactgcgtccccatctcctacaaagactactccatctcctcggcataaaaaaagtgattcttcaggtcaggagtacagcttgtgaaaactcaccaaaatgaatagttgtttcgttacatttagatgaaagttaaactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccga

SEQ ID NO: 24460 - DNA, 411 bp, Homo sapiens
caggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactg

SEQ ID NO: 24461 - DNA, 469 bp, Homo sapiens
  misc_feature 469: n = A,T,C or G
tgagaagcaagtgtcggatccgcaggcgcagccgtgcgatgttgtcctctacagccatgtattcggctgctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactggcttacgctgacaaagattattgaagcaagactaaagatgtataagcattccaataataaggccatgactacgggggcaattactgcaatgctgtctacaatcctgtattcaaggcgcttctttccatactatgtttacaacatcatcggtggacttgatgaaan

SEQ ID NO: 24462 - DNA, 445 bp, Homo sapiens
gatttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtg

SEQ ID NO: 24463 - DNA, 406 bp, Homo sapiens
  misc_feature 2, 10: n = A,T,C or G
gnattcggcnttaaggccgggggcgcaatagtatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagt

SEQ ID NO: 24464 - DNA, 425 bp, Homo sapiens
aagcgaattggcaccaaacagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagcctagtggagccacttttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacattttgaaacctt

SEQ ID NO: 24465 - DNA, 410 bp, Homo sapiens
  misc_feature 141, 229: n = A,T,C or G
tctaaattattattaatagcgtattttaatctatttaattttaagatggctataatgtaattaaagcactactttaaatatacgccgagtactaggcaatgagtaaacattataaaagtataaaagtcggccgggcgcggnggctcacgcctgtaatcccagcactttgggacgccgaggcaggcggttcacaaggtcagcagatcgagaccatcctggctaacacggngaaaccccgtctctactaaaaatacaaaaaattagccaggcgtggtggcgggcgcctgtagttccagctactcgggaggttgaggcaggaggatggcgtgaaccagggagatggagcttttgcagtgagccgagatcacaccactgcactccagcctaggcgacagagcaagactgtctca

SEQ ID NO: 24466 - DNA, 487 bp, Homo sapiens
ccttatggccggggagtccgagtggagagagcgagctgagtggttgtgtggtcgcgtctcggaaaccggtagcgcttgcagcatggctgaccaactgactgaagagcagattgcagaattcaaagaagctttttcactacttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaaagaagttgatgaaatgatcagggaagcagattttgatggtgatgg

SEQ ID NO: 24467 - DNA, 264 bp, Homo sapiens
tgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactg

SEQ ID NO: 24468 - DNA, 467 bp, Homo sapiens
atttgcactattctatagaaactacaatttgttgccctatatgtaaaattagaattgtaattaaaaatacacattttattatgtaatcatgttctggtatgtctcatttctcagccttattttataacgtggaagtcattgaactatgttatcagaaactaagtttgtatattatttgtgaaaaacatgtatttctgaatcagtccgctaatatgattgtgcagtattagcttgcttttgctgctgtgttaatgtcatatatttgcttaccttttgggttcaattatctacataattgtgaaatttaacaagttataataaagcatgacaaccaaagttttagaaaacattaaacattttaaatgcacgtttaaaaaacgtgttgaatgtaacccccctatttttgtgtgcaaacactaaattttattgctttatgttttgacctttataaaggtgttattctgctg

SEQ ID NO: 24469 - DNA, 260 bp, Homo sapiens
tcaacttttctaagaaaagacttttcagtcttgtagtgtgtgcttacagtaactaattttgttgaaaatggtttcaagttattcaaatttgtacaggactgtaaagatttgttgacagcaaaatgttgaagaaaaaagcttatagaataaaagctataaagtatatattagggatctgcaaacaatgaagaattatgtaatatattgtacaaatgtaagcaaaggctctgaaataaaatgccatagtttgtgaatccttg

SEQ ID NO: 24470 - DNA, 472 bp, Homo sapiens
  misc_feature 428: n = A,T,C or G
atgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggnaagaaggcctgctctaaattatccagtgtatgggagaaacgaca

SEQ ID NO: 24471 - DNA, 487 bp, Homo sapiens
  misc_feature 286: n = A,T,C or G
ccttatggccggggaggcattgaggcagccagcgcaggggcttctgctgagggggcaggcggagcttgaggaaaccgcagataagttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaancttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataattttgaaggcgatcttttaaaaagagattaaaccgaaggtga

SEQ ID NO: 24472 - DNA, 426 bp, Homo sapiens
  misc_feature 270: n = A,T,C or G
caatacaaccgcccaacctcggtccacacctgggcatttggtgagagtcaaagctgaccatggatccctggggccaacggcaacagcatgggcctcacctcctctgtgatttctttctttgcaccaaagacatcagtctccaacatgtttctttttgttgtttgattcagcaaaaatctcccagtgacaacatcgcaatagttttttacttctcttaggtggctctgggaatgggagaggggtaggatgtacaggggtagtttgttttanaaccagccgtattttacatgaagctgtataattaattgtcattatttttgttaacaaagattaaatgtgtcattggaagccatccctttttttacatttcatacaacagaaaccagaaaagcaatactgtttccattttaaggatatgattaatat

SEQ ID NO: 24473 - DNA, 473 bp, Homo sapiens
gatttcagaaatgttctcaacttttgtctgaaaggaaaaaagggggaagaaaggggtggcagtggcaactgtcaagacattttataacttttactttcaagatagtgtctagacttcttttggaaattttcttataatctcttagttttttatgtcaagaaaaggactggtgtagcattaagacctattctggcatcaatgatattagggaaagcttttaaccatattggcagagccagactttaagggctaagtcatatgacttgggcagggaacagcctttttcaaagatcatgaaattatttcacatagtgcgattttttgagtttggcttgatggatgtttgctgatccagacgttatcattggtgacattatttttagtgaaatgaaccaggagtgagtttgtcactgttggctgtatttttacaaaatgagctttacaatattttttctgacttaaaaaagtcatgc

SEQ ID NO: 24474 - DNA, 474 bp, Homo sapiens
agtggagagaatttcacttgttaataatgctattaaaagatgaagcttatacactttataattgcacagagtatttgtgtaagttcatataaaagtggaataaaattaaacagccaaaaagagagtattctttgctagaggtcacttttggggtaatttttagaatgtggtaaaagaaaaaatatcttgcaaatcattagaaatatgttgattttgtgttactcttgatgaaatactatgtgagggtatttgtctaggcctgattctgagaataatataagaatcgagccaggcaccatggctcatggttgtaatcccagcactttggaagttgagactggtggatcacctgaggtcaggagttccagaccagcctagccaatatggtgaaacccactgtctactaaaaatataaaaattagctggatgtgatggacagcacctgtaatcccagctacttgggaggctgaggca

SEQ ID NO: 24475 - DNA, 500 bp, Homo sapiens
  misc_feature 8, 15: n = A,T,C or G
attcggcnttatggngggggaagataaaaggatcttctttcctccgaatgtataaggaatataactgttgaccttgattctatactcatttaaactattatctgtcagcaagaatgaggcccaaagtgaggaaatacacaaaatagagagctcctcacttacagaagcttgatgggagaaccaaagattgtacttcagcaagaatagtaaaccagggagaaggaggaattgcaaaaaataatacagtggcaaacaaagaattggcaaaatatttgataaatcaagttgagttgattgcaaatacataatttttaaagtagaatcaaaactctagacaataacaagaaagttggaaaatagagttgagtcaggaatgctacctattcttgctttgttcccaaaaagtagcacaaaaagagacactgaccaacttcagggtattttaccaaaactaaatagctattttgtggctctgcagccagactacctgaatgaaagac

SEQ ID NO: 24476 - DNA, 473 bp, Homo sapiens
agaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaag

SEQ ID NO: 24477 - DNA, 270 bp, Homo sapiens
atacataaatgaactattaggaataataagggtgaaggagaaaagtctacatgcaaagtatacaaagaaactaagatgtgttgggcacagggaggggaacatcacacaccagggcctgtgagggggtccgcgggcaaggggagggaaagcgttaggacaaatacctagttcatgcaaggtttaaaacccagatgacaggttgataggtgcagcaaaccaccatggcacatgtatacctagataacaaacctgcacgttctgcacatgtat

SEQ ID NO: 24478 - DNA, 471 bp, Homo sapiens
ctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgccggcttcttcgccttcgtcaaatcttcaatggaacctttgtgaagctcaacaaggcttcgattaacatgctgaggattgtagagccatatattgcattggggggtaccccaatctgaagtcag

SEQ ID NO: 24479 - DNA, 472 bp, Homo sapiens
  misc_feature 17: n = A,T,C or G
gttaccataaaatgatngtatccaccctcaagttggggatgcaaatcaaaagccctgttccacctgtccaccttgtagggaagtcaaaagctttggaaagagtttttgccttctcccagcaaaaatctttggtcaggaggggaggagcatattcttggctgaactcatgctgagctcatcggaagtgaaaacaatgagaggagaaaaattctgtgtgtcagttccatagtccccaggaggccgcataaagggaaggtctttttggacccattctgaggactgagtcattttcatgatttgagtgtggagttcctgggttaatgtattatagtccagccatagattaatctttccttactccagcagcagaccagatttataaagtatgactctgttttcagattcaaattatttttaataaggtaaaaacaaagatgaagataaatattttttaaaaacagcattagctgta

SEQ ID NO: 24480 - DNA, 424 bp, Homo sapiens
ccttatggccggggagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatt

SEQ ID NO: 24481 - DNA, 199 bp, Homo sapiens
tctttcatagatatttttgtctatttggatcgcattaattgtttccagtaaaactcttttaccacagggaaatacacatctcacttcagagttccattaggttttatattgtacttttcctccattacttattaaatactcctattaacaaaaggtacaaaataacaggttatgaggaaatgagcgatatatgaacggc

SEQ ID NO: 24482 - DNA, 473 bp, Homo sapiens
gattcctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggttttgaagatgccgcatttggattggatgaattccaaattctgcttgcttgctttttaatattgatat

SEQ ID NO: 24483 - DNA, 464 bp, Homo sapiens
  misc_feature 13: n = A,T,C or G
atatggaaacatngtgcttcacctgagaagtgtatgcagtggcaaaattagctggacttcatgatgcaattcttcgaatgccacatggatatgacacccaagtaggggaacgaggactcaagctttcaggaggagaaaagcaaagagtagcaattgcaagagccattttgaaggaccccccagtcatactctatgatgaagctacttcatcgttagattcgattactgaagagactattcttggtgccatgaaggatgtggtcaaacacagaacttctattttcattgcacacagattgtcaacagtggttgatgcagatgaaatcattgtcttggatcagggtaaggtagccgaacgtggtacccaccatggtttgcttgctaaccctcatagtatctattcagaaatgtggcatacacagagcagcccgtgtgcagaaccatgataaccccaaatgggaagc

SEQ ID NO: 24484 - DNA, 444 bp, Homo sapiens
ccttatggccgggggagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaag

SEQ ID NO: 24485 - DNA, 278 bp, Homo sapiens
catggtggctcacgccctgtggtcccagcactctgggaggccgagacgggtggatcacctgaggtcaggggttcgagaccagcctggccagcatggtgaaaccccatctctactaaaaatacaaaaattggctgggtgtggtggtaggcgcctgtaatcccagctactcgggagtccgtggcaggagaatcgcttgaacccgggaggtggaggttgcagtgagctgagatcacgccattgcactccagcctgggtgacaagagcaaaactcagtctct

SEQ ID NO: 24486 - DNA, 431 bp, Homo sapiens
tatacattatctcctatgaaccgacaggggaaaaaaatgtgaaaaggctttgaaatggaacaaaaacttactaggtatcttcaatgaaggcctagtttttgcctagcacatctgtctgggcttcctgattctgtgggatctctgtgctcttattgtctttcagtttttataactttatgagttgcagacaactgataacaaaaatgcaaataatttttgttcacagacaataaattttgtctggtagggttccactgatcttccttcctcattgtagaagaagccaattttgcctttatttaaaatacatttcagcactctgtagtgcctatatatgtgtggttctttaaacactcctttaagtcatttgtaacttcttgttcattccctcattaattaatgagttaaataaacacatttgtcacaagcta

SEQ ID NO: 24487 - DNA, 470 bp, Homo sapiens
  misc_feature 18: n = A,T,C or G
aataagtcatgaccaagnacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtatgtgaatgtacaaagaaaacaaaccattgcttatgctgttatatactagagaaaattttt

SEQ ID NO: 24488 - DNA, 255 bp, Homo sapiens
gaggaaatttttatggcaggaatattttcacgtataatttaggaaggctgtaggttattaaaaaaataaaaccccccagctcctacacctggtcattagtgatttgcaggatgtgtgctacattgtcattcctcattgatttgatcactgcttagtgctaccatgattctcttaaaagaggaagagacaaaatgtgagaatatttgtgtcttcagaggatgtggaataaaattaatgcaaagaggaatatgaatg

SEQ ID NO: 24489 - DNA, 299 bp, Homo sapiens
  misc_feature 294: n = A,T,C or G
ccttatggccgggatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtnaaaga

SEQ ID NO: 24490 - DNA, 170 bp, Homo sapiens
  misc_feature 27: n = A,T,C or G
gaccgggatagaagaaaggagctcagnatcgtaataaggatcgcagtcgatcaagaagaaaaaagcagagatcgtgaaagggaacgagagcgggaaagagagagagagagagaacgagagcgagaacgagaacgggagcgagagagagagcgagagagggaacgggagcg

SEQ ID NO: 24491 - DNA, 472 bp, Homo sapiens
  misc_feature 272, 452, 457: n = A,T,C or G
agctttaatttattaatgcaacagtacctaacaaacccacaggtcctaaactaccaaacctgcattaaaaatttcggttggggcgacctcggagcagaacccaatgtttaaaaatataattgtatttagatcaaggttttattaaaagctacattttataacactggcacacacaaaaaagtagttttaagcttgtttgcacagttctttttttccattggaaatggaattcattgccttaggtctttttaaatagtgtattattattcgtnggggctggctctatgcttgaaaaccagtttatttataacctgttataagtgctatattctgtttgcagttaggaaatgcagaattcaaagtgatctcctagcttgtaagcaaactgagatgcactatcccttttctataaaaaataagttaatgtgtcaagaaaccaactctattaaggnggggnttaatattacccttt

SEQ ID NO: 24492 - DNA, 149 bp, Homo sapiens
  misc_feature 10, 11: n = A,T,C or G
gtattcggcnnttatggcggggtacttagcaacaattcctgtttctttaggggaaaatagcaaccagaacaaaacaccagaaacacacaataatatctttattaccttgaagtacacaaagatcttaaaaacaaacaaacaaaaaaccg

SEQ ID NO: 24493 - DNA, 470 bp, Homo sapiens
tgtaccgggaataacattcctaggctgaaatttccacaaagaaatagaacctgtacccagttcttcaggctgatttccctgacctcttgggcatttgtatttgtagtaaagtattgcagagattcctaagtattttatagcagccatcaaaattggactttgtattgtttattcgtaaaagacacttggtaatagacttcagtgaactctgtatgaatgcagtagtgtgtgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgctttttttctgaaatacactaagagcagccacaaaactgtaacctcaaggaaaccataaagcttggagtgccttaatttttaaccagtttccaataaaacggtttactacct

SEQ ID NO: 24494 - DNA, 462 bp, Homo sapiens
atagtaaatatatttgtttctaattgtattcctagagtttacattcctaaagaataaacgacgactttggctatttttgtgtgttccctaccttcttaaggctatggaaataaactggagtttagttttttgaatttttgtatatttgtgtaaatgttctccatatatagtactttatacaacaagtgttgcctcttgttttattgaaataaaaactgaaaaaaatattttttccagatcagtttactcatttaaaaaattattataaaaatttgcagaagttttgatatgaaggaagagaatagaggaggaagacttaggtaagttgagccattgagagcttttgggggtaagtgataagacaatgacctcattcctggctttgtgctttacatgtcatagggctgaggagtatgacaggtccactcgtattcatccaaagatgaagatgagcctctatgg

SEQ ID NO: 24495 - DNA, 466 bp, Homo sapiens
aactgaagaagctgcatataaaccacaacaacctgacagagcctgtgggcccacttcccaaatctctggaggatctgcagcttactcataacaagatcacaaagctgggctcttttgaaggattggcaaacctgaccttcatccatctccagcacaatcggctgaaagaaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgagtatctgcgtttatctcacaacgaactggctgatagtggaatacctggaaattctttcaatgtgtcatccctggttgagctggatctgtcctataacaagcttaaaaacataccaactgt

SEQ ID NO: 24496 - DNA, 207 bp, Homo sapiens
  misc_feature 108, 133, 172: n = A,T,C or G
ccttatggccgggggtttggtggtttggataggtttaaggttgggttaaagtgtaagggatgctcaacagtgcaagtaaataatatttagtcaccaaacatatttagnaatttttagaaataaaattttattnccagcctaaatttttgccaaaaaaatttccaaccctacnaaaattttaaccaaatttttttaccattttttagg

SEQ ID NO: 24497 - DNA, 368 bp, Homo sapiens
  misc_feature 4, 23, 72: n = A,T,C or G
cagnagaaagcacatacgtgtgnacacgcctgcacacacacattcagtattttaaaagaatgttttcttggngccattttcattttattttattttttaattcttggagggggaaataagggaataaggccaaggaagatgtatagttttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaaccttaaactttttggcttgaaaatatttttgtaataaagatttctgggtaataatgaaaga

SEQ ID NO: 24498 - DNA, 497 bp, Homo sapiens
  misc_feature 18, 40, 61: n = A,T,C or G
atccggggtatttcggcnttatggcgggggatagcaaggnctaacccctataccttctgcntaatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatcgaatcttagttcaactttaaatttgcccacagaaccctctaaattcccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatag

SEQ ID NO: 24499 - DNA, 216 bp, Homo sapiens
gatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatca

SEQ ID NO: 24500 - DNA, 474 bp, Homo sapiens
aaccttgagtcatctcagttgactgttcaagcagaatttgatatgtctgccatacctagaaaacgtggtagaccaagaaaaatcaatccaaaaaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggaccttt

SEQ ID NO: 24501 - DNA, 226 bp, Homo sapiens; identical to SEQ ID NO: 14144

SEQ ID NO: 24502 - DNA, 386 bp, Homo sapiens
aaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagatatat

SEQ ID NO: 24503 - DNA, 467 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaagtttagttaaaagttgggagggtgattaaaataattttggaagggcgatctttttaaaaaagagatt

SEQ ID NO: 24504 - DNA, 476 bp, Homo sapiens
atattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgctgctattgccaatttttcaatgaaatgacctaaaaacaacaaaaaaaaataacctatacggtagttgctttagggggtgggggggatgctatctgttagtgcttgaaagggggtaaatgcttgccgctttagaggtggatggtgctcataaaaggccccagtcgggggtatttaaaaaggactgaacagaaaattccttagctagt

SEQ ID NO: 24505 - DNA, 424 bp, Homo sapiens
  misc_feature 67, 87, 91, 100, 122: n = A,T,C or G
gaatatacatcgctaaatctccgctttttgctcggcctcagatgatttagaagtttcaagaaacatnagtttggaatacaaatgccnattngaacatganaaaaagaacaaatgctttggtncactctgaatctgatgttggcaacagaactgaggtgggaaaccattcaagcaaatcttccacagttgttcaagaatcttctaaaggcacacctcggtcttacttagcttccagtccaaacccattcagccgtgcaaatgcagctgaaaccatatctgcagcaagagcacttccatctgcttctcctacttctatccgaactggatatatgcctcgaaaggcttcagttggatctgcttctactcgtcacgtgtttggatcaagactgcagaggataaagaccacagttaataccataggggc

SEQ ID NO: 24506 - DNA, 410 bp, Homo sapiens
  misc_feature 21, 35, 46: n = A,T,C or G
taccttttgtgaccatcaganaaactgaataaacnttaactggccntcctggttttgcagagatcaggttgttgacagttcctggttgacccacagctacccatgtcagttatctccactaacatatccaagaatctttgtaggacaatttctccacctgcaaggtctttcaggtagaactcttcttttaaggcaattagcccattgccaaaaggttttactgtcttaaagctgtctttctgagatctaattccaaggacttctccacagctaagtgagatgcctcacaccattaggtgatgctttggacagaacagagtattttcatcttgtgtttaaagcaattccttggcttcggctcctcaccactttctatgccagtctcccatttatgtccctagtaatggcct

SEQ ID NO: 24507 - DNA, 470 bp, Homo sapiens
attcacttatagtgctcatgtcaggaatggcaagtgagtaagagcccctgataatctgcttttgttagaacgtaatgcaaagataataaaacatgtccacttcttttctagttctaatcagtttttagacatcaagatttatttactttgcatgagatttgtttcctattatttgaatatgtgctatacacttgaattagaaaaacctgcttgaatgtattgtcagttattaaagcacatgtgactaagtttgcatttgtcagtattgttctactgtttgtactgaaagtctcattttaaaattgctacttaacactgtactataccttgtaattttttagattctccacttgtattctttaaatgtttccagatgcctttagttttagctgctgtaaaatagctactttgcgttatttgtatagaaattgttttttaaaaactccatttatttatacagagacatttat

SEQ ID NO: 24508 - DNA, 472 bp, Homo sapiens
aactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctggtggagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatg

SEQ ID NO: 24509 - DNA, 468 bp, Homo sapiens
tccatatgataggctgcttttatgaacacttcctgtatttgataatttgatctgtagtggttaaaaaatgtcatatgtggggtctagctctgacttcatcactaaccacctgtctgacctgtggtaattaaccttctctcaattcctcttcagtcacctctaaaccggtaataataataataataggatctacttcataggactgatagacaatattaaatgaaataaagtgcctgatgcctactgtatgctcaatttatgttcagcaactagaattataaatagctgatttctatgagcaaaaccagtatttctaaaaataagattccaagagctttacaaagctgttcacttgatttttaaaattgattacaaatttttgttgcttagcatcagagaaatctataaagagtttatttatatgggacaaagaacaacaaaagacaatttttcacaaggcaacataat

SEQ ID NO: 24510 - DNA, 259 bp, Homo sapiens
  misc_feature 252, 259: n = A,T,C or G
atgttccaaaaactttgaaagctaaatgtttcccatgatcgctcattcttcttttatgattcatacgttattccttataaagtaagaactttgttttcctcctatcaaggcagctattttattaaatttttcacttagtctgagaaatagcagatagtctcatatttaggaaaactttccaaataaaataaatgttattctctggtaaagagctatacagaaaggtccaggtattttactttctgggaaggncttcagn

SEQ ID NO: 24511 - DNA, 475 bp, Homo sapiens
gaaaacatttgaaattaatcccagacacccgctgatcagagacatgcttcgacgaattaaggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtggaagaagagcccgaagaagaacctgaagagacagcagaagacacaacagaagacacagagcaagacgaagatgaagaaatggatgtgggaacagatgaagaagaagaaacagcaaaggaatctacagctgaaaaagatgaattgtaaattatactctcaccatttggatcctgtgtggagagggaatgtgaaatttacatcatttctttttgggagagacttgtttttggatgccccctaatccccttctcccct

SEQ ID NO: 24512 - DNA, 369 bp, Homo sapiens
  misc_feature 18: n = A,T,C or G
gtttgctaagccttcttntgaatactgttgaattttgtcaaataccttttctgtatctattgagatgatttataatgtttcatttttattctcttaaaattgtattgattggttttaaaataaaccatcttgaattcttggggaaaacgtcactgggtcataatacattattctatttcgtcactgggtcataatacattattctattttacatattgctggatttgattagctaaaatttaaagattttttgtatctatgtttttaagggatattgatattgtaattttctgataagatctttgtctgattttggtgtaaggctaacactggctttaaaatatgagttggatagccaaaagaactatg

SEQ ID NO: 24513 - DNA, 409 bp, Homo sapiens
  misc_feature 13, 20, 29, 31: n = A,T,C or G
tatggccgggacnaccgaangtgccgganantgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcagacttgtttgatataaaatatgttgtcttttgtttaagcatttattttcaaacactaaggagctttttgacatctgttaaacgtctttttgttttttttggttaagtcttttacattttaatagttttttgaagacaatctaggttaagcaagagcaaagtgccattgtttgcctttattggggggg

SEQ ID NO: 24514 - DNA, 221 bp, Homo sapiens
  misc_feature 14, 21: n = A,T,C or G
tgcattctccagcntcaaganactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatg

SEQ ID NO: 24515 - DNA, 404 bp, Homo sapiens
  misc_feature 69, 74, 135, 192, 227, 237, 329, 332, 349, 362, 373: n = A,T,C or G
gtgaattcgaacacataattttaggcacttgtcactatatgtgtgtactgtagttaaaaaaaaaaatcntaggnggcagtacagaatagttgctctggagtgtcaccagccaggtaaaaatcctggtcccgctgnggttttaggcaagggatctaacctcacgaagcctccattacctcatctttaacctgnggatgctaacagcaataatctcataacaatgctgngaaggtcagnggaaataagcatagaaacttgttagttcagcgcctggaacatactaagtgttcaacatagctgagcgctcttaatctgctgacaaaggcagnggngcccttgtaggaaatanatggcaaaccatntggactaacgnggatttcaaatgttcttagtagtctacattt

SEQ ID NO: 24516 - DNA, 474 bp, Homo sapiens
gatataaatgaaagtacacctacactaatagtctgtctcaacaatgtgtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagtattacaaaatcctagtttatactagactaccatttaaaaatcatgtttttatataaatgcccaaatttgagatgcattattcctattactaatgatgtaagtaccgaggataaatccaagaaactttcaactctttgcctttcctggcctttactggatcccaaaagcatttaaggtacatgttccaaaaactttgaaaagctaaatgtttcccatgatcgctcattcttcttttatgattcatacgttattccttataaagtaaga

SEQ ID NO: 24517 - DNA, 213 bp, Homo sapiens
  misc_feature 74: n = A,T,C or G
atttggatgattgtcataaggtttttagcatgttcctccttttcttcaccctccccttttttcttctattaatnaagagaaacttcaaagttaatgggatggtcggatctcacaggctgagaactcgttcacctccaagcatttcatgaaaaagctgcttcttattaatcatacaaactctcaccatgatgtgaagagtttcacaaatccttc

SEQ ID NO: 24518 - DNA, 500 bp, Homo sapiens
  misc_feature 2, 15, 29, 39, 41, 45, 46, 59, 67, 75, 76, 82: n = A,T,C or G
tntggcccggggaanctgaactgagaccntgccccctananagannccccaaggacaantttctgangccagganncgtccntccaaacggctgtactttactaaaggtttttggagcctgcacctgaagcatcttacttttactagtatatcaacccttttgtttttaaattgacctgccaaggtagctgaagaccttttagacagttccatctttttttttaaattttttctgcctatttaaagacaaattatgggacgtttgtagaacctgagtattcttctttttaccagttttttagtttgagctcttaggtttattggagctagcaataattggttctggcaagtttggccagactgacttcaaaaaattaatgtgtatccagggacattttaaaaacctgtacacagtgtttattgtggttaaggaagcaatttcccaatgtacctataagaaatgtgcatcaagccagcctgaccaacatggtgaaacccca

SEQ ID NO: 24519 - DNA, 470 bp, Homo sapiens
gctgaaaatagtgtggtatattctttgggagacagatagagataggagtcataggtactgggtttatgatgtcattagagtttgcagtttaagattctcaaagctgtaaattacaatggactttagatactgtcacacacaatgacactagataagtgggtgggtagctgaggatctacagaggtctaagtgagggagaataatagaggaagaagagacttattccttgttctgtcttgcagttcttgccaacagtaaaatgtccaggccttaagtactgggtgtgtattatctgtgtctatcaaactccagtaatgagagcctagtgaaaaatctgaaatttcttttgcaaatggaacagtgaaaagaaaccctggtcaagagcaatagataatggtgatagaaatcggctagtcactcaaagcattagtctttgcaccaagaagaagcttctttaagaaattcatctt

SEQ ID NO: 24520 - DNA, 119 bp, Homo sapiens
tgcataagcctgcgtcagattaaaacactgaactgacaattaacagcccaatatctacaatcaaccaacaagtcattattacccccactgtcaacccaacacaggcatgctcataagga

SEQ ID NO: 24521 - DNA, 227 bp, Homo sapiens
  misc_feature 20: n = A,T,C or G
gaatcaggtcgttcaagagncgaaatgacgctcagaggcaactttctcgagaaccagaatgccagaatgttacaagatggaattctgaccaatcacctttccaaacaaaaggagattgaaatggctcaaaagaaaatgaattctgagaattctcatagtcatgaagaagaaaaagacctatcgcataaaaatagcatgttgcaggaagaaattgctatgctaagact

SEQ ID NO: 24522 - DNA, 471 bp, Homo sapiens
  misc_feature 4: n = A,T,C or G
aganagaagctggaaaatgggctgccccagcagcaaactgtgcctctattctccatgtgcagcaacaaggcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaataga

SEQ ID NO: 24523 - DNA, 473 bp, Homo sapiens
  misc_feature 13: n = A,T,C or G
gaaagatagagantaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaggaccttgaaatccatgacgcagggagaattgcgtcatttaaagcctagttaacgcatttactaaacgcagacgaaaatg

SEQ ID NO: 24524 - DNA, 500 bp, Homo sapiens
  misc_feature 2, 25, 30, 434, 460, 468: n = A,T,C or G
tntggcccggggaggcattgaggcnagccngcgccggggccttctgctgagggggcaggcggagcttgaggaaacccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaaggtgaccttaaacagcttaaagtttagtttaaagggtggnagggtgattaaaaataattttggaanggcgatcnttttaaaaaagagattaaacccggaaggtgat

SEQ ID NO: 24525 - DNA, 364 bp, Homo sapiens
  misc_feature 15, 26: n = A,T,C or G
atttgtacttaagtnttccatctttnctcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttccttt

SEQ ID NO: 24526 - DNA, 500 bp, Homo sapiens
  misc_feature 9, 12: n = A,T,C or G
ctccggccnttntggcccgggggtatcaatggagtgagccccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtgggagatgctggcaacaggggaggaccagatcaacaggcttattagaagaatgaactaaaggtgtctaccatgatt

SEQ ID NO: 24527 - DNA, 399 bp, Homo sapiens
  misc_feature 141, 266, 290, 327, 341, 395: n = A,T,C or G
actctcagggttggctagttttattgtagaatacattgttgctctatactgtaaatggaaaattaacttgtgtaacccagtcaaacaatctttgtgattatttgcggagcataccacccagataagctgaagatttatgtnttttcttttaaaataccttttctagggtagacagggtgggaaagagggtataagttgaagaaagggggttgggaagtgattaggtgaaggaatttccttcatggaaacactcctaaggaaaatgngcagttggatatgctgcgcttagntcatgaaatgtaagttaaaatgcaaggttctagctanactgctaagaaggngacattaaatatgcccttttccttctttcagaaaaagatcattattatttatgngcac

SEQ ID NO: 24528 - DNA, 165 bp, Homo sapiens
gtgaggtgcagtaaagtgaaacacaataaaatgaggtatgcctgaggtcaggcacggtgactcacacctttaatcccagcactttgggaggctgaggcgggtggaccacctgaggtcgggagttggagaccagcctgactaacatggagaaaccccatctctact

SEQ ID NO: 24529 - DNA, 329 bp, Homo sapiens
aagttcgaaacattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttc

SEQ ID NO: 24530 - DNA, 358 bp, Homo sapiens
  misc_feature 356: n = A,T,C or G
gtggtgaaacccgtctctactgaaaatacaaaaaattagccaggtgtggtggcacgtgcctgtagtcccagctgcttgggaggctgaggcaggagaatcacttgaacctgggaggcagagtgagccgagatcgtgtcacgcactccagcctgggtaacaaagcgagactccatctcaaacaaaaaactgaagagtataattggattgtttgtaacacaaagaaaggataaattcttgaggtgatagataccccatttaccctgttatgattattatgcattgtattcctgtatcaaagtgtctcatgtaccccatatataccacagaaatgtaaaagtaaataaattaacaaatantt

SEQ ID NO: 24531 - DNA, 350 bp, Homo sapiens
gcctttccggcggtgacgacctacgcacacgagaaacatgcctctcgcaaaggatctccttcatccctctccagaaggaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccattctcaataaacacatttttggatg

SEQ ID NO: 24532 - DNA, 268 bp, Homo sapiens
  misc_feature 9: n = A,T,C or G
gctcacgcntgtaatccaaacactttgggagactgaggtgggtggatcccctgaggtcaggagtttgagaccagcctggccaacgtggtgaaaccctgtctctaccaacaatacaaaaattagttgggcgtggtggtgcatgcctgtaatcccggctacttgggaggctgaggaaggagacttgcattgaacccgggaggcggaagttgcaatgagctgagactgtgccactgccttacagcctgggcaacagagccagactgcatct

SEQ ID NO: 24533 - DNA, 496 bp, Homo sapiens
  misc_feature 16, 19, 433: n = A,T,C or G
atccggggtatttcgnttnttatggcccgggggcgatcgcttcctggtcctcgccctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgnggatggtgggaattcgggaaaataaccagttaaaccagctactcaaggctgctcaccatacgg

SEQ ID NO: 24534 - DNA, 460 bp, Homo sapiens
  misc_feature 456, 459: n = A,T,C or G
aatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcaccttttgccacactgagtgagctgcacttgtgacaagctgcacgtggatcctgagaacttcaggctcctgggcaacgtgctggtcttgtgtgcctggcccatcacttttggcaaagaattcaccccaccagtgcaggctgcctatcaaaaaagnggng

SEQ ID NO: 24535 - DNA, 471 bp, Homo sapiens
  misc_feature 5, 450: n = A,T,C or G
aaganaaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttatttgttttttattccacacttcctacttggtctctgggaagttttaccacatgtaacagattcctttatatgtaaggggaaaatcactatttggaggaaactgtcctggtcaaaatatttaactgactgntgacatggattttcctttttt

SEQ ID NO: 24536 - DNA, 355 bp, Homo sapiens
  misc_feature 108, 286, 288, 347: n = A,T,C or G
tgactacaacatccagaaagagtccaccctgcacctggtgctccgtctcagaggtgggatgcaaatcttcgtgaagaccctgactggtaagaccatcaccctcgaggnggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggngnctaagtttccccttttaaggtttcaacaaatttcattgcactttcctttcaataaagtngttgcatt

SEQ ID NO: 24537 - DNA, 471 bp, Homo sapiens
gagtatcactgattttagggacgccccacagagctaaagcattttttaatccgagaggacttttgtaactcatattagttaatcttctagctctgagatagcaacacagctcttagaattctgtaagtagcttgaggcctcctcctctactgtacatgttcttgctttcccaaaattgtaagtttggtttttcctatgaacaagactgtaattgatttttctctccctgaggaaaaaagttcggaataaatgagacatggatatgaaactacttagcacaatgcctggtacatattaggccctcagcaaatgtggctaccgtgtcattatttcatggtgagactcaaggcaaaacaagattcttaatttatgctccgtaaatgctagaggcttgggcaatacggtctgtcctgaaaaacaggactctgtgtctcattgcctctagaatccttaggtagcagtttctgttca

SEQ ID NO: 24538 - DNA, 202 bp, Homo sapiens
  misc_feature 7, 29: n = A,T,C or G
attggcncggggtatttaaagttccgaanggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaac

SEQ ID NO: 24539 - DNA, 119 bp, Homo sapiens
gtgaatgcaaagactttggatggaggcctgaatgtcattcaattagaaactgcagtaggggctgccatcaaaagttttgagaattctctaggtattaatgtgccaaggagcccgttttc

SEQ ID NO: 24540 - DNA, 208 bp, Homo sapiens
ctagtatttgatagcacaacaagctgactatagtcaacaataacttactgtgcatttcaaaataactaaaagagtataattggattgtttgtaatgcagagaaaggataaatgcttgaggggatggatacttcctttaccctgaggtgattattatgcattgtgtgcctgtatgaaaatatcttgtgtgcctcataaatggtagggta

SEQ ID NO: 24541 - DNA, 468 bp, Homo sapiens
gaaggaacttggagcccatggaaaacagccctccttgagagctgccaaagagcatgctatgcctaaagatttaaagaagatgttagaaaataaagtcatagaaacattaccaggtttccagcatgttaagttatcagtagtgaaaaccatcttgttgaaagagaacttccctggagaaaacatagtttcaaaaagcttttcttctcactctgatctgattacaggtgtttatgagggaggcttaaaaatctgggaatgtacctttgacctcctggcttatttcacaaaggccaaagtgaaatttgctgggaaaaaagtcttggatcttggttgtggatcaggtttactaggtataactgcattcaagggagggtccaaagaaattcactttcaagattataacagtatggtgattgatggaagtaaccttacctaatgtagtagctaactccactttggaagatgaag

SEQ ID NO: 24542 - DNA, 456 bp, Homo sapiens
aaatgggcccgcgttcgcacccaaaaccgtgaagaaggcggcccgggtcatcatagaaaagtactacacgcgcctgggcaacgacttccacacgaacaagtgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcatgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtatttattttcaataaatctggggac

SEQ ID NO: 24543 - DNA, 482 bp, Homo sapiens
cattccaacaggtatgtgcccttactgccctacgtcctgtgcccttctggtcatgtgctttcttctcatttctctaagctgtttggtggcatctagtttgcttttgaaggtataatacagtttgaaattcatcgttgtcctagctatctaaatgtatttaccttactttgaatgatagctaaagactgttaggattctaaagccaaatatttgatagattgaagagacagatttaacccatgagaaacagcagttagggcttttggtttcttgtatttgcacaagccctgtaaaattgtttatgtaaataagaccttttatgtgtgacaattgaaaatttgtccttaactctgaatgacctaaaaatagcaattccagtaaatactaaccatttttttctatttctattcagagcactaaaacaatgaggctattcaaattaaagcaattctctactcatatttttatattcattctatctc

SEQ ID NO: 24544 - DNA, 168 bp, Homo sapiens
  misc_feature 10, 18, 40, 166: n = A,T,C or G
cgcggggaanttcggccntttatggcggggcaacagaaanaaaactaccgaatccaaaataacagctaccaacccacacaagtaacatctacccacaactcaagataccacaccattcaaaattactactcttaaaacaactactcttgcacccaaagtaactacnac

SEQ ID NO: 24545 - DNA, 248 bp, Homo sapiens
  misc_feature 17, 52, 109, 125, 140, 177, 203, 219, 224: n = A,T,C or G
gaggcattgaggcagcnagcgcaggggcttctgctgagggggcaggcggagnttgaggaaaccgcacataagtttttttctctttgaaagatagagattaatacaactncttaaaaaatatagcncaataggttactaanatattgcttaggcggtaagtttttaacgtatttttantagcttacgattttaagagaaaatgntgaagacttagaagantagcntgaggaaggaaaagataaaaggtt

SEQ ID NO: 24546 - DNA, 290 bp, Homo sapiens
gctttgctgactgtctttttcctatagactgagagagcacttagaggtagcttgcagcctccaccaaactagaccctcttcatctcaatttctcgttctaagaagaacacattgactgtctcagtttgtgtcgtgtgtccagctttgacaaagatgggagtaagtagtttgtagccccatagtacaagtatgacttggcatggagttgagaattacttagtgcttagaaaaaagggtcaacataggctagggagctcctgtaggataaagatatcctctataatctccct

SEQ ID NO: 24547 - DNA, 112 bp, Homo sapiens
  misc_feature 17: n = A,T,C or G
tctcagctactcaggangctgaggtgggagaattgtttgagtccaggggaggtagtgagctgtgattgcgccactgcactccagcctgggtgacaaagcgagaccctgtctc

SEQ ID NO: 24548 - DNA, 475 bp, Homo sapiens
aactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatgggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtatt

SEQ ID NO: 24549 - DNA, 474 bp, Homo sapiens
atatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcaccgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccac

SEQ ID NO: 24550 - DNA, 218 bp, Homo sapiens
tggagcggatgctgacagaacgaatgttcaatgcagagaatggaaagtagcgcatccccgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcct

SEQ ID NO: 24551 - DNA, 347 bp, Homo sapiens
  misc_feature 14, 15: n = A,T,C or G
tattggcccggganntttttaatactagctgattgacttcacagaaagcagcttttttgaattctaatacataggtgtattatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtgggtagttacctataaataaaaacaaatatgcgtt

SEQ ID NO: 24552 - DNA, 457 bp, Homo sapiens
ctcatagttctatcctctaattccttaaatcctactaggagcgtcagtgagggttttcatagcttttggaaatactttggtctctgaactgtaattagcaagaagtaaaaacagaaacgtcaaacgtcaaatgtttgctttgttacctggaggactaaatgtagatgtctttagtatactttgtatgttcttaatatttggaagataattttgtgaatctgtagattttattttttcagtcttaccttacaaatttcttttctatgaataatagaggaacttacggcactctgccatttgttaatgaaaggaagtgcagaggatttagaaaagtacatgatccccagaccacaacaaaccaaaacataaactcatgtctgtgtcccatggtcatagtcaaagattttgtactgctaaaattaccaaataatttaaataaagggggatttgaacacag

SEQ ID NO: 24553 - DNA, 207 bp, Homo sapiens
tcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatgtaaaaccagtatgaccttgtctagtctccaaacttaaaataaacttttgaaaagctgg

SEQ ID NO: 24554 - DNA, 472 bp, Homo sapiens
  misc_feature 33, 190: n = A,T,C or G
ctatatctttactattataaattatgctacagnaaacatcctcatatgtaaatcttacaagattataggcatgtcattagttgttttctttgaataattcttataaattgagttacagggccataagtcatgcacattttcaactgttaatacttctggccaaacgttcttccataaagtttgtgccacntgcatactgccatcaacaatggaattgcatccatttcccacagtcaaagatgagactgccaacacatgattagttttataaaactctgaattattttttctaataatggagaaagatgtcaattaagttacatgaactctttttcctgatacccattgtgatcaaaagtatgcaattttaaaatacctgggggttattaagaattgtattctataggtgattgaagagtattttaagctatacaaagggatcacagtcattaaattattttattaccaaagt

SEQ ID NO: 24555 - DNA, 478 bp, Homo sapiens
  misc_feature 443: n = A,T,C or G
aaatgatttgattaaacctagacgcattaggaaatgcaagttttacctaaaacttgcagaaatttaaacacatttccatttacttactaacgaacagacctgatttttatttaaaaacacaatttagctttgccaacagaagagtaaaggaaaccataacttataaatttgtaatgtgttcctccttgttggagacattagccagtgtttagttttagaccaacttatacaaacagagtattgatttgtacacattctggagacttgctatatcatggtttgctatggcacagactcagcttagcatggggacattttgaacttcattcaaagttgagtagttactggaacctttgacattgccttgtaatgaggtacttccaaaaaaagacccctaacaatggcataataggtggaggtctctctgtgcatatacataatantatgcaggataaaatggtgtgcaccaatcaaatct

SEQ ID NO: 24556 - DNA, 308 bp, Homo sapiens
gcaactaatttttaagaagctaccacttgtcagccaggcacagtggctcacgcctataatcccaacactttgggagtccaaggtgggcagatcacttgaggtcaggagttcaagcctggccaatatggtgaaagacttctctactaaaactacaaaaattagctgggcatggtggtgggtacctgtaatcccagctactctggaggctgaggcaggagaattgcctgagcctgggaggcagaggttgcagtgagccaagatcgcgccactgcacaccagcctgggcaacaagtgcgaaactctgtctc

SEQ ID NO: 24557 - DNA, 361 bp, Homo sapiens
ctgaatgtgttttctgaataagtatataagtagagagggaggccattttgcaaatgcggataatgctgacatgtcgtacttctaaataaattataatttgatttaaaaaggttgcctgcatgtacatttgccattttacaaagagcaacccgtactcctacctccacccaagttggtaacaaccttatcttacaaacaacccttaatattttaaaagctgcagaaaaaacaaatacatgaataaatgaataaacaaaaaacacatagggaaagggtatgagctcttgctgcaaggagtagatgaaagactgataaatgaagctgaggtccccccagtgcttccctttcaatagtttatgtt

SEQ ID NO: 24558 - DNA, 190 bp, Homo sapiens
cctgtggcccttcaaactgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattg

SEQ ID NO: 24559 - DNA, 473 bp, Homo sapiens
gctctttttccggctggaacctggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggatttgtagagccatatattgattggggggggtaccccaatctgaagtcagt

SEQ ID NO: 24560 - DNA, 472 bp, Homo sapiens
  misc_feature 44, 48, 180, 192, 200, 296, 310, 343: n = A,T,C or G
agaaaaaaacaatcttgaaccttacctcataccaagcacaaaantcanttcaagatggatcatagacttatacataataaataaaactataaaactgttatatgaaaacatggaagagaatatttctgacttagaggtaggcaggtcatgaaaagcggtagcctgaaaagaaaaaaaatnataaattagatntcatcgcnatttaaaacttacgctcatcaaaatacatcatgaagaaaatggataggcaagccacaaatcatatatctgataaaagactggtacccagcatttgnaaagaactcctaanatttaattaatagaataatccaatttaaaacgnggaaagatttaaacaaacacttgatttaaaaagttttgtgaatgagagtgtgcacatcaaaaaatatctagcatgatagatatctagcatgatagaagcccaattttaagccacaagaagataccacta

SEQ ID NO: 24561 - DNA, 382 bp, Homo sapiens
  misc_feature 46: n = A,T,C or G
gaaggcattgaggcagccagcgcaggggcttctgctgagggggcangcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaagg

SEQ ID NO: 24562 - DNA, 264 bp, Homo sapiens
  misc_feature 37, 263, 264: n = A,T,C or G
gctaaacctagccccaaacccactccaccttactacngacaaccttagccaaaccatttacccaaataaagtataggcgatagaaattgaaacctggcgcaatagatatagtaccgcaagggaaagatgaaaaattatagccaagcataatatagcaaggactaacccctataccttctgcataatgaattaactagaaataactttgcaaggagagccaaagctaagacccccgaaaccagacgagctacctaagaacagcnn

SEQ ID NO: 24563 - DNA, 410 bp, Homo sapiens
atagaaggaggcatttctgaatcatgtttgttcaccatggcgagactcactgcagaatttttaaccaccttattttaagtcattcattctaggaacagtcaagcccctaccacaaaggggccagatccgttcaagtgaggaagcacttgcagtttctgaattttgctgtatatttgtcctatgtcacccaacaggccctttgctatagctgggacattaccagaccccaataccttagggtctcacagcctgaaggacacagagcattgaattattaaaagacctgaaaatattataatgtttttcaattgtcacctgttttcaagacttaaatgctatagacttttctgcaggaatgacgtgtatattcctcactggcatttaccaaaaataaatgatggtttccaggg

SEQ ID NO: 24564 - DNA, 488 bp, Homo sapiens
  misc_feature 7: n = A,T,C or G
gaatacnaaacttaaaaacacattcatttagatacctttactaagataaacaattaaatttaatttaattttatccagtttgctttgtatattgcaaatctttgctcatcaacatggattttggaagtatattttatatgtgccatatgttttctgcatattagccagttgttggtgtattaaaagtaaggttaaaaaactcaacctgtttttaggtttattgtatatattaaattacttttcacatatttgattgttttaataactctatagcatttttaacaggaataagtagctaccgtagggaatttggaaaatatataaaagtgtaaattaaatgaaaatatgaggtattcacatttcctgccaatacacgtaatcgtatcattgcatgtccttttgttccttttctctatacaagaaaaatatattggccatgcacggtggctcacacctgtaatcccagtgctttgggaggccaaggcggg

SEQ ID NO: 24565 - DNA, 377 bp, Homo sapiens
  misc_feature 270, 283, 298: n = A,T,C or G
tgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatntgtattaaggatnaactggaaaaaatgngtctcagtgctaattcttggacctttaatacagtgtgcttatctgttacggcctccttttatctctcttctccaatttt

SEQ ID NO: 24566 - DNA, 269 bp, Homo sapiens
  misc_feature 3, 9: n = A,T,C or G
aantcggcntttggccggggggaggccaaggtgggtggggctcacttgagcccaggagttcaagaatagcctgtgcaacatggcaaaaccctgtctctacaaaaaatagaaaaattagctgtgcgtggtcatgcaggcctgtggtcccagccactcaggcggctaaggtggaaggatcatctaagtctggggcagttgagactgcagtgagtgagccatgattgtgcctctgcactccagcttgggtgacagagtgagaccctatctca

SEQ ID NO: 24567 - DNA, 476 bp, Homo sapiens
  misc_feature 459: n = A,T,C or G
gatattaaaatttttgaaatcactactgttacctgttatagaaaatagtgttggcttagtctagtctctgtgtaactggttacattttgatggttgtctatactcaactggatatgtgtatgtaaattagaaaatacatacctatccagacataaatgctaagtaacatttttttcttcctccaactacataatttgtagctcatcatttttccttaatcctttcctaacttgttgcagcagtttgaatttcccagatatttatgtttgaacataatggctcagaatacatatttgaacatcatagttgtatatatttttaaagtagaataaataatggaaagcaacttgatatacaagtttatactaaaatttcaactgtgtgaagatacattttaaggcattactttgctaataatctacacattcttttttctattaaataaacaaatggtttggnggttcacagctttcatc

SEQ ID NO: 24568 - DNA, 290 bp, Homo sapiens
gatggtaggttacgcctgtaatcccagcaatttgggaggtcaaggtgggagaattgcttgagtccagcaatgagagattagcctgagcaacatagtgagaccccgtctctacaaaaaataaaaataaaattagccagatatggtggcacatgtctgcagtccctgctactcaggaggctgagaatggaggatcgcttgagcctaggaggcagaggttgcagtgaactgtgattgtgccactgcactccagcctgggtgaccgaacatgacccgaccctgtctacaaaaaa

SEQ ID NO: 24569 - DNA, 469 bp, Homo sapiens
aaggcatggcggggacactgtgaatgtcagcccagaaggtgatcagagcctgttaattaaaatgggaagaagacagaagggaaggtagacatcaggttctccctggagacttttcgttctcatttacgctgcggaaactgacgtttttgcctaacaccccatgtaatgtaaacgtataggcttgagtacgtgtccggccgcatgtgtagtgaaccctaaagctttcctaattgtagttagcatcgtccctaagcggaacgattttccgtgaacatgatttgtacttttctacgagccgtacagtatacggagaagctgcacaggtcctcggcaaagcgattgcttttgccatacatcgtgcttaacaaagcgtgcttgaagactgagcccagtttgagatgtgggcttcaatatcaaaagaaaacgctgcgacctagatgtattctttggagtcacccagaaaaccatc

SEQ ID NO: 24570 - DNA, 384 bp, Homo sapiens
  misc_feature 6, 11, 12: n = A,T,C or G
aacagnaaaanngggcactgtggaaattctaacaacaaatgtgaagtaattccagaaagcaccagtgcagtaacaaacattccacaggtgcagatggttgccatacaggtatcttggaacataacacaccaagaagtcaatactgagccatataatccttttgagaaacaacaaggggaaatttcacggattgaaaaggagtaccaagtattacaagaccaacttaaagaagcgtatgaaaattatgagcagataaaacttaagggcttagaagagaccagggacctggaagaaaagttgaaaaggcacttagaagaaaacaagatatcaaagacagaattagattggttgcttcaagatttggaaagagaaattaaaaaatgg

SEQ ID NO: 24571 - DNA, 464 bp, Homo sapiens
  misc_feature 274: n = A,T,C or G
caataagtaagttctttactgcttttctactgctactttaaaaaaaaacaacaacaacaaataaaactctcagagtctggaggcttatcagtgcacctgccacagttaatttctgtattcttttcatacattccatctgacacataagagtgcactataatggcttgcctagaactggtaagaagtggtctgtgaatgtatattgaaaaaatgtgggttcataagtaaaagcgtaacgcagatatttgtgtattctgtattcacagcgtaggcngccttttgctttaaatgcatattcatgtatctttgtgtgctaagaatgcatgttagcccttttgaaaagtaggcactattcatacacagtagcttcttggaattaactcatctttgttaacttagtggcacatagtccaaatttttaaaaagcaagacccttgaatatgccaagagaaaatctaagctag

SEQ ID NO: 24572 - DNA, 461 bp, Homo sapiens
acggaaggagcggcggcgacggaaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggaga

SEQ ID NO: 24573 - DNA, 472 bp, Homo sapiens
tggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaattaaagatggagactttaagaacctgaagaaccttcacgcattgattcttgtcaacaataaaattagcaaagttagtcctggagcatttacacctttggtgaaagttggaacgactttatctgtccaagaatcagctgaaggaattgccagaaaaaatgcccaaaactcttcaggagctgcgtgcccatgagaatgagatcaccaaagtgcgaaaagttactttcaatggact

SEQ ID NO: 24574 - DNA, 499 bp, Homo sapiens
  misc_feature 7, 35: n = A,T,C or G
tcggccntttattggcccgggccagagcccccganttaatacccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagttttgaagtggaaaactggaagacagaagtacgggaaggcgaagaaaagaatagagaagatagggaaatttagaaagataaaaacatacttttagaagaaaaaagataaatttaaacctgaaagtagggaagcagaagaaaaaagacaagctaggaaacaaaaggctaagggcaaaatgtacaaacttagaag

SEQ ID NO: 24575 - DNA, 471 bp, Homo sapiens
  misc_feature 281, 464: n = A,T,C or G
acggtacctgaaaacaacgatggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacncccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttntagaatc

SEQ ID NO: 24576 - DNA, 447 bp, Homo sapiens
attacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaacac

SEQ ID NO: 24577 - DNA, 472 bp, Homo sapiens
  misc_feature 5, 31, 428: n = A,T,C or G
gagtncgagtggagagagcgagctgagtggntgtgtggtcgcgtctcggaaaccggtagcgcttgcagcatggctgaccaactgactgaagagcagattgccgaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgnaagaagttgatgaaatgatcagggaagcagatattgatggtgat

SEQ ID NO: 24578 - DNA, 233 bp, Homo sapiens
  misc_feature 3, 11, 35, 229, 233: n = A,T,C or G
aanctcggccntttattggcccgggctttgaaganagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggngctn

SEQ ID NO: 24579 - DNA, 377 bp, Homo sapiens
  misc_feature 73: n = A,T,C or G
gctgaggtaggagaattgcttgaacccagaaggtagaggttgcagtgagctgagatcgcaccactgcactgcngcctgggtgacagagtgagacaccctccccaccccctcacgcccccaaaaatgttagaaactcccttaatagtaaagtattggcattagctcacaatataatgtggttaaagcaaacaaaatacattgtgacataaatatgaataaaaaatgtaggaaactcgagattatttttccattgtccttctcacttggtcagacccttacatgagctttgtttctagttctctgtgctaccgctaaagaaggacgtggaaaagttggagaaagttcggaagaggaccacaaagataattaaagggttg

SEQ ID NO: 24580 - DNA, 287 bp, Homo sapiens
  misc_feature 8, 255, 278: n = A,T,C or G
caaagagntaagagaaacgattcagttctgtagactagagaactaaaggaaagtatgaaagcaatgtctcatcaaatagagaatatcaataaagagatagaaaccataaaaaggagtcaaatagaaattctagagttgaaaagtatggtaactgaaatggaaaaattattagaggttctcaatggcacattacagcaggctgaagacagaatggggaacttgaaggttaattgagattgttgactctgaggaacngaaattaaaaatgaatggaaggngatggatct

SEQ ID NO: 24581 - DNA, 442 bp, Homo sapiens
  misc_feature 442: n = A,T,C or G
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggagggaaggaaagaacttgatgttggtgaaggaan

SEQ ID NO: 24582 - DNA, 217 bp, Homo sapiens
  misc_feature 5: n = A,T,C or G
gtaanataggtgccctgccgcctgctaacagaaagacaaatccactccactcattttcagatttcagaggttggtggtagtattttcaaatatccatttgataagagaagcagaggcagatctttgcttttttggcatatgtctaccacagccttacagtggatttaaagtacagaaagtaatagttcttttaaccctctacaacttgtgagatcag

SEQ ID NO: 24583 - DNA, 480 bp, Homo sapiens
  misc_feature 20: n = A,T,C or G
gactgatctgttcttgagcngatattagttgggtggcgaaaagtagctatctggagtcgcgggatgtaaaaacaaatatttcatggaaacgtctaaagaaggtaggatctttattttctttgaatctgatagatatttttggctgctgacctagggaatgattctactctatcacatctgatactatgatacttactgagtagactcagattttgagtaatcataccttgactgtagttgtcatatactctgaaagaaatttatatatcaacctgaaataattggttgaaaccctttgctcaggtactttttaaacttcgtaattatggaaatttgttttaagaaatgttcagtgctgatacatcatctttctgagaggatgtaagttctgtctgtgatcaatgtgaagtaaaaagagttacagccttttttgtaccattttatccctgaatacttacctgtattttaatcctgaagtat

SEQ ID NO: 24584 - DNA, 113 bp, Homo sapiens
gaggatgacgagcatgagtaaagaaacaatactgcattagaaaagtgaggccttcagaggagatgctggagctggaaaaggagaggagagagctcatccgcagccaggccgtc

SEQ ID NO: 24585 - DNA, 471 bp, Homo sapiens
  misc_feature 322, 452, 461: n = A,T,C or G
aaacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccanaactaccactggcaataaagtttttggtgccctgaagggagctgtggatggaggctttgtctatccctcacagtaccaaacgattccctggttatgattctgaaagcaaggaatttaatgcagaagtacntcggaagcncatcatgggc

SEQ ID NO: 24586 - DNA, 474 bp, Homo sapiens
gaaacaggaatgatttctccttaattgcttaaggccggggagcaaagtgtcttaacttctgtctttgactttcccagcgttgagtcatcaacactttgccaattagctcatggtcctggcaacctcagaaacccctgaagttttaaaaactttctcgctccccacgaccccagaatgaaacagctttaaaaatagccttaagcaaaaggatgttatttcattaaatttggtttaatggaaagaataaaagtaaatgaaaaacacaccctacacactagactccgaacactggtaatcagtactgcatagcaaactctttgggaaagaaaacgaaaatgttattgcacatgtaaaatatgaaaacttaactctgctgtgtgttaggcaatcctgtaatcttttttgactcttaaaagaaattcatttctgaaatgcttggttggaagactgtgacaatagctcatgaaattgagt

SEQ ID NO: 24587 - DNA, 354 bp, Homo sapiens
  misc_feature 349, 353: n = A,T,C or G
aggagtctcaagctggagcactactgaccctgccttgggccttgctgctgctgacccaactactgagctgagaccactgagtaccaggggctgggctccctgatgacacccaccctgtgccatcaccataacctctggggaccccaacctcagaggcagcttcaagtgccttttgctgtcttccccaccgcagtcaccaccacccgaaatgccacgtggtcactgtgcactgccctgttcatgtgcctctgcggggcagggccttcctggttttgtacactgctgtacccagatgcctacaaaccattccctgccacatacaggtgctcaataaacacttgtcggagcngaana

SEQ ID NO: 24588 - DNA, 474 bp, Homo sapiens
gcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatgggaatttgggcacctgtttcccccacctactccaatatttgctggagga

SEQ ID NO: 24589 - DNA, 459 bp, Homo sapiens
  misc_feature 203: n = A,T,C or G
attgtatatatggtcttaagtgcctggcctccttatccttcagaatatttattttacttacaatcctcaagttttaattgattttaaatatttttcaatacaacagtttagggttaagatgaccaatgacaatgaccacctttgcagaaagtaaactgattgaataaataaatctccattttcttcaatttatttcagtgtantgaaaaagttgcttagtatttatgaggaaattcttcttcctggcaggtagcttaaagagtggggtatatagagccacaacgcatgtttattttgcttggctgctgttgaaaaatagaaattagtgcccttttgtgaccctcttcattccaagattgtcaattaaaaatgagtttaaaatgtttaacttgtgatcgagacctacatgcatgtcttgatattgtgtaactataatagagactctttaaggagaatctt

SEQ ID NO: 24590 - DNA, 472 bp, Homo sapiens
  misc_feature 24: n = A,T,C or G
gctcttttccgtggcgcctcggangcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaataaggtttccccatgaagcagggtgtcttgacccatggccgtgtccgcctgctactgagtaaggggcattcctgttacagaccaaggagaactggagaaagaaagagaaaatcagttccgtggttgcatttgtggatgcaaatctgagcgttctcaacttggttattgtaaaaaaaggagaagaaggatattccttggactgactgatactacagtgcctcgccgcctgggccccaaaagagctagcagaatccgc

SEQ ID NO: 24591 - DNA, 245 bp, Homo sapiens
gtgcaaaatagaaaagagtgtaggaaacaagagaagagaatagaagaaggaagagaaaaatgaaagaaaagaaagaagagagggagatggagagagaaataagagagaaaagggaacgggagaaaaaagtttgaaagaaggagagagaagactggagaaaatgaagagatggagagagaaataagagagaaaagggaacgggagaaaaaagtttgaaagaaggagagagaagactggagaaaatg

SEQ ID NO: 24592 - DNA, 487 bp, Homo sapiens
ccttatggccggggagaaaacgcaggcaaacctgaggtcctcagaatggcgggcacaggtttggtggctggagaggttgtggtggatgcgctgccgtattttgatcaaggttatgaagcccctggtgtgcgggaagcggctgcagcgctggtggaggaggaaactcgcagataccgacctactaagaactacctgagctacctgacagccccggattattctgcctttgaaactgacataatgagaaatgaatttgaaagactggctgctcgacaaccaattgaattgctcagtatgaaacgatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaac

SEQ ID NO: 24593 - DNA, 239 bp, Homo sapiens
gaggctgaggcaggtggatcacctgaggtcaggagttcaagaccagcctggccaacctggtgaaatcgcatctctactaaaaatacaaaattagccaggcttggtggtgggcacctgtaatcccagctactctggaatctgaggcaggagaatcacttgaacccgggaggcggaggttgcaagtgagctgatatcacaccattgcactccagcctggacgacagagtgggactccatct

SEQ ID NO: 24594 - DNA, 474 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaaagttgtaggtgattaaaataattttgaaggcgatcttttaaaaagagattaaaccgaaggtg

SEQ ID NO: 24595 - DNA, 489 bp, Homo sapiens
gatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatct

SEQ ID NO: 24596 - DNA, 445 bp, Homo sapiens
cattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctgtgttttttaatataagctttacaaaaaaaagatgcattcccttcctgttcacactcttaccatgtttttgttcttccttaagaatgattgtgtg

SEQ ID NO: 24597 - DNA, 413 bp, Homo sapiens
  misc_feature 3, 9: n = A,T,C or G
aantcggcnttatggccgagatgaaagcacaagcgtaccaaacgggcaaggacatctctacaaattactatgcgagtcagaagaaaacatttgaaattaatcccagacacccgctgatcagagacatgcttcgacgaattaaggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtggaagaagagcctgaagaagaacctgaagagacagcagaagacacaacagaagacacagagcaagacgaagatgaagaaatggatgtgggaacagatgaagaaagaagaaac

SEQ ID NO: 24598 - DNA, 432 bp, Homo sapiens
gtgggaggagtgggtttaaggggaaaattgggggtttctttttagatttgctaagtggagatgctggaccagcagatggatatataggtttggaattcaagggagaagaccagcctggagatgcagatttgggagtcactaatgtagaaacggtgtttatgtacttgagattgggtggagtcacctgagccagaagtgaatagagatgaagtagagaggtctgagcatgagctgggcagaatcttccagaattctctgacacagaggattgcactcccctccgtggtcagagacgacgcaggagaccatgaggtatgaagaatgaaatcaagtagggaagcccagccctagcagacatgttgaatggacaaccggcatgttgattttctgttccatgttagaggaaagaaaaacaaaaatatttttaaaagc

SEQ ID NO: 24599 - DNA, 488 bp, Homo sapiens
attgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttg

SEQ ID NO: 24600 - DNA, 249 bp, Homo sapiens
ataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 24601 - DNA, 280 bp, Homo sapiens
  misc_feature 279: n = A,T,C or G
gagagcctgttattctatggagaacccctccaaaatccaacaacatcattaaataaatcttaatttaagaatagtacaacatagtaaattttaaatcctaaagaaacagaatagaatataaatgcaatatactgtgtttatattcattcacatgtacatgcatgcaaaaaaataaatttgcatccttagatatttaattttccatagacatctacccatgtgaactttattttatttttcttgttttcatttttctttctctactttaactgacataant

SEQ ID NO: 24602 - DNA, 325 bp, Homo sapiens
atcacgcccaagcaatagttaaacatctgaaattcatgagaagaatggatcagtatggtattgagaccattctgttttttctgggccatgttaatttgtcaccatgaagattagaagcacacactcttgctggccccacttaaagtctgctgtttatctttggctcttatttgtgcaataaagacaacaaataatctaaaaaatagtgttgggtgcagtagctcatacctgtagtcccagcactttgggaggccgaggtgggaagaacacttaagcccaggagttcaagaccatcctaggcatacatagggagacctggtctcta

SEQ ID NO: 24603 - DNA, 385 bp, Homo sapiens
caagcatgcattgttgagccctttgaaaccggtatttctggatcttcatatttgaatgatccaatacaataactactagccacatgtggctattgggcacttgaagtgtaactttagtcaaagtgagatgtgccatagagtgtaaaatacatactccatttcaataaataaaaatatcttattaataagttttgatattagttacatattgaaataatattttggatatattgggataaaatatatttaaaataattttcatctgattcttatttatttattgttaatgttgctcacaaacgatgtaaagttttatatgtggtttaaatctgtgattcacattctatgtctactttatggctcaggcctagatgtctcgtgagtg

SEQ ID NO: 24604 - DNA, 117 bp, Homo sapiens
  misc_feature 6, 77, 80, 90: n = A,T,C or G
atttanaagaattaatattcatattaacacattgctctcaaattattgggaattaacatccttgtaaaaactgggancangccaggtacngtggctaacgcctgtaatcctgacact

SEQ ID NO: 24605 - DNA, 280 bp, Homo sapiens
  misc_feature 2, 3, 85, 116, 208: n = A,T,C or G
anncgccttaggccgggctcatggaacacattcttccagtatttgatttatcatggtgagaccatagcacagtggcggaagtcangataccaagatatgcctgagtatgaaaattnccgccaccttctgcaagccccagtggatgatgcacaggaaattcttcactccagatttccaatgccaagatacattgacactgaacatggangcagccaggcccgtttcctcctttcaaaagtcaacccttcacagactcataataatatgtatgcctgggggc

SEQ ID NO: 24606 - DNA, 498 bp, Homo sapiens
  misc_feature 11, 17, 51, 192, 476: n = A,T,C or G
tggaccggtcnaatccnttcgcaggactaactggacaaatagtggcagcgntttcaacagctaaatataaggaactggcctgaatctgtgtattttttcaagagaggtggcatgcattcagcagtatatttataaacaggaacctgtacagaagtgccctggaagaaggcctgctctaaattatccagtgtntggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttaccctcagctatatcactgcccaacatcagaaaacctgacggctatgattactatgccttttctaaagatcaatactataacattgatgtgcctagtagaacagcaagagcnattactactcgttctgggcaga

SEQ ID NO: 24607 - DNA, 385 bp, Homo sapiens
  misc_feature 28: n = A,T,C or G
gatcctgagaattacttttaataaaatntttttttgctgttattaaaactaacctgaattgcctaaaaccaagaactctgcttgataaaataagcatagttttaggaacagccatgcagatataaattttatcaacactttatacataatttgggacttatatttaaatgtaatatttgatgcttataaaagggtaaatggggaatgcaaataaattatcaagcataataactcatcacctaacttaagaataacattatgagtgcttgtattttatctatttgagctcttctcctatctttgccgacccccccgctctctttttaatagatttgttcgaatgtagaaagacctaaaatacatatgtatccctaaagtgacttat

SEQ ID NO: 24608 - DNA, 304 bp, Homo sapiens
ctttggagcacagctgaagtatattttaaatacatgtctaatgtatatatgatcattttatatcaggagtcagccagctttttctataaaaggccagatggcaaatattttccacctgtgggccttatggtccctgtcacagttatttgactctgccgttgtagcctgaaagcagctataggaatacgtaaacaaacgtgtgtggccatgttccagtaaaactttatttgcaaaagtaagcaatgggccagatgtggccttcagactgtcgtttagcaacccgttttaggtaatagcaataagc

SEQ ID NO: 24609 - DNA, 392 bp, Homo sapiens
  misc_feature 19, 25: n = A,T,C or G
tatggccgggatacaaaanaaaaantagccaggtgtagtggcacagacctgtaatcccaactacttggaaggctgaggcaggagaatcgcttgaacctggaaggtagaggttgcagtgagccaagattgtgcgagactctgactcaaaaaaaagagttccagaaagagtaaatcggctatcttacaagggaactaaaatcaattcttagcatcaatcccaattagtagacgtaaacgaggtaatgtcttcttcctcgtttggaagcggatttattttggatcaaaaattctatacctagacgttttcagacatgaactcagaaattctattcccgtcatattccttatgaaaaaaaagttacttgaataaattctcaaacagaaaagtacga

SEQ ID NO: 24610 - DNA, 343 bp, Homo sapiens
atattaaaggaatatttcagagtataatcttgtgtctggctttagctcaacattattctgtgagattcaaccattgttactgatggttatagatgagtcattctcactgctataccccacttcattatgtagtatgccacaattatctattttgctgatgagcatttgggaggctccaattttggccataatgaacagtgctgctatgaattttcttgcacatgtcttgtgatgaacctaagtatgcatttctgttggttatagacccagaatggaattgctgacccatagcatatggatatattgaacatttagtaggtacctaacagtttttccaaggtgg

SEQ ID NO: 24611 - DNA, 130 bp, Homo sapiens
  misc_feature 5, 30, 102: n = A,T,C or G
gtaancctaagacccttactatccaacaanatctgggtcagatttcactttttgatcccagggaggaatagctctccccttgccagcttatatacccttagnaatatctatgatcccaggactgacgtgg

SEQ ID NO: 24612 - DNA, 400 bp, Homo sapiens
  misc_feature 1, 397: n = A,T,C or G
natacacgagtatgaccagctctcatttatgcatgcctagcttttatttttgttaacatctgtttctccacccagctcaccccactactccataatgataaagataatggattttttatcatttttagttttgattttgcattgggggtggtttactctcttttgtatatgtaggcatgtgcttttcctaagagctttgcaaataaactttttactgtaactttttcagaattaatatgacatgttaatgattattagatctcatctatccttggggtacatgggagtcgttccaagagatacacaagcagatatagtttattgacctaagttaaatgccatttccagggtaaataatatgaacaaacaataatcaaatgcctttacatttaaatgnagg

SEQ ID NO: 24613 - DNA, 473 bp, Homo sapiens
gacataaatgatacagaaccggtgacaatgattttcatggggtatcagcaggcagaagacagtgaagaagataagaagtttctgacaggatatgatgggatcatccatgctgagctggttgtgattgatgatgaggaggaggaggatgaaggagaagcagagaaaccgtcctaccaccccatagctccccatagtcaggtgtaccagccagccaaaccaacaccacttcctagaaaaagatcagaagctagtcctcatgaaaacacaaatcataaatccccccacaaaaattccatatctctgaaagagcaagaagaaagcttaggcagccctgtccaccattccccatttgatgctcagacaactggagatgggactgaggatccatccttaacagctttaaggatgaagaatggcaaagctgggaaaaaaggtgatctaaagagttgtaccacctatataaacatcctttg

SEQ ID NO: 24614 - DNA, 353 bp, Homo sapiens
  misc_feature 12, 351: n = A,T,C or G
atggaccggggnacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgatnac

SEQ ID NO: 24615 - DNA, 236 bp, Homo sapiens
gttgaaataaatttataaataagtgcaaaaccactctatccttagggcaataatcagttgcattccacttaataactaatttttatttttatgatcaataataatgtacatcattttctgttttctggagaaaatgcccatttaaaacacttgtgtttttttcttataatctctcctccttgtgattatactaatctcaaagaaagaatattcttgattaaaaatattgctagttt

SEQ ID NO: 24616 - DNA, 102 bp, Homo sapiens
  misc_feature 15, 24, 51, 86: n = A,T,C or G
catatcaagaactanaaaatatanattatccctaagtcaagggcccccatnagaataaaatttcttattaaggtcattagatgtcnttgaatccttttcaaa

SEQ ID NO: 24617 - DNA, 500 bp, Homo sapiens
  misc_feature 3, 11, 42, 419, 489: n = A,T,C or G
acncgggaatntcggcctttattggcccgggatctctgagcnattatcctcattagtgaaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgccccctgcccccagggctcttcanaaagcatctgcatgtgaacaccatcatgcctttataaaggatccttattacaggaaaagcatgagtgggnggctaaaccct

SEQ ID NO: 24618 - DNA, 320 bp, Homo sapiens
  misc_feature 316: n = A,T,C or G
gtggttatgactgggagggaggatgggagcgaggcacgtggaccagaaatacttcctagaaacagcaagtacgctgctcaaccctgcctgaactttcctgtaaacagccactgacagactgcatccctgctgggtggatcctgcgactcctagagggaatggcacttcttgtttttaattagcaaggtgaaaggtgaattaaaactagcagtttggcaagtcagtgcaagaggctgacttctgagaggcttccaggagcccgaagagaggacctccacgggagaagggagtgcgtgtgctcggtttttttttttcnctct

SEQ ID NO: 24619 - DNA, 437 bp, Homo sapiens
tatggccggggttccgttaattagtactaattaagtggatagatagaatggttttcctgtttgtccctcccatgtttaaaaatctatccaaggttcatgttccaaagtcaagcctattttaaagaaagactgagctcactagttcagtatattttattctcactgacaaaacttggggggagatgtgaatatgacctggtttagagagggtttgttaaggtttatactatttttggattgtgactattcgtcgagagtgatggtttttatctgtcttttgtacattgttttccctttctacattttgctaattatcctgtatataagtttaatatatcactttttaaaagaaaaaattctaccattttaaattcatgtttcaactcctacaaccaaatgagaaaaatcagggatgagcagctttatcccatttgggg

SEQ ID NO: 24620 - DNA, 233 bp, Homo sapiens
  misc_feature 23, 30, 36, 42, 62: n = A,T,C or G
tatggccggggtgcctcttactntcttttnaaagcnttttanaaaaatcctaggtagcctanttttaatactttaaacattattatatttgtgaaagaacttttagaacagaccttttctttttactttaaaattcctgtatttccatttttaagagtaaatttaatctccaggatttagaagtgtctttccagagaagcataatgagaaagtcagactgaggtaataagacc

SEQ ID NO: 24621 - DNA, 371 bp, Homo sapiens
gctctgattctcaaattattgaaaatgacagtgatctctttgtagacttggctgccaaaatcaatcaagacaatagtcgaaaaagtccaaaatcctaccttgaaatcctggcagaagtacgagattataaaagaagacgccagtcctatagagccaagaatgttcacataaccaagaaatcatatactgaggtgattcgagatgtgataaatgtgcacatggaagaactcagcaatcattggcaagaagagcaagagaaggcagaggatgatgccgaaaagaatgaagaaaggcgatcagcttcagtagattcacggcagtctggtggaagctatttggatgctgagtgttcacgacatagaagggatagg

SEQ ID NO: 24622 - DNA, 271 bp, Homo sapiens
accgagaacatatctaaaaaacactctgcaaacatttggtcacatgcaagttagtggtcatatgacggactgcattcaggacaagggtaaagcaatacttgctttgaagaatcacatttcgactcggtctgctgatctgaggtttttagattttaaatatttatgtggaattaattaaaggtagttggctatatcgctatcatttcattcttttgacattatgtgaatattttactggaaaataagactaataaattgttaaaagtttcta

SEQ ID NO: 24623 - DNA, 314 bp, Homo sapiens
  misc_feature 17: n = A,T,C or G
tatggccgggataaaanaataatttggccaggcacggtggctcatgcttgtaatcccagcactttgggagggtgaggtgggtggatcacttgaggtcaggtattcgagaccagcctggccaagatggtgacaccctgtctctactaaaaatacaaaaattatctgggtgtggtggcatatgcctgtagtcccagctgcttgggtgactgaggcacgagcatcgcttggacctgggaggtggaggttgcagtgagccaagatcacaagatcatgccactgcactccagcctgggtgacagagcaagaatgtccca

SEQ ID NO: 24624 - DNA, 426 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgatt

SEQ ID NO: 24625 - DNA, 137 bp, Homo sapiens
  misc_feature 73, 135: n = A,T,C or G
gaaaatgaatctgtatgcaacattatttttatttcttaatacattttgggaaacttaattgcaactgtgtggntcagggatttagtgcaagaagaagaacagttgatgggggaaaagaaaaagaaaaaagacggncg

SEQ ID NO: 24626 - DNA, 100 bp, Homo sapiens
  misc_feature 2, 7, 29, 39, 49, 57, 97: n = A,T,C or G
gntgtcncctgcgttagataggcacatgnacctgaaggncctcggtgcntgagtacncctcctgtgtagaagtccgcccacagtgacagctatgctnatc

SEQ ID NO: 24627 - DNA, 482 bp, Homo sapiens
  misc_feature 10, 30, 395, 451: n = A,T,C or G
ataattgacnatgcttttcaccttttagtnaatgttagaagcaaggggtaacttaagtcctggtgggaagaccatccattgagttctttgaaagtcaacatttttcagcccacgatagtgaaatgagagtaaatataaatgaataacaattctaacaaaaagagttttttgattcaaatccattagtttgaacttttcgagcttattatccatttccttaaatcccatagcttatcagagttaacatcagagggaggtaaaatatttctgtgatattctttgtataaaatctacactttgaaatggattagtaacctgtgaacaatacatattttagttaacatataaattatgtgagcaaagtggttttcagtggtttttttcttattttaggntttgaaacctgtcttaaactcacagacttgtagaagaaatctctaattcagtattntttaaggaagttcactttttggccctattac

SEQ ID NO: 24628 - DNA, 209 bp, Homo sapiens
  misc_feature 6, 11, 207: n = A,T,C or G
aacagnaaagngtacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacnac

SEQ ID NO: 24629 - DNA, 195 bp, Homo sapiens
cggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccacctcacagaaatgcaag

SEQ ID NO: 24630 - DNA, 252 bp, Homo sapiens
ggacatgcttcctaaaaacagaccattttccttaacttgcatcagttttggtctgccttatgagttctgttttgaacaagtgtaacacactgatggttttaatgtatcttttccacttattatagttatattcctacaatacaattttaaaattgtctttttatattatatttatgcttctgtgtcatgattttttcaagctgttatattagttgtaaccagtagtattcacattaaatcttgctttttttc

SEQ ID NO: 24631 - DNA, 471 bp, Homo sapiens
atacacgtttcactttgaaaaaaaatgcaaatcgactttttaacaactgttgagatgtttcatgggacagtagaactctgactcaccaactgggctaaattttaatttaaaaatgtatttatttgagtgtctttccccccctcaccctcaccatctgaggggctccctgagatcttggtagaggaggcccctcctgcccagaccttcgtttgtttccccggtggcccttgcttcttgctttgcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggggtaaggttctcctccactgtttgaccaaattctcagtgataaatatgtgtgcagatccctagaagag

SEQ ID NO: 24632 - DNA, 447 bp, Homo sapiens
gctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataaccagcttcagtctctactggattagccctactctttccttttcccctccattatttagtgactctgtaagtaagttaaatacacccttattatttagctggttaagtaactataatgaaatctgctgcaaaatctctcttggaatccatgtgcccaggattatattagcattatttttaataaatctatatgcttaacat

SEQ ID NO: 24633 - DNA, 421 bp, Homo sapiens
aacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaaattttgacactgaaaaacattttattaataaaggaatattgac

SEQ ID NO: 24634 - DNA, 216 bp, Homo sapiens
atgaggtcaggagtttgagaccaccctgaccaacatggagaaaccccatgtctactaaaaatacaaaaattagccaggtgtggtggcatgcacctgtaatcccaggtactcaggaggctgagccagaagaattgcttgaacctgggaggtggaggttgcagagctgagatcgtgccactgcactccagcctgggcaacagagtgagactccatctc

SEQ ID NO: 24635 - DNA, 478 bp, Homo sapiens
agaataaaaactacttttctaatctaactattttctaatctaactattttctaatctaactattttctaatctaactatatgacctgctagcagtaggtatattagcaaataataagaggaaataccgagaaaatcaatcttgctctgcatggttcaaagggaaccatcaagaaaatgaaaagacaacacacacagtgggagaaaatgcttgaaagtcatgtatcttcataggggacttatacctagaacagctaaagaagttttacaactcaatcataaaaagacaaatagctcaattaaaaatgggcaatatatttgtttgtttgaaaaattcactgtgtatatttggagtatataacatgatgttataagatatatttatatataccttaatatcattgctataacgaaaaaaaattaacatatcaattatttcacaaagttacccatctcccccaccatgttaagagcaactac

SEQ ID NO: 24636 - DNA, 407 bp, Homo sapiens
atagtttggcagttgtggaaatgctgcagtaaacatgggagtatagctatcttttgaagataatgatttcatctcttttttatatgtatacccagaagtgggattgctgcatcaaatggtggttctatttttaattttttgacgaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatac

SEQ ID NO: 24637 - DNA, 333 bp, Homo sapiens
atgcagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctataggagactgggcaaaacctgtacaatgacaaccctggaagttgctttttttaaaaaaataataaatttcttaaaac

SEQ ID NO: 24638 - DNA, 311 bp, Homo sapiens
gtatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtatatatatatatatgcac

SEQ ID NO: 24639 - DNA, 472 bp, Homo sapiens
ggacaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggggggaaaaaaggggggg

SEQ ID NO: 24640 - DNA, 474 bp, Homo sapiens
aaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataacgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgtt

SEQ ID NO: 24641 - DNA, 424 bp, Homo sapiens
catgacaaattttgaataatatgatattaaaataaaaagagaaagagctgctaaaacctggtattttaataaattagacatatggaactcctgctttatttaagaagtagacatagggctttattagtgcaggattaagcatgtagttggctaatgtcagtgaatttttcttgaatattcgggacataaaacagaaaaggagtttatacgtagtgtaattatttcttacatatgttttggtcagtaagccggtttatagagaaacctatgcttgttccttaaactgtagattaagaatataggagttattaaaattaataatacttttgtttacataaaagtaggactgcattatttagtagctgttattcagagcttagtgtgctcttttctaagaggcttcatgagtatcccgaaataactg

SEQ ID NO: 24642 - DNA, 439 bp, Homo sapiens
cagttgacacaaaataaactacgaagtggctttaacacatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaaactacgatagcccttatgaaacttaagggtcgaaggtggatttagcagtaaactgaga

SEQ ID NO: 24643 - DNA, 228 bp, Homo sapiens
  misc_feature 11, 19, 28, 30, 45, 48, 51, 57, 60, 62: n = A,T,C or G
actctccggcnatctattngcccgggantntctttcgcctttgantcntanttttcntananactacccttaagggagccttcagtgatacctaaaaagagtgtgatgctgttgtaaatttgcccattgctttcctttttgtcaatattcaaggattgtcttggaccatgggcccaagccctgaattgtaagaaggaatggtaaagcatggtaaccccattaaagggt

SEQ ID NO: 24644 - DNA, 318 bp, Homo sapiens
  misc_feature 20, 36, 37, 68, 75, 84: n = A,T,C or G
aacccgggaaactccggccntctattggcccgggannatgaaaaaacagctcattattcacctggccnttcagantaaatgccnaattaaaacccccaatgagatattcatctcaccacccagttagaatggcaatcattaaaaaagtcaggaaacaacaggtgctggagaggatgtgggagaagtaggaacacttttacactgttggtgggactgtaaactagttcaaccattgtggaagacactgtggtgattcctcaaggatctagaactagaaataccatttgacccagccatcccattactgggtatataccc

SEQ ID NO: 24645 - DNA, 472 bp, Homo sapiens
  misc_feature 422: n = A,T,C or G
gtgctttaaatgacatctgcctgggatgtaccacaaccatatgttacctgtatcttaggggaatggataaaatatttgtggtttactgggtaatccctagatgatgtatgcttgcagtcctatataaaactaaatttgctatctgtgtagaaaataatttcatgacatttacaatcaggactgaagtaagttcttcacacagtgacctctgaatcagtttcagagaagggatgggggagaaaatgccttctaggttttgaacttctatgcattagtgcagatgttgtgaatgtgtaaaggtgttcatagtttgactgtttctatgtatgttttttcaaagaattgttcctttttttgaactataatttttctttttttggggtatttttaccatcacagtttaaatgtatatctttttatgncctctactcagaccatatttttaaagggggtgcctcattatggggcagag

SEQ ID NO: 24646 - DNA, 484 bp, Homo sapiens
  misc_feature 25: n = A,T,C or G
tatggccggggactcagactcagangaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattgggttt

SEQ ID NO: 24647 - DNA, 177 bp, Homo sapiens
  misc_feature 119: n = A,T,C or G
tgcctcaatttgctaggatggcattttgtcaaaatatatgccagactacttagagtttaggagcttgataaaaatacagacaactgctccagacttactgagttagaattctagaaggnggggcaagaatctgcatcttcatattgcctaaatataaactgtgagtaccaatgtttt

SEQ ID NO: 24648 - DNA, 495 bp, Homo sapiens
  misc_feature 2, 10, 39: n = A,T,C or G
anctccggcntttattggcccggggaggcctttgaggcnagcccagccgccggggcttctgctgagggggcaggcggagcttgaggaaacccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaaggtgacttaaacagcttaaagtttagtttaaaagttgtaggggattaaaataattttggaagggcgatctttttaaaaaagagatt

SEQ ID NO: 24649 - DNA, 471 bp, Homo sapiens
  misc_feature 10, 52: n = A,T,C or G
atctcaaagnactgagtattccatttaggtttggagaccacttgtgctgtgntgcctgatatttaccaaacttgaataagtgttcgtcaacttgatagtgaatgtaccccttctcaccttatattttgattaaatcaattaactataggtcatctaccaagaatgtaatccaagcggttgataaaacattattaggcagatagattattgattattaaattttgagcagtgcaaaaacggttttgctgcttggagttcagattcagtccctcaaagagtttatgatcactgaaatacactctgaaggtattctgaagaagttaaaaaattttagaaaacgaaatgttctgtatacaaagacaatacagtcactacgaactgcagaaagtataggaaagcagtaattgatgtagagtttagacagtcttggatcttttttagagcactaaccatggatttagactcaaaata

SEQ ID NO: 24650 - DNA, 488 bp, Homo sapiens
  misc_feature 3, 443, 448: n = A,T,C or G
aanagttggaactgctgtttcttcttcgatgatgcagatctgcctccaccacctccccttctggatttggaaggacaggaaagtaaccaatctgacaaacccacaatgacaattgtatctcctcttccaaatgattctactagtctccctccatctctggactgtctcaatcaagactgtggagatcataaatctgagataatacaatcatttccaccgcttgactcacttaacttgcccctgccaccagtagattttatgaaaaaccaagaagattccaaccttgagatccagtgtcaggagttctctattcctcccaactctgatcaagatcttaatgaatccctgccacctccacctgcagaactgttataaatattacaacttgctttttagctgatcttccatcctcaaatgactcttttttctttatatgttaacantattnaaaaatggcaactgatagtcaatttttggatttttaattc

SEQ ID NO: 24651 - DNA, 474 bp, Homo sapiens
gaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatgggaggccatggggatcaaggagacccggaaatacaagaaggtctattggtattgagcctggggcagagcagctcctccccaacttctgtcccagccttgaaggctgaggcactttttttcagat

SEQ ID NO: 24652 - DNA, 467 bp, Homo sapiens
ggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttgggtaggccaagtatgctaagt

SEQ ID NO: 24653 - DNA, 469 bp, Homo sapiens
  misc_feature 2, 9, 14, 25, 26, 83, 177, 370: n = A,T,C or G
gntgctggnaaagnaaacaggttgnncacttgctgaggtgcaaaaattcttaagacttctgtttgaaattgctcaatgactangaaaagatgtaagtagtttactaaaattgtttttctaccatatcaaattaaacaattcatgcctttatagggtcaggcctacaatgaataggtntggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggntgtattgtagctattacttatacagcaacatttcttcaattagcagtctagacattttataaacagaaatcttggaccaattgataatatttctgactg

SEQ ID NO: 24654 - DNA, 481 bp, Homo sapiens
  misc_feature 466: n = A,T,C or G
gcttttttttgaggaagacgcggtcgtaagggctgaggatttttggtccgcacgcccctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggggggnaagtcaccattgcag

SEQ ID NO: 24655 - DNA, 370 bp, Homo sapiens
gtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaataccgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatc

SEQ ID NO: 24656 - DNA, 494 bp, Homo sapiens
  misc_feature 8, 14: n = A,T,C or G
cacatatngggcanttcggccattatggaccggggaaactcggtggtggccactgcgcagcaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgtctttcccatctgtctatctatctggctggcagggaaggaaagaacttgcatgttggtgaaggaagaagtggggtggaag

SEQ ID NO: 24657 - DNA, 390 bp, Homo sapiens
gggtagctgaataaggggtcagaacttctgaaaccagagatctgtaatcatctctattggcctggggtgcctgtgctataaatgagtttcttcacatgaaaaacacagccagcccaagatgacttatctgggtttaggattcaatagtattcactaactgcttattacatgagcaatttcatcaaatctccaaactcttaaaggatgctttcggaaaacacgctgtatacctagatgatgactaaatgcaaaatccttgggctttggtttttttctagtaaggattttaaataactgccgacttcaaaagtgttcttaaaacgaaagataatgttaagaaaaatttgaaagctttggaaaaccaaatttgtaatatcattgtatttttta

SEQ ID NO: 24658 - DNA, 497 bp, Homo sapiens
  misc_feature 2, 10: n = A,T,C or G
anttcggccnttatggccgaggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaagtttagtttaaaagttgtaggtgattaaaataattttggaaggcgatcttttaaaaagagattaaaccgaaggtga

SEQ ID NO: 24659 - DNA, 222 bp, Homo sapiens
  misc_feature 7, 158, 184, 200, 219: n = A,T,C or G
accgagnaaggcaaagtaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgtncaaatgattttaattattggaatgcncaatttttttaatatncaaataaaaagtttaaaanctt

SEQ ID NO: 24660 - DNA, 471 bp, Homo sapiens
attccaagtgtcctagccttctgatgacattaattacctagttgtgtcgaggagtataggatggactctcctgagaaggggaggttggtggctttgtcttttctttttgctggatcctgaactggtctagacctcctgcccccaccccccagcccccatcagatgtggctggcctttcatttgaaggcttcagacttaaagcattaagcagctagtgccctctgcagggcctggtttccccagggaagggcagcaaggaacatgggaccagaagcctgtcctcagtaatgtgactatagtgagctttagcaaaagtttttctatataatgacatcttacttatcttttaccctttcctcagttttcccctgcctttaactaataaagaattgggagacagaaattttttaaagtcctccttattcaagattttgaaattcttagcctgggagtgctggagagaacctgatg

SEQ ID NO: 24661 - DNA, 287 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggag

SEQ ID NO: 24662 - DNA, 389 bp, Homo sapiens
  misc_feature 28: n = A,T,C or G
atagtaactcggctgtcctttgaatatnactgtgttgagtagattcctctaggacctttgatttcatgagttgggcccaaaccgtggtggaataataacaaaaagaagttaaatgccacaaattttaatagtgagcttacttgaaggatttaagtaggtttaggaggtgaagaaggccgatggagaaatttacagattaattttggaagctctactctagctatcgaacaatcaaaggaatgcacctatcagctacaaagaacagctagacagctgttttttttcttttataaatgtttctgtgttgtgtcaaaatgatttctggtgatttaaactaacagataatcacagctgctgtctaaattcatagtgttgaaaattacaaaatg

SEQ ID NO: 24663 - DNA, 356 bp, Homo sapiens
  misc_feature 1: n = A,T,C or G
naactcgcattttaatgatccgctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttac

SEQ ID NO: 24664 - DNA, 264 bp, Homo sapiens
  misc_feature 16: n = A,T,C or G
cattattgagacgagnatctggttgctcaaggaccacgttatgtggtacaaataggtgacaaaattattgactacaatgaagaattccgcctctttttgtcaacaagaaacccaaatccttttattccaccggatgcagcttccattgttactgaggttaactttactacaacaagaagtggattacgagggcagcttttagctttaaccattcagcatgagaaacctgatttagaagaacagaaaacaaaactattacaacag

SEQ ID NO: 24665 - DNA, 394 bp, Homo sapiens
  misc_feature 11, 25: n = A,T,C or G
tattgcggccnatatggaccggggnatgcattttgatgctttgtgcattcatttctttctgtgctttgttggaatctggctatctgcttacagctattgaggaaactcagctttttaggagtgtttacagcctttttcatacctaaataggatgaacagtagatataaacttgccaaggcagaaatgtgttgataaatcaaaatgtgtatttgtggagggttgtgcatctcttggttgcagcttgctaaataggccatttaggaatcttctttcaatgcttttttcttgagcactgcctggggtggtgaaaaagcagagggcaagcctttgtctgacgccaaaaatgtcttcagtgaagaggccaagaggaagggtaagtgaaagcctgaatga

SEQ ID NO: 24666 - DNA, 425 bp, Homo sapiens
gagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagaccttttttgttaaataaacttttgtaatagtc

SEQ ID NO: 24667 - DNA, 280 bp, Homo sapiens
  misc_feature 201: n = A,T,C or G
gaagcaaggcaacagcaggagagagcagcaatgagctatgttaaactgcgaactaatcttcagcatgccattcggcgtggcacaagcctaatggaagatgatgaagagccaattgtggaagatgttatgatgtcctcagaagggaggattgaggatcttaatgagggaatggattttgacaccatggatatagatttgccnccatcaaagaacagacgagagagaccagaactgaagcctgatttctttgatccagcttcaattttggtgaatcagttct

SEQ ID NO: 24668 - DNA, 318 bp, Homo sapiens
  misc_feature 3: n = A,T,C or G
aanccagggaaattcggccttatggccggcatccatttattttgtgataattcctctatgtttcctaatcatttgctctttgaaaaaagtgagagcttgtgatcagtcctgcacggaagccagtacacaatctaggtattagagcagtgcattgacagagaggctaccttccattttgtgcttccaagaggtggttgtaaataggaaagtgaaaattgttaaatgacaaaaattactttgaagtaaatttctctgcctgttttagaacttaaccctagatgaagaatcagtatattttggggggcagtaatagtaaga

SEQ ID NO: 24669 - DNA, 473 bp, Homo sapiens
caggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgacccgatgttcaggacaacagcattagtgtcaagtggctgccttcaagttcccctgttactggttacagagtaaccaccac

SEQ ID NO: 24670 - DNA, 475 bp, Homo sapiens
gatttaagaaggtgtaaaagaagtctaaaggcacaatctttaggtttgtttgttacagctttcattgaacaaaaatgagaattcagaatttttcactttctactataatggcaaagagaataattgacggagaagacttttcacaattattagacaaatcagaagatcagtgcaaagagccaaatagaagcactgtaggccgtaatgatgtgggtgaaattaataatataagtgaaatctcaagactgagtctttggatgatgatactctagatcttctcaaacaccttaattttgatgagtgagcaatctgtttttaaggacaaaaaagaaacaggtattctcttccagttaatcattctgcagcaaggactctatcatgtagtagttttcagcaagaatctggaccatctcttttagctaaacgaatgcatgaccctatttcattcatcttttatgatgcttgtttatcagca

SEQ ID NO: 24671 - DNA, 116 bp, Homo sapiens
aatgggaatgcggctcaaaccacacgtttgacaggagagagacagatcgacagacctggcccacaaccagacacagaaacagtcccggggtgaaagggctcaacaacaacaacgag

SEQ ID NO: 24672 - DNA, 496 bp, Homo sapiens
  misc_feature 5, 29: n = A,T,C or G
agcgnaattcggccttatggaccgaggangcttggatgttacgagataagggctccaggttttaatgacagccctactaatgattttcttagctgtgagaatcctacatggtttaagcatagtcagatgtccagcccaaatgaccctgtgtgggcgtctgtgtgtgagcctctttgtgtgcacacatgtgtgttttataggtttaataagtgttggctaggtgcagtgacacacacctgtaatcccaacactttgggaggccaaggcgggtggatcacctgaggtcaggagttcgagaccagcctggccaacatggtgaaaccccatctctactaaatacaaaagttagacgggcatggtggcaggcaccctgtaatcccagctactcaggaggctgaggcaggagaatcgcttgaacccaggagacggaggttgcagtgagctgagattgcgccattacactccagcctgggcaacaagagtgaagctccatctc

SEQ ID NO: 24673 - DNA, 466 bp, Homo sapiens
cattccactgactaactttggtgttttgtttccaagttaagtgattcctcctttttttttgttcaatgttaaatttaaaaataacaatgtgtatgggtcctcccatgtgtaatatggtaacatgtaacttgcagtgtttgccagctttcaaagcaggctttgtgaaaatgtaatacaaacagcagtgaatgggactcaaatgttgtgcttcctataaacagctccgctctttcagggaaggatggtaacaaactagaaggacaaatatgtacgtatttataacgtattaaaactcttttaagtagcttaaggtattgtgcaatggcctagcctagtagaaatgggggaaaagcattgctgtggaccattgttaaagtgacaggagttgtagggttacccctttgacaagcttccatagtcttcagacacgcacattgatggcatccctacagtcttcttcacttga

SEQ ID NO: 24674 - DNA, 497 bp, Homo sapiens
  misc_feature 14, 77, 188, 237, 240, 251, 278, 322, 334, 381, 398, 408,423, 442, 493: n = A,T,C or G
atggcccggggaancttctggggtaagtgatgctcccacctcggcctctcaaagtggtgggattacaggcgtgagcncccgcgcccggcctccatgagtctgatttataacccatgtcttttgtatttctcagtccttgtccacacatctcatcacacacgtgcgcagaaaacaggcacacgcagtgngaacccaggcacagctctccgagagaactctagtcaacacgtcgtccgnggnacatcggctgnttttctgcccctttccttcttttctgnctctttctcttattccccaaaactccgttgtgtttctgatttgnccacatcgtttncggcaaaaggaaaacacaatggtaagggggggggtttataaattctntcttcgttatcaagggnaaaattgaancggcttggaaacaanatgaaatttaacttgtgcncgggacacacccgtcaacaaaaccctaataagtgcaaaaagacttgtttancagg

SEQ ID NO: 24675 - DNA, 403 bp, Homo sapiens
caatggaaattattacaagcagattaatccctctttttgtgacacaagtacaatctaaaagttatattggaaaacatggaaatattaaaattttacacttttactagctaaaacataatcacaaagctttatcgtattgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggcttaagggt

SEQ ID NO: 24676 - DNA, 264 bp, Homo sapiens
gcaagaagaacagaactaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactac

SEQ ID NO: 24677 - DNA, 477 bp, Homo sapiens
ggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatgggaagaagtcacttggagccagaagagagcccgggaaagaggcatgtccaaaccaggggcccttcagcttcagacaagcccagcca

SEQ ID NO: 24678 - DNA, 288 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtggcatgaggaaggaaaagataaaaggtttctaaaacatgacggaggttgagatgaagcttcttcatggagc

SEQ ID NO: 24679 - DNA, 405 bp, Homo sapiens
  misc_feature 8, 17, 36: n = A,T,C or G
aaccgggnaattcggcnttatggccgaggtaaaagntaacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaaaaaactaccgaatccaaaataacagctacaaccacacaagtaacatctaccacaactcaagataccacaccattcaaaattactactcttaaaacaactactcttgcacccta

SEQ ID NO: 24680 - DNA, 500 bp, Homo sapiens
  misc_feature 12, 13: n = A,T,C or G
tatggaccgggnntagctttatttttctggacaaaaagttgcttttagaaatactttacttgttgaagttgttttactatcaaagcatacctattagcttttgaagggagtcctcctgtaaaatttataggattaaaagttttcatgtgcttgtgactaattatgaggtttatagtggtttacattttgagatagttatatatataatatgcccttttcttttgtgacattatacgtatttttttatattgcatttaaaattaaatgacttgcttttgccagattaaatacagataccattggggttttctgttttgattcctaatgataatatggattgatttcaggtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatg

SEQ ID NO: 24681 - DNA, 469 bp, Homo sapiens
  misc_feature 95, 146, 367: n = A,T,C or G
acataaataaacaaaatggagaatagaaagcaatagagggaatcaatgcaagttgttttttttttgaaaagattaagaaaattaacaaaccgttntccagactaaaaagagaaaatactcaaataactaaaatcagaaatgaaggnggagacattacaactgatgccacagaaataagaaatttaaaggatcgtaaaagactactaggaagaattatgtgccaacaaattggataacctagaagaaatgaataaattccttgaaacatacaacctactgaaactgaatcacaagaaaaaaattaaacagacctataactagtatggagattgaattaataatgaaaaaccttccaacaaagaaaagngcaagaacagatgacttcactggaaaagtctaccaaacattgaaagaacaattaacaaactccaaagaattgaagaggagagaaaacttccaagctcatttt

SEQ ID NO: 24682 - DNA, 478 bp, Homo sapiens
tatggccgggggcccttcaaaccctgaggtccatactatttattaccattacaaatgtttcattaagttcttcctgatcagtgctggtttgaaaattctatgattttactcacttgtgtaatccacagtgaaggtcagcaaaattctcaatactactgactaagaatttagaattatggttatctaaagaacttgctttgcttgatctaaactagaaatatttaaaatttcaaacaattatttgtgattacagaaatttctcagatttcatgcagttcttctagagctctatctgtggaagtataggttgtgagtacatttatacttaagcagaattactcataggaaatggtaaggtcagccaaacacaatggctcacatctataatcccagcactctgggagaccaaggccagaggatcagttgagcccaggagtttgagaccagcctcagcaacatagtgagaccctgtctgtac

SEQ ID NO: 24683 - DNA, 416 bp, Homo sapiens
  misc_feature 16, 132, 218, 310, 359: n = A,T,C or G
gaggcattgaggcagncagcgcaggggcttctgctgagggggcaggcggagcttgaggaaaccgcagataagtttttttctctttgaaagatagagattaatacaactacttaaaaaatatagtcaataggntactaagatattgcttagcgttaagtttttaacgtaattttaatagcttaagattttaagagaaaatatgaagacttagaagagtngcatgaggaaggaaaagataaaaggtttctaaaacatgacggaggttgagatgaagcttcttcatggagtaaaaaatgtatttaaaagaaanttgagagaaaggactacagagccccgaattaataccaatagaagggcantgcttttagattaaaatgaaggtgacttaaacagcttaaagtttagtttaaaagttg

SEQ ID NO: 24684 - DNA, 365 bp, Homo sapiens
atgtgggggacagaacagtagtcctggactcgaagggaaggtgctgaccagtggggccttagcaatttgaagggttgggaaggaggaattatatttgcaaaggggctgtctattagcatatttcctttgagggggcaaaaaaaagtgccagtatcgacttttacagattgtggccagtgaggatattataatcctatgtaaacagaaaagtcccacttaccgattcattctttcactgtttgtatctgcgcccagaattctcagtgacgtgggggtgagggttgggtggcgattgccttagagggaacccctaaattggttttggataagtttgagcccttgaccttaatttcattgctaccact

SEQ ID NO: 24685 - DNA, 493 bp, Homo sapiens
  misc_feature 12, 17: n = A,T,C or G
ggggggggggcnaaganggaccggggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttggggtctggacaaagtgccaaaggatcttccccctgacacaactctgctagacctgcaaaacaacaaaataaccg

SEQ ID NO: 24686 - DNA, 500 bp, Homo sapiens
  misc_feature 9, 10, 370: n = A,T,C or G
ctccggccnnttttggccgggggattttgaagaaacctcataaagtgtttaaataagcaattatatattgtattctcttggaacaaataaaagttaaaattaaaaataaattcaataatgacttataagttataaaaagtaaacatgaactaaataaaattaaaatacaataatggaaataatagatgcagaggatggtcacaaaagaagagagcacagagcagaagatggaatcagtgaatctgaaaacatgccaacagaatttactgtctgaacaagaagaagaaaaccgataaaaaaaaatttaacagcatttcaggaaactttagaacaataataaaagagctaacattcataatcacaggagatntagaagacgaggagatagaatgtgggactaaaaaactattaaaaaataatgacttcaaccttcccaaattagatggaagacataaacctaaatattcaagaaacagagcaaaccctaaatagaatacacc

SEQ ID NO: 24687 - DNA, 476 bp, Homo sapiens
gcttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggattatgttccttttttgttattacttttaaataggtcctgaaat

SEQ ID NO: 24688 - DNA, 251 bp, Homo sapiens
  misc_feature 12: n = A,T,C or G
gcagtgagagangcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaatcctgtcttgttcataaattgacaatgtcaataaattgaaatatggttcactgtt

SEQ ID NO: 24689 - DNA, 498 bp, Homo sapiens
  misc_feature 1, 23, 26, 29, 41, 48, 68, 452: n = A,T,C or G
ntgggccggggtgggtgggtccnaanctntaactggaaccnaaagagnccagtacttttgcaaagaanaaggatcacctgccaggtgcacctggaaattgctacagtttagtccgcatgatctctcctgaaggaggaagccctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcaagtgtggctttggacaggaatatnttgaaattaaatcactgccatacagggtttttccaatacacaagtg

SEQ ID NO: 24690 - DNA, 490 bp, Homo sapiens
  misc_feature 4: n = A,T,C or G
agantgggatggtagaaaaggaaagctttaaaagtttttgagccaatgaatgacatcatacaagttctatgagcaatgatttcaggatgggagagaatggcatcaggaagacccacttgaatgctggtaagtaatgttactaacagtgccattagtaacattaatgttactagggcctggactgatatgctgatggaagtgagaatgaagaataaggtgggatgaaagagattttgaaagaggttttaaagaacctgaaatgggaatgggagagattaactaagcctgcttgccatggacagcaatggggttgcctagaagattagctgtggggaaaaagttatgcatttacctttgggcataattaaatgcaattgactctccatattcatgggttctgcatccactgattcaaacaactgtggaacaaaattgtcagaaaaaacgatacaacaataaaaaatgatacaaataaaaaacagcatggtat

SEQ ID NO: 24691 - DNA, 317 bp, Homo sapiens
  misc_feature 3, 8, 30, 37, 47, 48: n = A,T,C or G
ctnaggtntttaagaggtctcttagttaantggctanttggaaaaanncttgattttttaaaaaatgtgctgtaagtaatgtacctcatggcattcttttttgattccttaaaaagctgtgtaaaaacccagaattttaaggagtttcttaaagaatgcttttagacatattatatctacttccctattttattgactataatttattttgtaagcattagtctttcaaagaaagaagactttctaccaccatggtctaagagtttggtcacttttctgagggattgctgagatcttgcttgtaatagtagctcccc

SEQ ID NO: 24692 - DNA, 101 bp, Homo sapiens
  misc_feature 2, 22, 34, 35, 37, 40, 47, 56, 64, 68, 73, 77, 80, 81: n = A,T,C or G
tntatggaccggggaatatctngcagttctaatnngngantaggganaccttgtgncgcataanttanttatnatgnganntatgcacgacaaaatcactc

SEQ ID NO: 24693 - DNA, 450 bp, Homo sapiens
ggtccttagaaacctcaagcaactccatggcatgccgctcgtttggggcaaagccatacccctttcaggccaggtctgcacaaactcagtgttcttggtgaggtgcccatggtggtggcgactgagcctgggctttctccttaccccatcattacctgggcccttgctgagaccccagtcatggggtggcacagagccatggctactccttttcaatctcaatgaaagtcttataagaatcctagctggtttctttatagaaattgacaagctaattgtaaagtttatattagaagttcaatgggtgcagaatagataaaacaaccttgtaaaagaagagcaaagttggagggctcacacttcctgatttcaaaacattattgcaaagcaacagtaactaagacagtgtggtagtagcataaggataagcagacagatcaatggaattag

SEQ ID NO: 24694 - DNA, 475 bp, Homo sapiens
catctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttacctgtgatattttaaatatccacagtactcactttttccaaatgatcctagtaattgcctagaaatatctttctcttacctgtaatttatc

SEQ ID NO: 24695 - DNA, 277 bp, Homo sapiens
  misc_feature 2, 3: n = A,T,C or G
annttttttgtaaagatgatggggtcttgctatgctgctcaggatggtcttgaacccgtgacctcaggtgatcctcccacctctgtctcccaaagtgctggaattacagatgtgagccactgcgcccagcctggtttggtagtttcttaaaagtgaaaattagacctaccatgtgacccagccattccactactaggtgtctacccaagaaaaataaaagcatgtttccacacaaagacttgtatacaaatattcatagcaactttatttggaatag

SEQ ID NO: 24696 - DNA, 486 bp, Homo sapiens
  misc_feature 18, 368, 417, 418, 481: n = A,T,C or G
gaggcattgaggcagccngcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttanattaaaatgaaggtgacttaaacagcttaaagtttagtttaaaagttgnnaggggaattaaaaataattttggaagggcgatcctttttaaaaagagattaaacccgaagggngattt

SEQ ID NO: 24697 - DNA, 465 bp, Homo sapiens
gacagccttccactaacatcccgtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctcttttttttctgggaggctggcacctgatttttgtatcccccctg

SEQ ID NO: 24698 - DNA, 317 bp, Homo sapiens
  misc_feature 10, 38, 39, 125, 140, 182, 218, 219, 288, 307: n = A,T,C or G
aatgaagacngacctttctcggtaatatttggagctgnncctatgttaaaatttaaagatttgatatacatggagcgtttcttctcgacaccaaaactttcatgtgttccaacagggtgcttacntatcctgtaaataancaacttgaaagtgcctggaaaattgcaccactgtgctttggnttgtacttttttaggtaaatctatatgctgaaaagnngagctcaaaaacagtagttcaatttgcttaattattgcttaaaataatggtactatgtaaaattggatnatggactacaataaaaggnaaaacttatt

SEQ ID NO: 24699 - DNA, 117 bp, Homo sapiens
  misc_feature 9: n = A,T,C or G
gtaaacagnacacattttgctatctgtgtcatcaggatagtgtaagtggtagggtagagactaccctagacatctgcatctttgtaagttagccagacaataaagaaaagccgaatg

SEQ ID NO: 24700 - DNA, 466 bp, Homo sapiens
  misc_feature 12, 13: n = A,T,C or G
aactccggcccnntattggccgggggttttgtgtaattttccaaatttttgataacaaatattatgtaccaaatttttttcaagatacatacattgttagaatttatcataaaatgaaatataaatcacagctctactaactcatatctcatctatgattcaaattgcagaggccctgcttttgcaataaaggctacttttgaagacaaatgtaattatagccaaacaacatttctagggttaagttagagaaagaagaattttatcttgacttaattcagtttctacaagtcaaggaaactgaattaatgtttctgccactgaaacaaaaccagatcagttgtattttgtagtattggagaatgtttattccttcctgagaaataaccaagatatgttttggatgccagtgttcttgtttcaagtatagtcatgtttgaatgacttaaaaaaaaataatcacact

SEQ ID NO: 24701 - DNA, 423 bp, Homo sapiens
  misc_feature 3, 10: n = A,T,C or G
ccnctatggnccgggaaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttt

SEQ ID NO: 24702 - DNA, 273 bp, Homo sapiens
  misc_feature 16: n = A,T,C or G
ggagcccaattctccncccaagcaaacacggaatatccaaacacaccagaaagcaagatctagtttcaaaatcatatttgatcatgatgctggaggacttcaagaaagacataaagaactcccttagagaacaagtagaagcctacagagaggaatcgcaaaaatccctgaaagaattccaggaaaacacaagcaaacagttgaaggaattaaaaatggaaatagaagcaatcaagaaagaacacatggaaacaaccctggacatagaaaatc

SEQ ID NO: 24703 - DNA, 467 bp, Homo sapiens
  misc_feature 196, 243, 277, 324, 358, 395, 461: n = A,T,C or G
gtggctcaagaaaccagttaatactcttggggatatttcggggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggngagaatgttctacctccaaagagggaaattgcaaagagaagtttttntagtcagagaccagtagatcgtcagaatcgacgnggcaacaatggtccacccaaatcaggaaggaatttctcaggtcctanaaatgaaaggagaagtggcccaccatcaaaaagngggaagagagggccatttgatgaccagcctgcaggcncaactgggggttgacctcatcaatggcagcctctgcccaccatcaggaaggagtaccttaatggtncaggac

SEQ ID NO: 24704 - DNA, 436 bp, Homo sapiens
cacagaagtcttgtatattcatgtagctcatgatgatggaatcaagtttgaaggcttaacctgtgcttaacctatattgggcattgtcaagacttaaatttagaacactggaaagcaagtataattaattttacaaatagggcatcaaattttacaaagactcctaaggctatatggtattccttttataagacatggaaaaggcaaagataagggaaacgaacaaatcgctggttagaagtaggggatttgagtacatatgggcttaagagtgttctgtcatgattgtagtggtgaaaacaagcatttgcaaaactcataaggctactcttaaaatagcaaattttgttgtatgtatattttaaagttaaacaataaaaatgctttcagtttattaaagaactcaagaccaggtgcaggggctcatgcctataat

SEQ ID NO: 24705 - DNA, 280 bp, Homo sapiens
tatggccggggattgcagtacattgagctccatagaaaacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagaga

SEQ ID NO: 24706 - DNA, 408 bp, Homo sapiens
  misc_feature 22: n = A,T,C or G
gaaaaattgaggctattaaagnatatgagtttgggagttaacatgggatgaaaagatgatgaacttttgagggagactgcacagttacaggccaggcagtcatgaagagcaagagttcaagcaagctgcttcacttttttttggagcatgttagcttattggtaaagtcagggtatgaattccttctactgctttatgacgtggattaactgcatgaaaagtacctgtataggccgggctcagtggctcacgcctgtaatcccagtactttgggagactgaggcaggcggattgcctgaggtcaggagttcgagaccagcctgccaaacatggcaaaaccccttctctacttaaaaatataaaaaattggccgggcatggtggcgggcgccctgtaatcccagctact

SEQ ID NO: 24707 - DNA, 317 bp, Homo sapiens
aagcattaatttgctaagtatttaccaggggagtgggaaaaagagttgagcaggattctcttaggctatgagagagtcaggcagcccccaagataaaataatgaactagaaaatctggaaccttacttctctgggaatcttacctatctggcacgtgggaaggaagaaaaaaggctactgagtaccctgaaatgtcacgaagttgatgcaatgaaactcgcacatctcactctgagccagttgactataactttcccagcccttgatatattggaagattagaggggaattgccagaagtaaaccaactgtctgctg

SEQ ID NO: 24708 - DNA, 426 bp, Homo sapiens
  misc_feature 137: n = A,T,C or G
agttgcctggttgctattagttctctcacctatttgccaagaatcaaagaatatctggatcaactacctgattttccctacaaagatgacctcctggccttggactccagctgcctcctgttcattgttcttgtgtnctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttggtttatgttacagaatgctgcaattcagggctcttcaaacttgt

SEQ ID NO: 24709 - DNA, 267 bp, Homo sapiens
ggggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaat

SEQ ID NO: 24710 - DNA, 470 bp, Homo sapiens
  misc_feature 177, 188: n = A,T,C or G
gatctgctttaagaattaacgaaagcgtgtcaagacagtaaggattcaaaccatttgccgaaaatgagtctaagtgcatttactctcttcctggcattgattggtggtaccagtggccagtactatgattatgattttcccctatcaatttatgggcaatcatcaccaaactgtgcnccagaatgtanctgccctgaaagctacccaagtgccatgtactgtgatgagctgaaattgaaaagtgtaccaatggtgcctcctggaatcaagtatctttaccttaggaataaccagattgaccatattgatgaaaaagggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccactt

SEQ ID NO: 24711 - DNA, 300 bp, Homo sapiens
tatggccggggaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagacc

SEQ ID NO: 24712 - DNA, 343 bp, Homo sapiens
  misc_feature 14, 15, 18, 29, 44: n = A,T,C or G
gtcctttccggcgnngangacctacgcanacgagaacatgcctntcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttg

SEQ ID NO: 24713 - DNA, 174 bp, Homo sapiens
  misc_feature 6, 17: n = A,T,C or G
atcacnccgatgaggcnaccagccagaacgccctgaacgcaggcaccatacttcctattctacaccctagtaggctcccttcccctactcatcgcactaatttacactcacaacaccctaggctcactaaacattctactactcactctcactgcccaagaactatcaaactcc

SEQ ID NO: 24714 - DNA, 428 bp, Homo sapiens
accgggcagtcatggaccaattgtgtgaccatgagcaaggatgcttattttttttaaaaagaaaacacatctaaaagcccagggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcaacatatgtggtacaaatttatatttgaagatctaaataaaccacgtattttccagtcttcgttgtgtgaagctaaatggtggctaaaaggaacactttttgtgtga

SEQ ID NO: 24715 - DNA, 474 bp, Homo sapiens
  misc_feature 172: n = A,T,C or G
gctttttttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggnggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacgagaaaaactccttgtggtgaaggttctaagacgtgggatcgtttccagatgagaattcacaagcgactcattgacttgcacagtccttctgagattgttaagcagattacttccatcagtattgagccaggagttgaggggggaaagtcac

SEQ ID NO: 24716 - DNA, 487 bp, Homo sapiens
  misc_feature 1: n = A,T,C or G
natggccgggattgggtgcaaggatatcattgttggctagattcattttgtataatcatgtatcctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtacattagtaggtgctcaacaaatttactgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgc

SEQ ID NO: 24717 - DNA, 485 bp, Homo sapiens
tatggccgggctatgaagagtttgtacaaatgatgacagcaaagtgaagaccttgtacagaatgtgttaaatttcttgtacaaagttgtttatttgccttttctttgtttgtaacttatctgtaaaaggtttctccctactgtcaaaaaaaatatgcatgtatagtaattaggacttcattcctccatgttttcttcccttatcttactgtcattgtcctaaaaccttattttagaaaattgatcaagtaacatgttgcatgtggcttactctggatatatctaagcccttctgcacatctaaacttagatggagttggtcaaatgagggaacatctgggttatgccttttttaaaggtagttttctttaggaactgtcagcatgttgttgttgaagtgtgggagttgtaactctgcgtggactatggacagtcaacaatatgtacttaaaagttgcactattgcaaaacgggtgtattatcccg

SEQ ID NO: 24718 - DNA, 368 bp, Homo sapiens
  misc_feature 3, 12, 41: n = A,T,C or G
acnctccggccnttttggccggggcaagacacattctagtnaatttttgaaaactaaaaccgaaaaaggttgaaagcgatgagaaatgacaccctatgtatgttagtgaaacaagtaaaatgacagcatatttgtcatcagaaacaacaaaggccgaaaggaagtggcatagcatttttctagtgctgaaagaaaagaagaattaacccaaaattctacatccagtgaaaataacctttaggaatcaagggaaaatgaaaatattcttagacgaaagaaaactaagaaaatttgctgccagcaggcctactctcaataaatggccaatggatgttctctaaacaaaaagagaattctaaaacaatacc

SEQ ID NO: 24719 - DNA, 469 bp, Homo sapiens
  misc_feature 427, 429, 436, 461: n = A,T,C or G
ggggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggattggtttaagngntattaancagctcttgaagtctaaacactggnaagaatta

SEQ ID NO: 24720 - DNA, 498 bp, Homo sapiens
ctatggcccggggggcattgaggcagcccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttggaaggcgatcttttaaaaagagattaaaccgaaggtgattaaaagacctt

SEQ ID NO: 24721 - DNA, 172 bp, Homo sapiens
  misc_feature 116: n = A,T,C or G
gtctcaaaaaaagaaaaaaaaaaatcccaagtggaagaggaagacagaaagaatgggtcagggagatgcaaggatggaagaagaggcaggagaaatgaggcctgagaagaactggnctcgccactgctggctttgaagacaaaggtttccaggtgccaagaaatggggtctc

SEQ ID NO: 24722 - DNA, 273 bp, Homo sapiens
  misc_feature 2, 5, 18, 39, 43, 272: n = A,T,C or G
tnctnaatgtgggtaccncagctgtatcactgcccaacntcanaaaacctgacggctatgattactatgccttttctaaagatcaatactataacattgatgtgcctagtagaacagcaagagcaattactactcgttctgggcagaccttatccaaagtctggcacaactgtccttagactgatgagcaaaggaggagtcaactaatgaagaaatgaataataaattttgacactgaaaaacattttattaataaagaatattggcatganc

SEQ ID NO: 24723 - DNA, 474 bp, Homo sapiens
atctatcctttacggcaagggtacctacggtacctgaaaacaacgatggcatggaaaacacttcccatttacctgttgttgctgctgtctgttttcgtgattcagcaagtttcatctcaagagctttcctgtaaaggccgctgctttgagtccttcgagagaggggagggagtgtgacttgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaaggaagaagactaagaaagttatagaatcagaggaaataacagaagaacattctgtttctgaaaatcaagagtcctcctcctcctcctcctcttcctcttcttcttcaacaattcggaaaatcaag

SEQ ID NO: 24724 - DNA, 483 bp, Homo sapiens
  misc_feature 110, 225, 252, 332: n = A,T,C or G
gcaataaagtttttggtgccctgagggagctgtggatggaggcttgtctatccctcacagtaccaaacgattccctggttatgattctgaaagcaaggaatttaatgcanaagtacatcggaagcacatcatgggccagaatgttgcagattacatgcgctacttaatggaagaagatgaagatgcttacaagaaacagttctctcaatacataaagaacagcgnaactccagacatgatggaggagatgtntaagaaagctcatgctgctatacgagagaatccagtctatgaaaagaagcccaagaaagaagttaaaaagaagaggtggnaccgtcccaaaatgtcccttgctcagaagaaggatcgggtagctcaaaagaaggcaagcttcctcagagctcaggagcgggctgctgagagctaaacccagtaattttctatgattttttcagatttagataattaaacctttttgaacag

SEQ ID NO: 24725 - DNA, 404 bp, Homo sapiens
  misc_feature 369: n = A,T,C or G
gtttaaagcctagttaacgcatttactaaacgcagacgaaaatggaaagattaattgggagtggtaggatgaaacaattcggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtnttggagaaattttagaagattagaaaaatataaag

SEQ ID NO: 24726 - DNA, 471 bp, Homo sapiens
aacagcctgtatagccaaacaatcctaagcaaaaagaacaaagctgcagtcatcacgctatttgacttcaaactatactacaaggctacagtaaccaaaacagcatgttattggtaccaaaatagatatatagaccaatggaacagaacagaggcctcagaaataacaccacacatctacaaccatctgatcttagacaaacctgacaaaaaacaagcaatggggaaaggattccctatttaataaatgggggttgggaaaactagctagccatatgcagagaactgcaactggacctcttcctttcaccttatacaaaaattagctcaagatggatcaaagacttaaacctaagacctaaaaccataaaaaccctagaagaaaaccttggcaataccattcaggacataggcatgggcaaagatttcatgactgaagcaccacaagcaatggcaataaaagccaaaatgg

SEQ ID NO: 24727 - DNA, 500 bp, Homo sapiens
  misc_feature 12, 14, 131: n = A,T,C or G
aatctccggccncntatggaccggggaggcattgaggcagccagcgcaggggcttctgctgagggggcaggcggagcttgaggaaaccgcagataagtttttttctctttgaaagatagagattaatacanctacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcgatgcttttagattaaaatgaaggtgacttaaacagcttaaagtttagtttaaaagttgtaggtgattaaaataattttggaaggcgatcttctaaaaagagattaaaccgaaggtga

SEQ ID NO: 24728 - DNA, 471 bp, Homo sapiens
  misc_feature 28, 461: n = A,T,C or G
gagcatttaagaagctcctctgccaagnaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagaccntagattctat

SEQ ID NO: 24729 - DNA, 349 bp, Homo sapiens
ataaaaggaatgaataatggcatttgcagcaacctggatggaactggagaccattattctaagtgaagtaactcaggaatggaaacccaaacatcatatgttctcactcataagtgggagctaagctatgaggatgcaaaggcataagaataatacaatgaacttcggggacttgggagaaagaatgggaggtgggtgaggaataaaagactacaaattgggttcagtgtatactgctcaggtgatggatgcaccacggtctcacaaatcaccactaaaatacttactcatgtaaccaaataccacctgtttcccaaaaaccaatggaaatgaaaaattaaaaaataat

SEQ ID NO: 24730 - DNA, 377 bp, Homo sapiens
  misc_feature 135: n = A,T,C or G
gagtactaacatggactaatctgtgggagcagtttattccagtatcacccagggtgcagccacaccaggactgtgttgaagggtgttttttttcttttaaatgtaatacctcctcatcttttcttcttacacagngtctgagaacatttacattatagataagtagtacatggtggataacttctacttttaggaggactactctcttctgacagtcctagactggtcttctacactaagacaccatgaaggagtgtgtgctcctattattcctggctttgtgctctgccaaacccttctttagcccttcacacatcgcactgaagaatatgatgctgaaggatttgggaagacacagatgatgatgatgatgatga

SEQ ID NO: 24731 - DNA, 481 bp, Homo sapiens
gaacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgcgatatttactaagaattgaacattcaaaaacccctggaagagactctttaagacctcaaaccatttagaatgggcaatgtattttacgctgtgttaaatgttaacaggttttccactatttctctttcttttctat

SEQ ID NO: 24732 - DNA, 110 bp, Homo sapiens
  misc_feature 13, 26, 33, 43, 57, 69, 76, 86, 90: n = A,T,C or G
catatgtggccangcgcagcgccttntgcctgnactcctaccncttcaggaaggccnaggaaggaaggnctgcttnagaccatcanttgnaggccagacacgccacacat

SEQ ID NO: 24733 - DNA, 248 bp, Homo sapiens
  misc_feature 22: n = A,T,C or G
cagtgagttcaccctctaaatnccacgatcaaaagggacaagcatcaagcacgcaacaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccct

SEQ ID NO: 24734 - DNA, 500 bp, Homo sapiens
  misc_feature 8, 9, 28: n = A,T,C or G
gcggccanngtggccggggagagaaganataaagattgaagaggagtttatggtgctgtgtcaactattaatgtttccttgggactagcacaggatgtatccacctggttaggagccccacactcctcaggccgtcatgtataaagcagttggctcatgaacttcatttttgtcaaattcctgttatcttatttaaatggtagtactggcttttagcattattgttattttgttttaaaaaaaacattcttaatgataattgtcaggaattgattttctgctcactacttcactaaattctaaaatgactattgcttagaggcagataaaatatcttgttctttaagaacaacgtcgagctatatacattgggaatatccctcacactgtttaaaaccatattgctttaagtggtgtataatgcaacattttattgaactattttgaaagtccctaatgtgcagattcacgtgaaattaccccatgtgtctagtttgcac

SEQ ID NO: 24735 - DNA, 489 bp, Homo sapiens
ggggcattcctgagctgacagcattcgggccgagatgtctcgctccgtggccttagctgtgctcgcgctaccctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaacccatgtgactttgtcacagcccaagatagttaagtgggatcgagacatgtaagcagcatcatggaggttttgaagatgccgcatttggatttggatgaattccaaattctgcttgcttgctttttaatattgatatgcttatacac

SEQ ID NO: 24736 - DNA, 483 bp, Homo sapiens
  misc_feature 431: n = A,T,C or G
tatggccggggaggcattgaggcagccagcgcaggggcttctgctgagggggcaggcggagcttgaggaaaccgcagataagtttttttctctttgaaaggtagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggngatttaaaataattttggaaggcgatcttttaaaaagagattaaaccgaagg

SEQ ID NO: 24737 - DNA, 354 bp, Homo sapiens
  misc_feature 329: n = A,T,C or G
atagttgatcaaattcaactgccttccccagataatgatacacgttaatgtgttttctgaatttctttactgatgctccagaaaggaagacaagttcatttttataattttatttttaatatttgtgttattgttgtcctcacgggaattaaatactatatatgaacactattaaaattcacaaaactactcaagtcaatgaaacacagtaacatgttcacagggacaagataaaatgactgtaactattgtcaggtgtcggaattgctttagccttttccataaatcatggtggaagtatcattatcatacatgattaatgacacttnacgtcgtggatctgattacaaccac

SEQ ID NO: 24738 - DNA, 424 bp, Homo sapiens
  misc_feature 420: n = A,T,C or G
gagctgcttttatgctgaaaatggtcatttccctgttcacttactgacatgtgaagaagggtttcttgctttcttaaacatttccgtaaggcaggctagaaatgtaatacttcaaatgtttgatgattatggtcttttgataggaatagattctgcttgggatatatatccaggcactctctaaggtctagggttgatattaacaaaggaatgtacttagaatagcagtacattttatgcaaatatggaaattattttaagaaacaatgacatatcaaaactgctttttacatgattttgaaatagactagaaagctttccctatagacatattaatattccaatcataactttaattcaagaatgcagttttaccaaaagaaaaatttgaaaatttctattcaggctactggaattggntatg

SEQ ID NO: 24739 - DNA, 488 bp, Homo sapiens
ctagttatagatgcccaagtaaatctggtgggagggatggggagtgggaaaacagtatttgggagatatagccaccaacagcgatccaaccaagcaacccatatccttgcaaagttaacagtagtatctaccaatatccagagttccagcactggagatgcagacaaaaatgatatgcaaatatgcacacagatacaaatgacccttggggagggggtgggaaaaacaaacaaacaaaacagccctgggcgcagaggcaggatcccagtttaacaggaaatcagagctcacatctgtagcttgatgtatgtaacatatatgaaagatgagatctcagacacaataaacgagacaggaccaactggaactggcacttaaggttgcaactaaagagtagcaagtatagcatttgaaagtagaaattcttggagtcattccttgggtaatgtcaagaaaaacgtctggagcctgggcagtacctgaagatg

SEQ ID NO: 24740 - DNA, 128 bp, Homo sapiens
  misc_feature 7, 12: n = A,T,C or G
atttttnacccngggtattcggccttatggcgggggtatttttaatagagaaggagtttcgccatgttggtcaagctgatctcgaactcctggcctcaggtgatctgcctgcctcggcctcccgaagt

SEQ ID NO: 24741 - DNA, 412 bp, Homo sapiens
  misc_feature 2: n = A,T,C or G
tnggccgggggaggttgagatgaagcttcttctggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattattgggagtggtagggatgaaacaattcggagaagattagaagttttggaagtggaaaactggaagacagaagtacgggaaggcgaagaaaagaat

SEQ ID NO: 24742 - DNA, 102 bp, Homo sapiens
  misc_feature 13, 42: n = A,T,C or G
ggccgcaactctntgcttctctccagctctcaatgctgctgnattttcctctagtgcttccggatcctcttcattcttttcggctactcaaccactccgcat

SEQ ID NO: 24743 - DNA, 153 bp, Homo sapiens
  misc_feature 21, 32, 70, 81, 89, 107, 143: n = A,T,C or G
gttcttagtgtagggcacctnttcctttttcngaatgggtaggtttactaagaaaatcacatataaatcnaaacattgttncgggcctntcaagttatattcctatntagcccttctttcagtttttactttgggaattttgnggtaaagaat

SEQ ID NO: 24744 - DNA, 196 bp, Homo sapiens
  misc_feature 19: n = A,T,C or G
gaaagataaaagtatgtgnatttagcatctttctcaaaaagttaaaaagaatcaacaaaataaactgaaagtaagtggaagaaaaaaattgtaaagataaaaacagaagttgaaaagtgagaaaactgaaatatagtagaaataatatgtaaatccaaaacatggtcccataaaaacccaaccaaaagatctaacc

SEQ ID NO: 24745 - DNA, 210 bp, Homo sapiens
  misc_feature 13: n = A,T,C or G
gactgtggcctgncctcagtggtaccccacacatcagcactaccacaagaaccaacactgagcctcggaagctagatcacaggttaggggtttctctagatgggggttctgaaatttgcagtgtctgctcctgggaggcagcaccagaaagggcactgaaatgtactagctggatgtgacccagtcttaataaacaggttttctaatccg

SEQ ID NO: 24746 - DNA, 120 bp, Homo sapiens
  misc_feature 5, 17: n = A,T,C or G
cggcnttatggcgggangggtttttaaggaaacaaaactatttttttaatctcagatttatactagctatatggatattaggcatatctggtaattatgaatctagaatttttatttggg

SEQ ID NO: 24747 - DNA, 188 bp, Homo sapiens
  misc_feature 51, 98: n = A,T,C or G
ggcggcattggagtcaagatggaggagtacgcgcgagacccttgccatggngaattgtggatgactgtggtggggcctttacgatgggtaccattggnggtggtatctttcaagcaatcaaaggttttcgcaattctccagtgggagtaaaccacagactacgagggagtttgacagctattaaaaac

SEQ ID NO: 24748 - DNA, 480 bp, Homo sapiens
  misc_feature 1, 7, 37, 39, 58, 183, 204: n = A,T,C or G
ntttttnatccgggtaatttatgcctttatggcgggnancgcactgagatcaacaagnagatttataagattggccagggctaccttatcaaggacggcaagctgatcaagaacaatgcctccactgactatgacctatctgacaagagcatcaaccctctggggggctttgtccactatggngaagtgaccaatgactttgtnatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccacttgaagaaagaccgaattgcaaaggaagaaggagcttaatgccaggaacagattttgcagttgggggggtctcaataaaagttattttccactgg

SEQ ID NO: 24749 - DNA, 310 bp, Homo sapiens
aatattaaacaacatgaaactgcagtctgtttttgaaaatgagaatgtcctaagtgattcagaagagaggagggaagttgtgcactctgaaaatgcatgaaaaacaaaaaaacgaaagcatcttcacaatgaagcttccagatagcaccgttttgctaaaagatacattctcattgttttccaacagtgatggcttccacataaggttaaacaaactaggtgcttgtaaataatttattacagtttactctatcgcatttctgtaacatgaaatgcatgcccttcttcaggggaagactgtggtcaagtt

SEQ ID NO: 24750 - DNA, 470 bp, Homo sapiens
  misc_feature 417, 437: n = A,T,C or G
ggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatgggaggttttgnaagatgccgcatttggattnggatgaattccaaattctgcttgcttgcttttt

SEQ ID NO: 24751 - DNA, 475 bp, Homo sapiens
  misc_feature 4, 37: n = A,T,C or G
attnaaagctagcagaaggcaaaaaataactaagatngagcagaactgaaggagttagagacacaaaaaacccttcaaaaaatcagtgaatccaggagctggttttttgaaagggtcaacaaaattgatagactgctagcaagactaataaagaagaaaagagagaagaatcaaatagatgcaataaaaaatggtaaaggggatatcaccactgatcccatagaaatacaaactaccgttagagaatacggtaaacaactctacgcaaataaactagaaaatctagaagaaatggataaattcctcgacgcatacaccctcccaagactaaaccaggaagaagttgaatccctgcatagaccaataacaggctctgaaattgaggcaataattaatagcctaccaaccaaaaaaagtccaggaccagatggattcacagctgagttctaccagaggtacaagggggagctggtac

SEQ ID NO: 24752 - DNA, 473 bp, Homo sapiens
  misc_feature 319, 419, 435: n = A,T,C or G
aatggatgaatgtttctgatggggtgggtttctgtgcctagcacagggcaggtgtcaaatacgtgtttgttgagtggaagaaggaatcacatgatgatttagattgacagtaggtcaaaataatactcatttcttatgtacttttaggagtataggtgaaaataataggaacaatgcagaagaaaatccttttgaaagccttcccaaaatgttgactggaaaagagtttaaacttactcatttcaagctgctattgtatctctctctctctctctctctctctatctatctatatatatatagggaatttttaaaaaanacaccgaaagaatagaaacatatcaacactatacttaacacatgtactctgcattaggttttaattccatgaattcctattcattttttatttttatgcntgaaagtttactgggnaatgggaattcaccatccctgtttagattctgcattga

SEQ ID NO: 24753 - DNA, 491 bp, Homo sapiens
gtgttaggaaggcactagagtacgacagtgagctaagatctttttatttatttattttttatctttacttttttccaatgagctaagatctgaaaatgattttcatcatgcatttagctaaagcccaattaaaaagattgtagtagaccgtatatttagattcaggctgagaattatgataagatgtaataaatacacagatatgtatatttgttatgattcattttattcattcatttatttatttatttatttacttacttgataggctcaatcttataatttgtcagatgagactgcagagacttttggggctgagttgctgatgggctcacctactgttctaaagggaagcaacattctcccctctcaagtttcagaaaagggaaggcagccagagagtaatgcaaaaggctgtcccaggtggcagaatagaagggattgcactcagcatccccaaccctgtggatgcaggaagtacccttggcctc

SEQ ID NO: 24754 - DNA, 100 bp, Homo sapiens
  misc_feature 19: n = A,T,C or G
tatggccgggaagaaaaanataattacaccacacccaagtacaggatgatagttcgcgtgacaaacagagtacttcctgtgtgaagattgcttatgcccc

SEQ ID NO: 24755 - DNA, 486 bp, Homo sapiens
  misc_feature 197, 312: n = A,T,C or G
tatggccgggtgactggctccatttcatggaccaactgatcaattgccagtactaagccactcattgttatggcttcctttttgaaaaccacctgtctcaaggattcaggtttctgctcacatccccagctgatgctcaataaaactcagccaggagcatatggagatgctgacagccaggtaatgggtgagactgnggggtcccttttcctctaaagcctttactctgagggtaaggtcacaaagtagggtgtgacttgaaagtatcgtgaccatgtggcccaccagcagcctttccaaaggggaactccngagacatttcataatgcaaacagcactgttgctttaagaacaaggcctttggaggtggctaaacttgcacgcacgtgtgtgaaaagccatcccatcttctgcctccagttggagctttcagctgttaaaacagtcagaaactattgattcttccctttagggaaaaaaatgctc

SEQ ID NO: 24756 - DNA, 482 bp, Homo sapiens
  misc_feature 468: n = A,T,C or G
aatgtaaaatactaaataataatgaaccacagaagcttcttcatatcttaaagcaaatttattgaaaattgtggatttctactcgttaagtttgccactccattaattgaatgtttaataaatattacagtttaccaagatagtaattattatacttttcaataaaattacactttcataccacctattatgtgtccataaagcagttgtaccgtagtaaaataaaaaatataaactaagaccataacaaaacccctagtacatcccctagatgaacagcaagtaaaactttacacttctatggctatgttattatacatttattaactgaatagcagaaccattgacttcatgaaaaattggcaactgtattggaaaatatttaaacttgtttttaatgtcttaaatcagagtgaacaatttctgatccaagggcttaaattattccagacctttgtcatgctggtntattattttaaggg

SEQ ID NO: 24757 - DNA, 326 bp, Homo sapiens
  misc_feature 21, 34, 39, 274, 301: n = A,T,C or G
ggaccggggggaaaacagtancaagtactctgtncaagnaaagaaaaagaaagaaagaaaaagcaaagaaaggcaagcaaaaagcaaagcaaaggaagcaaaggaagaaaggaaggaaggaaggagagggagaagaagaagaagaaggagaaggagaagaagaagaagaagaagaaggagaaggagaagaaaaagaagaagaagaagaagagaaggaaggaaggaaggaaggaaggaaggaaggaaggaaggagaagaagaagaagaaggaganggagaagaagaagaagaagaagaaggngaaggagaagaaaaagaagaagaag

SEQ ID NO: 24758 - DNA, 448 bp, Homo sapiens
  misc_feature 9: n = A,T,C or G
atcacaagnaacacacacatatacgcgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatgc

SEQ ID NO: 24759 - DNA, 471 bp, Homo sapiens
  misc_feature 423: n = A,T,C or G
gtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaatattatatgtcaatatttaggtaaagcttttcttttttaatttccaggaaaaaataaaaagagtntgagtcttctgtaattcattgagcagttagctcatttgagataaagtc

SEQ ID NO: 24760 - DNA, 474 bp, Homo sapiens
  misc_feature 453, 456: n = A,T,C or G
gaaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggagggaaggaaagaacttgcatgttggtgaaggaagaagtggggnggnaaaaatggggggggggac

SEQ ID NO: 24761 - DNA, 499 bp, Homo sapiens
  misc_feature 5, 220: n = A,T,C or G
agggnaattgcggcccttatggaccggggaagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcngctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtcttccaaggcaggttctctcgaatactttga

SEQ ID NO: 24762 - DNA, 258 bp, Homo sapiens
gtggcacctgcgccgaacaaatgtacggaatgtgtgagtccctctgggagcccaacatggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctt

SEQ ID NO: 24763 - DNA, 500 bp, Homo sapiens
  misc_feature 2, 8, 29, 41, 42, 119, 148, 243: n = A,T,C or G
anttgcgnccctctatggaccggggaggnattgaggcagcnnagcgcaggggcttctgctgagggggcaggcggagcttgaggaaaccgcagataagtttttttctctttgaaagatanagattaatacaactacttaaaaaatatantcaataggttactaagatattgcttagcgttaagtttttaacgtaattttaatagcttaagattttaagagaaaatatgaagacttagaagagtngcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaaggtgat

SEQ ID NO: 24764 - DNA, 464 bp, Homo sapiens
  misc_feature 13: n = A,T,C or G
gcttttcacaagnatggcgccgaagcgaagaaggaagctcctgcccctcctaaagctgaagccaaagcgaaggctttaaaggccaagaaggcagtgttgaaaggcgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacatttgatgtggccaaggtcaacaccctgattcggcctgatggagagaaagaaggcatatgttcgactggctcctgattacgatgctttggatgttgcc

SEQ ID NO: 24765 - DNA, 234 bp, Homo sapiens
  misc_feature 99, 109, 126, 215, 222: n = A,T,C or G
gaccgggggaatgaacaagctcaggtattttcattcttatttttaggattttagtttttagtgtatggtacaaatgaacacagtttatattctaatacncttactgcanctcattttaatttttangatgcaagcacaatttactattcaaagtgagtagcaacatattcaacttgatcccattgtattcacttactcttgcccatgaaaaatgnccataantgaacagggcct

SEQ ID NO: 24766 - DNA, 402 bp, Homo sapiens
tatggccgggaagatctttttcttaagtgaaagcacctttaatttgctctaacggtacatcctgtaaagacagaattctgcatagccttttaggtgtttttacagtatgtgaaaaatacaagactcattctagagttaaattaccaatcttggttgatattatctgcctccatttttattaatttggaaattaatatgttgctagtaaatattggtttttacagtacccagtttgaaaatgtaagttatcaaaacttaatgtagtgaatttgtgtaaccatgttgtattgttgagaatgtatttttatttaaattttattttcttatcaagagtattataaaaattaacttttgtaactgtcgcttggaaataactcaaataaattacaagaagcctgtcac

SEQ ID NO: 24767 - DNA, 150 bp, Homo sapiens
  misc_feature 18, 48, 64, 104, 107: n = A,T,C or G
gaacataaaaatgcaagnatgaagcagcaagtgctgactgaggagctntagaaagctatccagnagatctagctaagatcactgatgaaaatgactcccccaancantggatttttaagtgcacgatgaaacagtctttataggaagaag

SEQ ID NO: 24768 - DNA, 469 bp, Homo sapiens
aaaaaagaaaactgcagactgatatctctgatgaacatagatgcaaatatccttaacaaaatactagctaactgaatccaacagcatatcaaagagataatccgtcatgattaagtgggtttcattccagggatgcagggatggtttaacttatgcaagtaaataaatttgatacaccacgtaaacagaattaaaaacaaaaatcacatgatcttctcaatagatacagaaaaacattttacaaattccagcattcctttaagattaaaaccctcagcaaaatcaacattcaagggacatgcctcaatgtaataaagtccacctatgacaaacccacagccaacataatactgcaaggggaaaagttgaaagcattccctctgagaactagaagaagacaaggatgcccactctcaccacttttattcaacatagtgctgggaagtcctagccagagcaatcatacagg

SEQ ID NO: 24769 - DNA, 395 bp, Homo sapiens
  misc_feature 5: n = A,T,C or G
caganaaaattcttagctgaaaggattcacaatttgattccacaactggatttctaggtaaaactatgggcaaactgaagattttatccagagggagccaaacaaagctgctgtgctatatgatgctgtcttctttatttgtcttttttatcatttattggattattaaactgaggtgatgcatgtaattgtgaatttggaatttgttccaacttaatggcttgcagtaccactttgataaaaatcagcatcaaaacattcctagtgttcaaatactgtggcattttccattgaaaattgctgaattttgcttattttataaatcacattagttaataccagtggtctttgaatactgtttcttaatgactcattttagcccctattttcagggg

SEQ ID NO: 24770 - DNA, 183 bp, Homo sapiens
accgggggtcggatgcattttgcctcaggggtataaaattaatttagaaatgacattttaaatagtggaagccttttatataatgatgtgaaaattattctgcttttgaaaatcaaaatcaaacatgaaacagtatgtctctctgtaaagaagtcagatatcttgttgggatattactttggc

SEQ ID NO: 24771 - DNA, 100 bp, Homo sapiens
  misc_feature 17: n = A,T,C or G
gatggcattgaggccgncagcgcaggggcttctgctgagggggcaggcggagcttgaggaaaccgcatataagtttttttctctttgaaagataacagat

SEQ ID NO: 24772 - DNA, 439 bp, Homo sapiens
  misc_feature 35: n = A,T,C or G
ggggcattcctgagctgacagcattcgggccgagnatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatga

SEQ ID NO: 24773 - DNA, 475 bp, Homo sapiens
gctaaacctagccccaaacccactccaccttactaccaggacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtaga

SEQ ID NO: 24774 - DNA, 479 bp, Homo sapiens
gagtgaaatttagtagccaagaaagaaggaaggaaggaaggagaaaacagctccctccaacagagacagagggaggggggattcaaacaaagagaaaacccctcgaatgagtttttaaaaagtaaaatacagagagattattatgtttaattttaattttaccaggctagaagcattaaccatgacttatttattctctgtactttgtatactttcattaatcaattaaacatgcttttctgtgagagaagcactaaactatttgttagaaaattctacataccaggcagggtacagtggctcacacctgtaatcccagcactttgggatgccagggcgggcggatcacctgaggtcaggagttcaagaccagcctggccaacatggtgaaaccccatctctactaaaaatacgaaaattagccgggcgtggtggccccgtgcctgtaatcccagctactcaggaggctgaggcaggag

SEQ ID NO: 24775 - DNA, 486 bp, Homo sapiens
  misc_feature 478: n = A,T,C or G
tatggccgggagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagatcgtctaccagctgcaggacgtcttcagtctgctgccagatgtcagcctgcanggagttcg

SEQ ID NO: 24776 - DNA, 485 bp, Homo sapiens
tatggccgggggattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggttttgaagatgccgcatttggattggatgaattccaaattctgcttgcttgctttttaatatttgat

SEQ ID NO: 24777 - DNA, 216 bp, Homo sapiens
atttgggagtttaatattctgatccaatatccaagaatttatccattccataaattctttctgtttagatgaatcaggattggtttctgtgccctgacaaattcaggtgttggtactatagtgagaattgtaggcagcatagagataagaggaatctagaattggttatcaggccttgtttggagataaaggcaattaaaaaatcatactaggagc

SEQ ID NO: 24778 - DNA, 281 bp, Homo sapiens
gggccaggtgcagtgtctccttgcgcctggccaataatatatttttacgtaagaatttgtgggacaactgaaacctgtgagaccagcctgggcaacatagggagaccccatctttacaaaaaataaaaaaatcagccaagcatgggggtgtgtgcctgtggtcccagctacttgggaggcagaagtgggaggatcccttgagcctaggaggttgaaactgcagtgagctgtgattgcaccactgcgctccagcctaggtgacagagcaagaacctgtctct

SEQ ID NO: 24779 - DNA, 402 bp, Homo sapiens
  misc_feature 2, 8, 27, 31: n = A,T,C or G
anggaccnggcatgtattagccatagntggngggaaggaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaagc

SEQ ID NO: 24780 - DNA, 189 bp, Homo sapiens
gggaaaagcatacggtataaagcacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgcc

SEQ ID NO: 24781 - DNA, 500 bp, Homo sapiens
tatggaccggggatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatct

SEQ ID NO: 24782 - DNA, 233 bp, Homo sapiens
tatggccggggcaaagtatgacctgtggtaagcaacctgggcatcttaggaagcagtccctggagaaggcatgttcccagagaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggccc

SEQ ID NO: 24783 - DNA, 266 bp, Homo sapiens
  misc_feature 201: n = A,T,C or G
aaaatttatacaagggttttaatgagaaaaaccttgtttgcaggaaggtgattgaaggaatgaacaagaatattgtgatgcatggaaagccattggattatcaggaagttgtagatatcattcaaagacatctgacaattaacatttgcataacactttacagtttgcaaactgctttcacatgtattatctaattccggngagctttcacagataaaaaaattgtctacctatcagggtgtcaaaaatgtaatgctgatcaatga

SEQ ID NO: 24784 - DNA, 421 bp, Homo sapiens
atcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttattttttgatagtcttacattacttgaattgttcaaagtacagtatatttta

SEQ ID NO: 24785 - DNA, 482 bp, Homo sapiens
tatggccggggaagtggtgggttacatcttgaagacagactgtgataagttagagatgtataatataaaccctaaaataaccactgaaatagcaaaataagttttaatcaataagccagtaaagaagataagaaatagaataataaaaagccacaaaattcaatccccaaaaaaagcttaaaaggagagaaaagaggaataggacacatggggaaaatagaaaacaaatagtaggttggtacatttaagtcatatcaaaatcatgttaaatataaatgatctaaaaacctcaattaaagggcagagattatcagattgcatgaaaaagtaggacccaactgtctgctgtgtatataaaattttttaaaaaataaagacaaatatgtttaaaagtaaaaattggattaaaagacacgagtctaacattaatcaaaagaaagatgtaatagctttcaacaggaaaactgcttgttagagcaaag

SEQ ID NO: 24786 - DNA, 181 bp, Homo sapiens
gttgacgcagtaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgat

SEQ ID NO: 24787 - DNA, 116 bp, Homo sapiens
  misc_feature 24, 28, 32: n = A,T,C or G
ttcaatgttgtctcatttggatgncagngctnttcacgaggtggacattgctcatatttaggtttgacctcagccccaaccaacatgtccatttgatactcgaatgcttgatcttc

SEQ ID NO: 24788 - DNA, 364 bp, Homo sapiens
  misc_feature 232: n = A,T,C or G
gaccgggggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttanaaaagccttgtaaatgcctatattgtgggcttttaacgtatttaagggaccacttaagacgagattagatgggctcttctggatttgttcctcatttgtcacaggtgtcttgtgattgaaaatcatgagcga

SEQ ID NO: 24789 - DNA, 340 bp, Homo sapiens
gagcagtgggagggtaccagcagaaagttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattggtgtg

SEQ ID NO: 24790 - DNA, 352 bp, Homo sapiens
tatggccgggaacgggcacaaataagaccaactcaatttccacttgaatttacaaccaaaagcctgctgagttgattacagctgggccaatacagtacgaggcaataacaaattagtgtgggttgattctggaattggaaaagcttttgcttgtatggatacagcaaatccagatgtctctgaacaaagcaacaatttaaagcaacgacattttctgtcctttaagcacttaaaatcaggtgtggtgtgttttcaaaggcagaagtctgcattttgagcaaaaggtggcttcccagctctaacaaggtaactggttagcatgacattaaagcttgggcaaggcttcaaactt

SEQ ID NO: 24791 - DNA, 472 bp, Homo sapiens
  misc_feature 12, 271: n = A,T,C or G
atatgattcatnacataaacagaactaaagacagaaaccacatgattatttcaatagacgcagaaaaggccttcgataaaattcaacatcgcttcatgttaaaaactctcaatcaactaggtattgaaggaacatacctcaaagtaataagagccatatatggcaaaccaacatccagtgtcatgctgaatgggcaaaagctggaagcattccccttgaaatccagcacaaggcaaggatgctctctgccaccactcctatccaacatagnttgggaagttctggccagggcaatcagtcaaaagaaagaaataaaaggtattcagctaggaagaaaggaagtcaaattatcttttgtttgcagatgacatgattctacatctagaaaacccagtcctctcagcccaaaagattcttaagctgataagcaacttcagtctcagaatacaaaatcagtgtgcaaaaattgcta

SEQ ID NO: 24792 - DNA, 478 bp, Homo sapiens
  misc_feature 1, 22: n = A,T,C or G
natggccgggcttcattctganggagcttcacttggacaacaacaagccttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaaatcttgttaatgtcattgctaaaaaaataaataaaagctagatactggaaacctaactgcaatgtgggatgttttacccacatgacttattatgcataaagccaaatttccagtttaagtaattgcctacaataaaaagaaattttgcctgcc

SEQ ID NO: 24793 - DNA, 500 bp, Homo sapiens
tatggaccgggcaggctctgaaattgaggcaataattaatagcttaccaagcaaaaaatgtccagaaccagatggattcacagatgaattctaccagaggtacaaggaggagctcctcccattccttctgaaactattccaatcaatagaaaaagagggaatcctccctaactcattttatgaggccagcatgatcctaataccaaagcctggcagagacaccacaaaaaagagaattgtagaccaatatccctgatgaacatcgatgcaaaaatcctcaataaaatactggcaaaccgaatccagcagcacatcaaaaagcttatccaccatgatcaagtgggcttcatccctgggatgcaaggctggttcaacatacacaaatcaataaacataatccagcatataaacagaaccaaggacaaaaaccacatgattatctcaatagatgcagaaaaggcctttgacaaaattcaacaacccttcatgctaaaaactct

SEQ ID NO: 24794 - DNA, 310 bp, Homo sapiens
  misc_feature 38, 46, 159, 257, 258: n = A,T,C or G
gtctcttcacagtagaaatataatttttattttgttgnttttgccntattatcaacatctggggcagtgtctggcattgtgtgtccaataaacatttgttggataaatgattgagtggctacttggttgttcatatgttacatgctgtctttggaaggntactgtaaacatgaactggatttatcttggcaacattttaagaacatgtcttcctctacatacatatttgccttccctcatttttaaagaaaaccagnncaacaaaaggaaaatcaaggtctacctgaagagaccttgtgatatacaaagc

SEQ ID NO: 24795 - DNA, 152 bp, Homo sapiens
cagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcc

SEQ ID NO: 24796 - DNA, 422 bp, Homo sapiens
tatggccggggactttgaatgaggcaggttgcttatgaatgcagcctgaagtgtcactcagagatacttgcattgtgttatctttgattgacatgtctgggggttgtggaaaaatttcagcatatccaaatgtgcttctctaaacactgtctttacatgaacattttctccaagagaattggctcatgcccttatgatgatgatctgttattgcagtgttcactctcactgtaggcgaggtacatcctaaaagggtaggttcatgggacttgggaactcaggccgtgtttgcaattctgattcccacaagtctttggggctacaatttaactaatgtatcacattacctgccacctgcagagcttatctaacaagctaattactttgatgagaatacccgctgtaatatcctccaaaatgac

SEQ ID NO: 24797 - DNA, 266 bp, Homo sapiens
  misc_feature 6, 14: n = A,T,C or G
gaaagnaaaaaatnagtgttttacaaagcaaacttaactgaaaaagaaaagctattgcagagggtagggcaggaaaaagaagagacagtttcttctcattttgaaatgcgatgcccaataccaggagcgcttaataaagctagaacatgctgaggcaaagcaacatgaagatcaaagtaagataggtcatcttcaagaggagcttgaagaaaaaaacaagaaatattccttgatagtagcccagcatgtggaaaaagaaggaggga

SEQ ID NO: 24798 - DNA, 293 bp, Homo sapiens
  misc_feature 8, 21, 231: n = A,T,C or G
attggccncgggtgattaaantaatttgaaggcgatcttttaaaaagagattaaaccgaaggtgattaaaagaaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtncgggaaggcgaagaaaagaatagagaagatagggaaattagaagataaaaacatacttttag

SEQ ID NO: 24799 - DNA, 124 bp, Homo sapiens
  misc_feature 14, 32, 75, 82, 84: n = A,T,C or G
atggaccggggttnttatattaaaatgaaggngacttaaacagcttaaagtttagtttaaaagttgtaggtgatnaaaatantntgaaggcgatcttttaaaaagagattaaaccggaggtgat

SEQ ID NO: 24800 - DNA, 440 bp, Homo sapiens
agctcactgcaatttccgcctcccaggttcaagtgattctcccacctctgacctcaagtgatctgcccgcctcagcctcccaaggtgctgggatgacaggcatgagccaccgcgcccagctagatgatggctttttaaactagtcttctcatttctaattttgatttcttagtatttccctaagaactttttctaagaataccaatatgaaaggtgaagtactcttagaagtggcatgggtacattcaggtacagttctcaaaagaactaaaaccaccttatttgctttgcaaatagtaaatgttcgctaccagtgtaatacagaagtgaggagaatgggtgagattatttttttcatagctcttcctttgtttatggtaatcaggctttgcattctaaaaatgtttcaggttatatgtgcatttcagtttctattctgg

SEQ ID NO: 24801 - DNA, 372 bp, Homo sapiens
  misc_feature 2, 5, 322, 368, 371: n = A,T,C or G
cntanatggaccggggaagactactcgcacaattttaatattataaatgtataatgtaaatgtaattaagatttgtataatgtacgatgtactttggtaaataaaagtatgctgtgaataaatacgtatgatacaattcaaaattttacataaatatgtgataaaatttagctcatattctttttttttctttgagacggagtctcactctgttgcacccaggctagagtgcagcagcatgatctcagctcactgcaacctctacctcctgggttcaaacaattctcctgcctcagcctcctgagtagctgggattacaggngcccgccaccatgcccagctaatttttttctatttttggtggtggnggng

SEQ ID NO: 24802 - DNA, 455 bp, Homo sapiens
  misc_feature 6, 428: n = A,T,C or G
aggtcncgcctagtttgattttgttattaatattgttttaaaaaatgcctttttctgcctttggtaaactaaaggtctaacatatattccaacttcttttgacagaggaaaagacaagcatacgaatctaaccttatctgtcatggcctgcagttagaagcaacaagatcagtaagtactggtcccttttcagccctcggctgaccactgttctcgggcagcttcgtgccacttggaatacttgggtgacattggaaacatgcagccctggccacatcttagtcatagactgggagaggagtcaatcaaaatctgcattgtgtaggatgtattctttttttctgatcaaaactagcagatcttttttaatagccaacgaattttacaatgaatgcatgtatgaatgattatttttcttttctttaaanaaacttctaaaagcttttttgttattc

SEQ ID NO: 24803 - DNA, 387 bp, Homo sapiens
  misc_feature 384: n = A,T,C or G
tacaattgttgggaaaaggaagcaatgcagacacgagaaggagggctcagccttgctgggacactttcttttgtgtttacatcatgccaggggcttcattcagggtgtctgtgctctgactgcaatttttctttttttgcaaatgccactcgactgccttcataagcgtccataggatatctgaggaacattcatcaaaaataagccatagacatgaacaacacctcactaccccattgaagacgcatcacctagttaacctgctgcagtttttacatgatagactttgttccagattgacaagtcatctttcagttatttcctctgtcacttcaaaactccagcttgcccaataaggatttagaaccagagtgactgatatanttt

SEQ ID NO: 24804 - DNA, 471 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggt

SEQ ID NO: 24805 - DNA, 498 bp, Homo sapiens
  misc_feature 35: n = A,T,C or G
tatggaccggggtcccagaatctactttgcaaagngagcattttcacttgtcagcttaaatttctgactagaactaacatttgtgtatttttgtgcttagtcggaatacaaatttcacagtggatttttgaagtttgtccttaaattggataaaatcaagtgattaaagttactaaagagataaaaatggtaatttccatttttaaaagtaatttggttgtgtttatagttatttgtacaagtatttatcacagactctaaattgaaaaatgtagtatgatctatatttgaccctaaaaatgttggattaatttaacaaatatggcagatttttcataactaagtcttaagtcttctaaaaggaagctgttacccttctgtttttaattacattaattgaaatgtgttttaagagatacaatttcagcatattttatatattaaaaaacaaaaaaggattagtattgagccagtggccaaaaggtaatattactacca

SEQ ID NO: 24806 - DNA, 238 bp, Homo sapiens
agatttcacctgggagaacctctttttctccctcgactcttcctacgtaaactcccacccctgacttaccctggaggaggggtgaccgccacctgatgggattgcacggtttgggtattcttaatgaccaggcaaatgccttaagtaaacaaacaagaaatgtcttaattatacaccccacgtaaatacgggtttcttacattagaggatgtatttatataattatttgttaaattgt

SEQ ID NO: 24807 - DNA, 465 bp, Homo sapiens
ggctccggaagcctgcgagttccggaagccttggtaatccaggattcggctaggaaaagacaagctttccagagaatgtttcagagaaagttacgtggagcgtgggcgtttcgcagactcataagtggtctggaacctaacctgcagtgtctctgagcttctggcaagtatgaggcgaggatttcacagaagaacttggagcaaaaattcccactgtcatagctataggctgtccagtcttgagggagctgcaggaacaggaaaaagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttat

SEQ ID NO: 24808 - DNA, 465 bp, Homo sapiens
  misc_feature 20, 394: n = A,T,C or G
gtatatattacccttaagtnttttcctgtcttcactaatttagcaatgcattcatattagctgatgaaaataggcactcacaatgacaaccagagccagtttcttgtcttttttatacattttgtcatcccagagacaatcagtatgtgcttacctgtgttcaagtagagaaaaatacagtagagtctgataggacatattctcgtaccacagacaaaacaaatcttatgttgcatttactatcaactgctgctaatacgttattataaaacttacctagctcctgaattcttcctatcttatagcttaaaaaaattaggatcataggcaaatcagttaccttgcagaaagagctttgtatgacagacattgtcttattttatttctgtaaaanttagcctgtatgaatatgattttaattaacaagaaaacatttcttcctgattgacaacagtgttagacaag

SEQ ID NO: 24809 - DNA, 480 bp, Homo sapiens
ccttatggccgggggtagtaaacctatgtttccttcccctttgtatatcttcccccagtatttagaacaagggttccatctcctggctggccatgtcttctgtgtaatgggaagagatgagatcattcaccaggtagttggttcagtgtgcagttgggaagacactgtgggttagagaaggcagataggaaactccttgtaggagtggaaagcattgagagggattctgacatttctttcttagagaacagggcctgtgtaaaggatgctcaactattcagcagtcttaatccaattcttgctttagacataagccgtttatctttctttcataatgaaagcatatattttcaaattccagatgcaatgtcataagataaagaagctgaaattagagtgcccagcaaatagatttttcatttgctttgaactaaactttaataacccatgacctccgacctaactgaatattctctcatt

SEQ ID NO: 24810 - DNA, 319 bp, Homo sapiens
tctgttgatgttaactgagctactagaagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatt

SEQ ID NO: 24811 - DNA, 472 bp, Homo sapiens
tacttccatgaattttaaaatctgagggaaatgttttgtaaacatttatttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataaagaatttgcatacttacctagtgaaacttttctagaattatttttcactctaagtcatgtatgtttct

SEQ ID NO: 24812 - DNA, 252 bp, Homo sapiens
  misc_feature 15: n = A,T,C or G
ggagaaggaactagnaaaaacaattctggtaatatgacaaaacaaagttctttaacacccccaaataatcacactagttcaccagcaatggatccaaacaaaaaagaaatccgtgatttacctgaaaaagaattcaaaaggtcagctattaacctaatcaagaaggcatcatagaaaggtgaagttcaatttaaggaaatcaaaaaaatgatacaagaaatgagaagagacatcttcagtgaaatatatagc

SEQ ID NO: 24813 - DNA, 489 bp, Homo sapiens
ggatttataaagggcattgccgatactttttgactgtgtaaattaagttaattttttgtatgatgtacagtttgtttaaccttagagcttctatagatttctactttattatacttgaatgaggcagaaaagcactgtggaaaatctgtagctctggatgcaacatgcagacataccaaaaaaataataataaagcaaggtactgaagagcaatgttaacagaatgctttatatccagaatgctatgtttttttcaagccacattttagttgaatgaagtaaagttattcaatcttttattttaaaatattgagaaagtcacaaatgattacctctttgatttgatgaacctataagtctattcatctctgttatttcatttctcaaatgtgagccttgttgaggtccattatcaaatctacactttggttgattatatgatggtttaggacaaggcagaaatttaaaacctgcatgtttagtgcatca

SEQ ID NO: 24814 - DNA, 296 bp, Homo sapiens
gtatctgtttgtatttttctttgatgaatgattggtcatgaggcctcttgcccactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaaatgtattgtgcattttggcttcacatgtttaactttttttaagaaaaaagttgcatgaatgg

SEQ ID NO: 24815 - DNA, 417 bp, Homo sapiens
  misc_feature 32: n = A,T,C or G
gaattgagttcaatgttagtttgatactaatnagtccattctgtttatttttgaattactgctttcatttggaatgcatttaaaaaataaattttaaaaaatacaaatataaataaaaattatatgtctgtattcacacacacattttgtgtatgtgtgtatatgtacacaagttaattaaataaaattgtggacttttaaataaaattatagatcaaataaattgtagacaattggtggaaagaggatggcctatgtcagatcgagccacctaacatttctttcagagagtacaaacattttgaagcatgtagtatctgcacgtgttttaaaattatgcataaattaattcttcgttaaatcctactgctgggtccttaagtgtcattaatttactgattctgccattatatttat

SEQ ID NO: 24816 - DNA, 364 bp, Homo sapiens
  misc_feature 1, 10: n = A,T,C or G
nattcctganacagtttgctaatttaaaaatgtagcattccatttgtatttatttctctcccttgccaaaaagattttctaatactgcttgtaccagccagagaaagatccaaaacactactcagctctcttgcactgagggaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttttatgttgcatgttgcttttgttatcagcctgattttttgctcagtatatgatagttctg

SEQ ID NO: 24817 - DNA, 165 bp, Homo sapiens
agcaaatgtggtaaaatgttaaaagtttttttaaaaatggtacgatgggctggccgtagtggcttacatctgtaatcccggcactttgggaggctgaggtgggaaaatcacttgagcccagaagtttgagaccagcctgggcaacaaagtagaccctatctctac

SEQ ID NO: 24818 - DNA, 353 bp, Homo sapiens
ggatttctaataatctgtctttctgaaaattcttagttgcctatggtcacaggaatttgtccccatttttataggacactattaaaactggtctacttgtgttagagacatggagggaattcattttcactggatcttgtcttggttaggtatttaggtactgtttgtttggtttgttaggtttgtctttaacctatagtagatccttatatgactataaagcaagggttaggtttaaataaataaaattattcagtgtcaaatgatggagtatctttcaagttcagtgaaaatgtggaaagtacagtttaaattacagcagtgggattgggaaacaaattatatgatagtac

SEQ ID NO: 24819 - DNA, 379 bp, Homo sapiens
  misc_feature 2, 13: n = A,T,C or G
gnagaattcggcncttatggccgagattgtagaactctatgaactgaagaagatattgaaatgatctttatcacttttaattaattagaagctggggccaggagcagtggctcatgcctgtaatcccagcactttgggaggccaaggtgggtggatcacctgaggtcaggagttcaagaccagcctggccaacatggcgaaaccctgtctctactaaaaatacaaaaatgagccaggcatggtgacatgtgcctgtaattccagctactagaggggctgaggcaggaggatcacttgaacctgggagttgggaggttgcagtgagctgagatcgtgccactgcactccagcctgggtgacagagtgggactccatctcg

SEQ ID NO: 24820 - DNA, 334 bp, Homo sapiens
  misc_feature 5, 11: n = A,T,C or G
gccgncccatngtggaccgggggatggagttggattcttcatacagcaaagtagctgccatgatttcaccaagtaaatatttgaggcactgctggtcacatggtctctgccataactgctctgctgttgtaatgccaaagtagtcatagacaatccatgaatgaataagtgtggctgtgtcattatcaaactttacacctaaatttgaattgcattaaactctcacatggtcaaaagagtcttacgatatgttttccccaaccatggctcacagctcccagaaaaataggtgatggactgtgtatcagccaccatttgcagatacttttttagg

SEQ ID NO: 24821 - DNA, 461 bp, Homo sapiens
  misc_feature 25, 221, 317, 376, 382: n = A,T,C or G
catcacagggtaaagcactaagtcngaggagtccctctctgaccttacaggttccctcctctccctgcagcttgatcttgggccctcacttttggatgaggtgctgaatgtaatggataaaaataagtaacaagatgccaacttttttcctttggggtaaaaggtacaaaaacaaactaaccacagttgaagagaagggcttccggagctgtatttgcagntttgtgttgggttttctaaaataatattcttacaaagtatttttttacctgttatgccctgtttgcaaaaacaatttagaaaaaaacaacaaagcnaaacctatcttggcaaaaaaaaggaagtgagtcagagcccattttcaggaggcattggngatgtncggctcacatattgtttgcagacacacaagaaatctggcttggccaggattggcacctagctatgaagggctgagcgag

SEQ ID NO: 24822 - DNA, 425 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgatt

SEQ ID NO: 24823 - DNA, 182 bp, Homo sapiens
aacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtg

SEQ ID NO: 24824 - DNA, 438 bp, Homo sapiens
  misc_feature 375, 437: n = A,T,C or G
ggtcaggattcttgatttattatatttgggtctagaaggtagcagtagggatcatttttgaaagttgggggatgatgtcattttggagaactcactatataagaagcacttggttgttttggacatgaaaattggggggcaggctgggcacagtggctcacgcctgtaatctcagcactttgggaggctgaggtgggcagatcacttgaggccaggagtttgagaccaacttggccaacatgatgaaacattgcctctaccaaaaatataaaaattagccaggcttggtgacacacacctgtaatccctgctactagggtgactgaggcaggacaatcacttgaacctgcgaggcggaagttgagtgagtgaaanggttgtgccacttgcactccagcctggcaacagagtgagattctgtctcaaaaaacaaaaant

SEQ ID NO: 24825 - DNA, 460 bp, Homo sapiens
  misc_feature 8: n = A,T,C or G
attatttnttttaaaattagtgtttttcatagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactggttactttgttgattctcagttactgtaggcatcaaaaggcaaaaatcaaga

SEQ ID NO: 24826 - DNA, 472 bp, Homo sapiens
ggcagataatttttagcttagggcctggtggctaggtcggttctctcctttccagtcggagacctctgctgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtgaattacagcaagctgaagaaggaacgtccggatttctaaatgaaatgtttcactataacgctgctttagaatgaaggtcttccagaagccacatccgcacagttttccacttaaccaggaaatatttctcctctaaatgcatgaaatcatgttggagatctctattgtaatctctattgggagattaca

SEQ ID NO: 24827 - DNA, 475 bp, Homo sapiens
gtggggcagccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaaagttgtcattgttgaagaagcacagagttcagaagactttaacatgggctcttcctc

SEQ ID NO: 24828 - DNA, 452 bp, Homo sapiens
gataatcattatttaaaaacatatcctgtttacctcatggggagcagggttgagaaccaattttctatgctttgagagaatcatagtagacagattagacagatgagaataaaaacagacatttagaagaggcatgtgagaaaattagcctctttgtgttaataatcctcatctgtgaaattaagataataacctcataaggttattgtgaagatttgaatgtgtgaaaacatgcaaagcacattgtgtttgcaatgtcaactattattacatcttcaccatagagtcaatcaaatagtgaacaaacattcctcggtacaatcttccatagattgtgctaggcttccctaaacactctgacactctacagtatatccagtcactcattcatttatcaggtgtgaagatcataagaggcactttttcagtcattatgtgacaatgccagaccg

SEQ ID NO: 24829 - DNA, 354 bp, Homo sapiens
ataaaagaattttgcctgccttttcagaatctcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacat

SEQ ID NO: 24830 - DNA, 325 bp, Homo sapiens
  misc_feature 1, 324: n = A,T,C or G
nataaaactttataaacaaacattttgtaaatagaatctatgctacagtaaaataattaacacaattatttacatgcaatactgacaaatttggcactttttgaaaagaaatgtacaaaacacttgctttaaaagaaatttaaaattataaaaactccgagcattactatcatgcactttgcaaatacctcacaagcacttatggcacagctatcagagagcatcaggctctctggtaatatttatgtaacttttaatgtgcttccataagtttgttgtaaaaccacctggacattgtcaagaataaagtcaaatgccatattnc

SEQ ID NO: 24831 - DNA, 444 bp, Homo sapiens
gcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatga

SEQ ID NO: 24832 - DNA, 265 bp, Homo sapiens
  misc_feature 41: n = A,T,C or G
ggtggttgtgtggtcgcgtctcggaaaccggtagcgcttgnagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggc

SEQ ID NO: 24833 - DNA, 415 bp, Homo sapiens
gtctacaactggatggtaaagttgattgaagtgtgcctcatgtagctttatgtttggggcatttgaagggctatggctggaccagagtgtaatataaatgcttaatagagaggggaaaagaagagtgtaagaaccattatagggctgggcccacgcctgtaatcccagcattttgggaggctgaggcaggcggatcacgaggtcaggagttcgagaccagcctgaccaacgtggtgaaaccccatctctactaaaaatacaaaaattagccagtcgcggtggcacgtgcctgtaatcccagctactcaggaggctgaggcagaagaatcacttggacccaggaggcagaagttgcagtgagccaagatcatgcctctgcaccccagcctaggtgatagaagtgagactccatctc

SEQ ID NO: 24834 - DNA, 121 bp, Homo sapiens
gaaggcattgtagactaatacgaatgggcagattatccaggaaatatggccgagaaaattggctcatatctgagaattcttctctggaattttaaatccaagataattgttaagcatattt

SEQ ID NO: 24835 - DNA, 293 bp, Homo sapiens
tatgtatatacacatatatatgagagaatcttcatgatcttgatgtaggagagaatttcttaaagaactaaaagtacaaatccaagaggaaaagattaataatttgactcccataaaattaagaactgctgtatattttcaaagatagcaccagctgtggcagtgaagtcatttgctatctgtaacctacaaaggtgtgagtatccagaaataggcaattcagtatgagttacggctttcaataggcacttctgagaagaggagatgatattatgatatactcacagatttgc

SEQ ID NO: 24836 - DNA, 470 bp, Homo sapiens
gggttttaagcaggatgtatcaatgcatgtcagatgggggtagataactttggggcaggttatcacaacctaagagttggtggagaaaacatgggaatgaattctagagaccacaaaatgaaaacttgaaagtgttactctttctcagcttaacgtttttaaatccaaaaaacaatttttacatttcttgggattcgaagagttgaacttcaggttgccgtggttacagtgtacagtatatatttatcagtctgtaccagtagaccagtaccctaactactgaaaagaatatggcagttttccatttgtctagtttctgtatgtacaatttactatccaattaattacttaagtggatttcttgttcttttttaaaaacttattgctacattgataggcagaatagcttctgaaagtgaccagttttcaatttcataggaagaggtgactcattgaaaaatagctcaagc

SEQ ID NO: 24837 - DNA, 472 bp, Homo sapiens
gggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggag

SEQ ID NO: 24838 - DNA, 473 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttggaaggcgatcttttaaaaagagattaaaccgaaggt

SEQ ID NO: 24839 - DNA, 306 bp, Homo sapiens
ggttgcccttggtctcggggtcgctgtaggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaaccccagtgaagaagttacctggaagtaaagactggctagattatcgaatgttcacattttaaagttctgagagaaataaaaacatgtagaatctgaaaaaaaaagga

SEQ ID NO: 24840 - DNA, 300 bp, Homo sapiens
  misc_feature 5, 16: n = A,T,C or G
agggnaattgcggccnttatggaccgggaatggctcacatctgtaatcccagtgctttgggaggctgaggtgggcagatcacttgaggtcaggagttcgagaccagcctagccaacatggtgaaaccccatctctactaaaaatacaaaaattagccaggcgaggtgatgcgtgcctgtagtcccagctacttgggaggctgaggtgagaaaatcacttgaacccaggacatggaggctacgatgagccaagatcacaccactgcaatccagcctgggtgacagagtgagaccctgtctc

SEQ ID NO: 24841 - DNA, 465 bp, Homo sapiens
  misc_feature 312: n = A,T,C or G
ggaatacagtggtgcaatcatggttcactgcagcctccctcctcccaggctcaggtgatcctcccacctcagcctcctgagtagctgggactacatagcaagccaccatgcctggctttttttttgtttgtttgtttgtttgtttgtattttttgtagagacgagattttaccatgttgctcaggctggtctcgaactcctagactcaagcaatctgcccacttagccccgaagagctgagattacaggcgtgagccactgtgccctgctagtctttaaaattctgcaataggtttagcagtgtcttagcanaaagtgctatttgagtgctggcgactggcttgcatagtggaaatatactggcctgagctctgcccacctgaccacatactgatgtcattatcctcccttcatcaaccccctctgcttcacatagtcttgtctgaagggaatgggtcagctgga

SEQ ID NO: 24842 - DNA, 471 bp, Homo sapiens
  misc_feature 461: n = A,T,C or G
gtaaatgagaattataaactctattccgttttggtatactaaatgttcttttaaccatctttaggaatatattgaaatgccaacaatagtttgaattgtgttctgtaaaaaagtattagtcaattatttttcaaaatgtagaattgtagaaaatgtcaatttttcaaactcatttttcattgctaggatttcttttaaaaaaattaaagtaatttcacttcatagcttgttgcattaacacctgtaattctattgtgaaagaaatttgattttttaattggtgtgtgttatgcccaagatgttaggatgaagatgctacctttttaaaaattttagttattggtaaaatgtttaattttacttaaaattaatttcttttcttgaaagttgtttattctgttctaaaagtagtcctgtcactgtgtttttatgctacttatagaaggggaactgattgccgntcctaggctg

SEQ ID NO: 24843 - DNA, 453 bp, Homo sapiens
  misc_feature 10, 204, 323, 324: n = A,T,C or G
tgcggccccntatggaccgggcaaagcaaatagtagaagctcaaacaacacagtaaaccaactagatttaacaggcatgtacaaaacactctacccgacaggactagtatacacatttttctcaagttcacatgggacattttctacaatagatgacatgatggactacaaattatgtctcaggaggtttttaaaagatagatntaaggcagagtattatctcggaccacaatgaaatgaaggtagaaataataacaggtaaaattagaatttgtgggaattgaacaccccaagacaaccaatgaatcaaagaaaaaattgtnngggaaactggaaaacacttagagatgaatgaaacacatcttagagaaagtgaaaacacaacacactaaaacttaatagtatgcaatgaaagcagtactgagggagaaatttatacctacaaacacttat

SEQ ID NO: 24844 - DNA, 415 bp, Homo sapiens
attcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttaagtaggcttctatattgcattt

SEQ ID NO: 24845 - DNA, 401 bp, Homo sapiens
cttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataatatttttttaaact

SEQ ID NO: 24846 - DNA, 250 bp, Homo sapiens
  misc_feature 7, 9, 56, 116, 203, 206: n = A,T,C or G
tcaggananatataatgaaaagggattattacaaaggggccttggaccttcttagngataccaacatggtttactttgctatggaatgtatacaaaaaacctttattctgatgatnttcctcatgctttgagagagaaaagaaccacagtggttgcacaactgaaacagcttcaggcagaaacagaaccaattgtgaagatgnttnggaagatccagaaactacaaggcaaatgcagtcaaccagggatg

SEQ ID NO: 24847 - DNA, 169 bp, Homo sapiens
  misc_feature 167, 169: n = A,T,C or G
taaggaaaaacttaatttgttcatccctaatttgatatatttgcaaaaaagtgttaattcactcattaaaacctaggcgtctgatgggtacagcaaaccaccatggcacgtgtatacctatgtaacaaacctccacattttgcacatgtatcccagaacttaaagtntn

SEQ ID NO: 24848 - DNA, 260 bp, Homo sapiens
  misc_feature 4, 7, 8, 122: n = A,T,C or G
ggangcnnggactgagttgtgggggagggaggcggttagcgggctttagcgccttttctggcggcggtagatttgaagcgcttcaaaggaccggacccagagaagaggaaaactctaccggngcaggacacagggatcagttgtccttgtttttttttggccttttcttcatttgaagattaagtattggagccatgggaataaaggttcaacgtcctcgatgtttttttgacattgccattaacaatcaacctgctgga

SEQ ID NO: 24849 - DNA, 312 bp, Homo sapiens
gaacgggggcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttgg

SEQ ID NO: 24850 - DNA, 468 bp, Homo sapiens
atggaactagggggagaggaaatgttagctatcctgatgacagtggtgatgaagatgactgttacaggttgaattgtgtcccttcaaaagatatcttgaagtactaacccccaaaacctcagattgtgtttttatttacaaataagctctccacagaggaaacaaaaattaaaatgaagtcattagggcgagcctggatccaaaatgactggtgtccttataaaggaaattaggacctagaggcagatatgcacagagggaagacgatgtcaaggcacacagggaggagacacccctgtgactgcagtgatgcagctacaattcagggaacataaaggatttctggcaaccaccacaagccaggaagaggcaaggaaggattctctctgagaagaaccggagagggtgtggccctgctgatatattgattttggaattctagcctcctgaattgtgagagaataaatt

SEQ ID NO: 24851 - DNA, 411 bp, Homo sapiens
  misc_feature 10, 14: n = A,T,C or G
ccttatggcngggntactataaccttcgaagcacttctttttgttatcaaaaagctaaactatgaaatccttccaatacgtgttgaatacaaagaagcctagataataaagagcccgttagactttatatgaaacctagtaaaagtataacctttggccattagaaattaagctttttcttttatatggtaaatgtatgctattaaaaacctggaaaaggacactttcatcctaactcctaagacttcattagttaaaatcctgctgtgatagaagccacagcctgtctttagaagtgggagctggtgctgtaataccttggtagaggtgggagctcacttttagtttgaagagtgtaggggttgtcaagataaaatataggatgcccagttatattttgaatttcagatc

SEQ ID NO: 24852 - DNA, 471 bp, Homo sapiens
  misc_feature 1, 71, 122, 135, 195, 240, 260, 356: n = A,T,C or G
ngatcactaacagaaaggaaatgatggaggaaagagtcagtattcttgaggctggattaatagaaactgtntactcgaacacagggtaaaattttaaatactgttatgaacaagaaaggttntaacaaataatgngataatgataaaatctgagcttcagaagggaagaacaatgaggatgctattgagagaganctcaaagacataatggctgaaaattctccaaacttgcaatgggcntaaacctacagatgcaagangatgagcaacttgccaaccagaatatacccaagaaaatccatgcaagcaacactgtagtcaaatttctaaaaactaaaaaaaatgttttgaaagcngcaagaaacaaatgacaccatagctatggggaaaacacaatgtgagtaacaggtggtgttattaccaggagagcagaataaccaataggatgtagctaaaatattcaaagtgctg

SEQ ID NO: 24853 - DNA, 482 bp, Homo sapiens
  misc_feature 333: n = A,T,C or G
gtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccanggccgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgag

SEQ ID NO: 24854 - DNA, 422 bp, Homo sapiens
  misc_feature 176, 182, 183: n = A,T,C or G
gatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatgnacccannaataggatttgctataatgggattcattggcttctttgtgaaattgatccatattcctattaataacatcattgttggtggctgaatacattttggaagagagtttttcatcttagagattggtggacaagtgtgagggtgtgagaaactcacagaatacaaatttgcctgtatgttttgtgggtttttttttttcctttcaagatgttttctatttctaaattaaaggaatttcaaag

SEQ ID NO: 24855 - DNA, 347 bp, Homo sapiens
gcctttccggcggtgacgacctacgcacacgagaaacatgcctctcgaaaggttctccttcatccctctccagaagaggagaagaggaaacacaagaagaaacgcctggtgcaagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccattctcaataagcacattttggat

SEQ ID NO: 24856 - DNA, 471 bp, Homo sapiens
ctattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagcca

SEQ ID NO: 24857 - DNA, 478 bp, Homo sapiens
  misc_feature 41: n = A,T,C or G
gatcccataggagcctctctccctactgctgctacacaagnaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgcccgaggggccaaatgagactgagggaagaaaaaaaatctctttttttctggaggctggcacctgattttgtatccccctgtagcagcattactgaaatacataggcttata

SEQ ID NO: 24858 - DNA, 391 bp, Homo sapiens
  misc_feature 4, 5: n = A,T,C or G
gcannctggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgc

SEQ ID NO: 24859 - DNA, 487 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaagtaatttgaaggcgatcttttaaaaagagattaaaccgaaggtgattaaaagaccttga

SEQ ID NO: 24860 - DNA, 345 bp, Homo sapiens
  misc_feature 110: n = A,T,C or G
tggaagaagatgatggaaatcatgacccgaggggggcagacaaatgacttgaaagaagtggtcaataaattgattccagacagcattggaaaagacatagaaaaggcttnccaatctatttatcctctccatgatgtcttcgttagaaaagtaaaaatgctgaagaagcccaagtttgaattgggaaagctcatggagcttcatggtgaaggcagtagttctggaaaagccactggggacgggacaggtgctaaagttgaacgagctgatggatatgaaccaccagtccaagaatctgtttaaagttcagacttcaaatagtggcaaataaaaagtgctatttgt

SEQ ID NO: 24861 - DNA, 436 bp, Homo sapiens
gctcatgaaaactgtacttcataaatattttttcttgaattttaaaactttacagtaaatttaggacccgaagacaccaaatatagacactgcttggggaggaagcctagtatgatgaggttaactgtgggcaatttcatttcctaccctaggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatggtaaggtttggggatgtggccttactactatggtgccaagct

SEQ ID NO: 24862 - DNA, 273 bp, Homo sapiens
ggactaaatgtagatgtctttagtatactttgtatgttcttaatattggaagataattttgtgaatctgtagattttattttttcagtcttaccttacaaatttcttttctatgaataatagaggaacttacggcactctgccatttgttaatgaaaggaagtgcagaggatttagaaaagtacatgatccccagaccacaacaaaccaaaacataaactcatgtctgtgtcccatggtcatagtcaaagattttgtactgctaaaattaccg

SEQ ID NO: 24863 - DNA, 499 bp, Homo sapiens
  misc_feature 2: n = A,T,C or G
cnggccgggagttctgataatgttaagaataaccattatgaaaaggaaaatttgtcctgtatagcatcattatttttagcctttcctgttaataaagctttactattctgtcctgggcttatattacacatataactgttatttaaatacttaaccactaattttgaaaattaccagtgtgatacataggaatcattattcagaatgtagtctggtctttaggaagtattaataagaaaatttgcacataacttagttgattcagaaaggacttgtatgctgtttttctcccaaatgaagactctttttgacactaaacactttttaaaaagcttatctttgccttctccaaacaagaagcaatagtctccaagtcaatataaattctacagaaaatagtgttctttttctccagaaaaatgcttgtgagaatcattaaaacatgtgacaatttagagattctttgttttatttcactgattaatatactgtggcaaat

SEQ ID NO: 24864 - DNA, 101 bp, Homo sapiens
  misc_feature 28, 68, 82, 84: n = A,T,C or G
ggaggcattgaggcagccagcgcagggncttctgctgagggggcaggccggagcttgaggaaaccgcngataggtttttttntntttgaaagatagagatt

SEQ ID NO: 24865 - DNA, 469 bp, Homo sapiens
  misc_feature 127, 229: n = A,T,C or G
gaaggtagaagaagatcatgaatcaccatcttcaggcagggtaccagcaccagaacacctccattgaagaaactgaatcagatgccagtagtgatagtgaggatgtatctgcagttgttgcacaagncctccttgacccaacagagacttttggtttctaatgcaaaccagacagtacccgatcgatcagatcgatcgggaactgatcgatcagtagcagggggtgganagtgagtgtcagtgtcagatctagagggcctgatggacagtgcacagtaactgaagtttaaataaaaatgtcttcagctccgtgctcaaggttgaaagggtaccctgtaaatttctgcccccataacattatactcatccctagtagtgcattttgggagttggggtgggaagggggtattgggaaggatagactcattaattaaaatgtctaacatgtctctgttgagaaatttattta

SEQ ID NO: 24866 - DNA, 268 bp, Homo sapiens
  misc_feature 178, 257: n = A,T,C or G
aatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcangtaagataaactatttaggaaaaaagtctgatgaatttaatgcctgtgggaaattgttactcaatattaagcatgatgnaaaacttcatt

SEQ ID NO: 24867 - DNA, 242 bp, Homo sapiens
taagtctaataataataactgataagtccattgaatttgcttctgattactttttctttagtagctaaacatgtatgtactcctatgattacaatgaacactcctctccatttaaattaattatttacatcgatgaaatagcaaaatgttaatgactaaatactgtcttggttttttcgttccaggtcagtcaatattaacttcttataattttcttttttttctttatgtgtgtgtgtgtg

SEQ ID NO: 24868 - DNA, 489 bp, Homo sapiens
  misc_feature 1, 31, 216, 468, 480: n = A,T,C or G
naggagtggcagaagatcccttcactcaganaagcaaggcttgatattagcttgttgaatgtaagagacacaaatgaagaagaacaaagagcctgagaaagcagcaagaggacatgatgaaaaatacgtggagttgatgagaaaggggagccaaggctttatacgtctaaagaaaatattcagtagctgaatccgcccagtgatagcctgtgggcnccagcagcaagggctgccatgggatacagcacccatctacaaagacctctattacataaacactgcttcttacaggaaacaaacctcttctgggatctccttttgtgaaaaccagtttgatgtgctaaaagtaaaaagtctattttccagggtggccttgttcagaagcagccagatttccaatggttgttttttccccttccactcagaaaccccctgcccttttccctttcagaaaacgatggcaggcanttcctcttgagnttacaagca

SEQ ID NO: 24869 - DNA, 468 bp, Homo sapiens
  misc_feature 225, 461: n = A,T,C or G
gaactcggtggtggccctgcgcagacagacttcgctcgtactcgtgcgcctcgtttcgtttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgcnaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgccttttcccatctgtctatctatctggctggcagggaaggaaagaacttgcatgttgggtgaaaggaaagaagtggggggggaanaaagtgg

SEQ ID NO: 24870 - DNA, 241 bp, Homo sapiens
  misc_feature 19, 21, 59, 239, 240: n = A,T,C or G
gaagaagaataagccaagnanaaagaggttaagctggctgtcctgaaatattataaggnggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaactaccnna

SEQ ID NO: 24871 - DNA, 472 bp, Homo sapiens
  misc_feature 3, 5, 135, 349, 424, 451: n = A,T,C or G
cgncntttatggcggggaagaaatgacatctttgaatcgctgtactacaggaaagaatgtacggagacatggcatgaagccggagagtgagagacattaactcattagactggaacttgaactgattcacatctnatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggactacattagtacacagcaccagaatgtatattaaggtgtggctttaggagcagngggagggtaccagcagaaagggtagtatcatcagatagcatcttatacgagtaaatatgcctgctattttgaagngtaatttgagaaggaaaattttagcgngctcactgacctgcctgtagc

SEQ ID NO: 24872 - DNA, 336 bp, Homo sapiens
  misc_feature 10, 14, 31: n = A,T,C or G
cccctctatngacngggattacccccaaagnatttgtgaagtttattcgaaaaaatctcctgtttctctggatgatagtgacattgaagctcgccttaatagttggaatcttgggatagaaaatcctcgatacctgagacagaagcctatcccagtttctctgcagatgacaccgaaattcagcctgagaaaatccagcagtttccatgatgatcattttctctctcgaatacgtgagaaagagctggacatgaaaacaaaaatgatggaagctaaatttcatgaagaaaagcttaaactgcaacagaaacatgatgctgatgttcagaagatttt

SEQ ID NO: 24873 - DNA, 403 bp, Homo sapiens
  misc_feature 12, 18, 296, 320, 349, 374: n = A,T,C or G
aaaatactgagnacttcncctcatgattgtgaatggagatgtaccagttcattttcttacctaaatctgggtgagtcttttaagagttactcattgaattaatctttattaataagataatttttgtaatttgttaaaaacaaaagattagtcatggatatttctatcttttcagatacaacagagtggaccaccctagtatcagattctcaggaagataaaaaaaattcaagaccaagaccaagagctggccactgtgctgttgcaatcggcactcgattggtatttttgggggnggaaagagatggctacaaaaagcnctgaatagtcaggttgctgcaggatcttnggatctggaaccgggaggaaagaanttttaaccaaaaaactttttcctttagga

SEQ ID NO: 24874 - DNA, 235 bp, Homo sapiens
  misc_feature 11, 235: n = A,T,C or G
aactaacaagncgaaacaaccagctaacatcataatgacaggatcaaattcacacataacaatattaaccttaaatgtaaatgggctaaatgctccaattaaaagacacagactggcaaactggataaagaggcaagacccatcagtgtgctgtattcaggagacccatctcatgtgcagagacacacataggctcaaaataaagggatggatgaagatctaccaagcaaatggn

SEQ ID NO: 24875 - DNA, 498 bp, Homo sapiens
  misc_feature 11, 15, 115, 135, 136, 206: n = A,T,C or G
caggcggggtnttcngcctttatgggcggggggctaacgatggatgtgaagaacctcttcaaggggaactacaagccactgctcaaggaaataagagaggacacaaacaaatggnaagcagaaaaaagcaggggnngaatcttagtttctgacaaaacagactttgaatcaacaaagataaaaaaagacaaagaagaacatcacantgataaaggaatcaattcaacaagaagagctaactatcctaaatatgtatgcacccaatacaggagaacccagattcacaaaacaagttcttagagacctacaaagagactcaggctaccacacaacaatagtgggagacattaacaccccattgccaatattggatcatctaggcagaaaattgacaagaaaggacttgaacacagctctggatcaagtgaatctcatagatatctacagaactctccaacacgaaacaacagactatatattattcttagtggcatatga

SEQ ID NO: 24876 - DNA, 103 bp, Homo sapiens
  misc_feature 11, 19, 25, 38: n = A,T,C or G
aaattcggccnttatggcncggganttctacaaaatgnaaaaattagctgggcatggtggtgcactgcctgtagtcccagctacttgggaggctggggcagga

SEQ ID NO: 24877 - DNA, 389 bp, Homo sapiens
  misc_feature 6, 148, 187, 197, 227, 261, 289, 333, 334, 389: n = A,T,C or G
cggccnttatggcggggggtgaaaaaaaaggtcttggtgaggtgccgccatttcatctgtcctcattctctgcgcctctcgaggagtttcagcagcggtatgttgggccagagcatccggaggtcacaacctctgtggtccgtaggancccttttgaggagggcctggaagaattgccattttcagnggaaacaagnggccgtactagctaagatgggttgactttngatctgcattgctccccccttcttgagtaagacnccactgcttaaacataaggtgttcagtnctcatttacagattgaagagcttttaagagggcagcctttggannggtcaaactagaactcatatgcctactagatttgttggcaataaacttatgacgn

SEQ ID NO: 24878 - DNA, 102 bp, Homo sapiens
  misc_feature 27, 28, 52, 74, 83, 91: n = A,T,C or G
ccgggtattcggcctttatgggggggnngatttaagaagctcctctgccagnaccaaaaggaaaagaagaaaangggccaaangccaaaangaaactgaggg

SEQ ID NO: 24879 - DNA, 282 bp, Homo sapiens
  misc_feature 4, 5: n = A,T,C or G
aggnnctagtatatcctccaagaaatataccacaagtttttccatttgactttgagctgctgttgaagtggtgagtgctgtgttttgagcttattttgaacctagatccttgtgaaaggtacaaatagaggtaatagttaagttatggcatttattaagaagttttattatttggcttcctttagaattattgtgaagtttaaaaatagcctttctcctgcaaattttcctagtctttagtaactgttagtgttctatatagcacaaacttgaatctctcag

SEQ ID NO: 24880 - DNA, 467 bp, Homo sapiens
  misc_feature 145: n = A,T,C or G
aatgttgggacacctaaatatacaaagcaatattaacagaatggaagagagaaatagacagcaatacaatagtattaggggactttaataacccccatggaaaaatgtatagatcatccagaaaaaaaatcaataaggaaacagngggaggaataacactgtgggccaaatgaacctaacagacaaatacagaacatgctatccaacagcaaaagaatacaaattattgtcaagtgcaaagagaatattctcctgtttagatcatatgttgagccacaaaataagtcttaacaaatttaagaagattgaaatcatatcaaatatattttctaaccacaatggtataaaaagacaaatcaataagagaaaaactggaaattttacaactgtgtggaaattaaacaacacacacctaaacaatatgtcaaagaagaagtcaaaaatgacatttaaaaatatcctgagac

SEQ ID NO: 24881 - DNA, 475 bp, Homo sapiens
  misc_feature 429: n = A,T,C or G
ggaggtacagaagcagctgtattggttacaggcttatttgccttatttgaacagaggttgaatagttggccacctttgattggctgaaactcagtgattggcacatgagtaggttccagtctgtttacacacccattcagtctacagtttactatgtgaaagtttatgaaaaaacctttagaataggtaaagagacacctttaggctaaacttaatttaacaaatgctactgactgattaagtaagaagactcaagagtgtcctttgggttgttagcatggaggtcgttggcaaccttaaagagacatttcagtggagtgccaggcagggtggtgacacctggatcacacagatatgaatgactagagactatgcttttgagaagttttgatgtgaaggggagcaagaaatggactggtggccaaggcncctgaggagtcaagggagtgttttctttttcggatgaatgaatctg

SEQ ID NO: 24882 - DNA, 361 bp, Homo sapiens
  misc_feature 1, 9: n = A,T,C or G
nattcggcnttatggcggggatttcacatttgatatgtagagaggaataggggttagtttatgtttatattgaaaaactttaaagactatttggaagttccagaaattctggttttaattcaagtaaaatgataaaatagtcattatatagttcaggatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactg

SEQ ID NO: 24883 - DNA, 191 bp, Homo sapiens
gtagaaaatggagacatggcgaaccgtctctacagaaaatacaaatattaaccaggcatggtgtcatacgcctgtactcacagctactcaggaggctgaggtaggatcatctgaacccgggaggcagtttgaggtgagccatgatcatgccactgccctccagcctgggtgacagagcaagaccctgtctc

SEQ ID NO: 24884 - DNA, 496 bp, Homo sapiens
  misc_feature 19, 20, 40, 127, 202, 344, 483: n = A,T,C or G
gggagccggggaattcggnntttatggcgggggtatcttnctttgaattagattttcattgcaccttacctcaattctgttgcacatttatttaaagatctgataaactgagaaaagtatacttttngaggatacatttcaaccatttttttctgagttcatatatatcagggcattagggcagctcagaaaatcacaagtnggaaacatagtcttaacaaatttgttatttaaaggaaagagaaatagcataaaattaagatcaaatttatcaccacagtatgtctactttcactggtatcagagtctctggggcagaaattatgtctgtgtctcttgcttgngtgcttttttcctccctatctcttgaaattcaaactttgaatatagtaaaattctggaaagctatataagaatatggcttatattcttatatatataccttatatacttaaggaataagtaatcttaaataatcagagntatggacaaagat

SEQ ID NO: 24885 - DNA, 101 bp, Homo sapiens
  misc_feature 9, 17, 30: n = A,T,C or G
aacccgggnattcggcnttatggcgggcantttgggaggccaaggttggtggatcacctgaggtcaggaagttcgagaccagcctggccaacatggggaac

SEQ ID NO: 24886 - DNA, 150 bp, Homo sapiens
gtggagccttctctctttttcccaaggagtccccagctgtcagaaaagtaccttaggtcctctcatgtgggcattcagagtggcaggaagacagactggggaaataattcagttgactgagaagaaagacaaacaaaaactcattcctcg

SEQ ID NO: 24887 - DNA, 473 bp, Homo sapiens
  misc_feature 165: n = A,T,C or G
gggtggctggacaaaggatgacgatgttcctttgatgtggcgtatgaagcagcatgctgagtgttggaggaaggagttctgaatcctgagacgacagtggtggccatcttcccatctcccatgatgtatgctggaccaactgaggtccagtggcattgcagagcncggatggttgcaggagccaactttttacattgttggacgagaccctgctggcatgcctcatccagaaacagggaaggatctttatgagccaagtcatggtgccaaagtgctgacgatggcccctggtttaatcactttggaaatagttccctttcgagttgcagcttacaacaagaaaaagaagcgtatggactactatgactctgaacaccatgaagactttgaatttatttcaggaacacgaatgcgcaaacttgctcgagaaggccagaaaccacctgaaggtttcatggctcccaaggcttgga

SEQ ID NO: 24888 - DNA, 142 bp, Homo sapiens
  misc_feature 2, 22, 48, 53, 65, 77, 133: n = A,T,C or G
tntagcccgctaccctgaggtnatagaacactcccagggaaacagcangacanggcctgaaagtntctgcagtgtanccccttccactcatgacaagacattaggacccggagcggaggagaagacggaggtncatgagaga

SEQ ID NO: 24889 - DNA, 491 bp, Homo sapiens
aactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcaccgaaacacactggggaatggagcagaacagtctttgaatatcgaacacgcaaggctgtgagactacctattgtagatattgcaccctatgacattggtggtcctgatcaagaatttggtgtggacgtt

SEQ ID NO: 24890 - DNA, 301 bp, Homo sapiens
  misc_feature 103, 106, 109, 274: n = A,T,C or G
gaggcattgaggcagccagcgcaggggcttctgctgagggggcaggcggagcttgaggaaaccgcagataagtttttttctctttgaaagatagagattaatncanctncttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaancttcttcatggagtaaaaaatgtatct

SEQ ID NO: 24891 - DNA, 190 bp, Homo sapiens
  misc_feature 5, 7, 188: n = A,T,C or G
gaaancncaggggaattcggccattatggaccgggcggtggatcactcggctcgtgcgtcgatgaagaaacgcagcctagctgcgagaaattaatgtgaattgcagggacacattgatcatcgacacttcgaacgcacttgcggccccgggttcctcccggggctacccctgtctgagcgtcgcttgnga

SEQ ID NO: 24892 - DNA, 328 bp, Homo sapiens
  misc_feature 7, 11, 71: n = A,T,C or G
gttatgncagngaggaaggaaagattatgtcttcccctctttccaaagaagctgagacagaagtacaacgngcgatccatgcccatccgaaaggttgatgaagttcaggttgtacgtggacactataaaggtcagcaaattggcaaagtagtccaggtttacagggaagaaatatgttatctacattgaacgggtgcagcggggaaaaggctaatggcacaactgtccacgtaggcattcaccccagcaaggtggttatcactaggctaaaactggacaaagaccgcaaaaagatcctcgaacggaaagccaaatctcgccaagtagt

SEQ ID NO: 24893 - DNA, 454 bp, Homo sapiens
  misc_feature 17: n = A,T,C or G
agaatagagaacccagnaaacaaatcctcacatctacggtgaactcatttttgacaaaggtgccaagaacatacactggggaaaagagagtcacttcaatagatggtgctgggaaaactggacatccatatgcagaagaatgaaacttgacccctatctcttgccatatacaaaaaccatttcacaatgaagacttaaatctaatacctcaaactatgaaatgactacaagaaaacactgtagaaactctccaggacattgatctgggcaaaaatttgttgagaaatatcccaaaagcacatgcaacccagaacttaaagtataataataaaaaagaaatggcaataccaattttactcaaactattctgataaatagaggaggaacgaatagttccaaaatcattctacaaggccaatattacccctggtgccaaaatcacactagaatacat

SEQ ID NO: 24894 - DNA, 332 bp, Homo sapiens
  misc_feature 38, 44, 60, 61, 65, 67, 70: n = A,T,C or G
gaagcaacttaagtaattgtagccttgactccttgagnactgtngatttcgatccagganncgtntntanagcacctgccagatgccagaaatttataccatttaaaactcagtaagtcttttaaatatcaggaaggagagaagcgacatcatgatacatcctatgggtattaaaaagccaatagaatattatgaataattttatgctaataaatttaacaacttcaacatcataaacaaattccttgaaaaataaaaagtaccaaaattcattcaagaagaaatagataccagcctgagcaacatggcaaaatcccatctctacaaaacat

SEQ ID NO: 24895 - DNA, 269 bp, Homo sapiens
  misc_feature 24: n = A,T,C or G
atgattccctggattatgcaaagnaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttt

SEQ ID NO: 24896 - DNA, 500 bp, Homo sapiens
  misc_feature 12, 22, 27, 28, 31, 141, 312: n = A,T,C or G
cccacgaaggtngtccgtccgnccccnnttngaccggggaggcattgaggcagccagcgcaggggcttctgctgagggggcaggcggagcttgaggaaaccgcagataagtttttttctctttgaaagatagagattaatncaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaancttcttcatggagtaaaaaatgtatttaaaagaaaattgagagaaaggactacagagccccgaattaataccaatagaagggcaatgcttttagattaaaatgaaggtgacttaaacagcttaaagtttagtttaaaaagttgtaggtgattaaaataattttgaaggcgatcttttaaaaagagatt

SEQ ID NO: 24897 - DNA, 194 bp, Homo sapiens
  misc_feature 2: n = A,T,C or G
tngcccgggggaaaatatcttgcttgagcctgaatcgattgtagagagccagggtaaagaatggcagaaagggagaggcaaaagcaagggagaaaaagcaaggaaaaaacagagcaagggagtgatttggctagggcagacaaaagatttcagagaagggataattaagatgagttacatatgatactattact

SEQ ID NO: 24898 - DNA, 182 bp, Homo sapiens
gtttgaaacagcaacgcttcggtcagggtatcttttaccagacactaaagcatatggagatagaatagaaagaatgcttcgcctcagtttgaacattgaccctgatgcaaaggtggaagaagagcctgaagaagaacctgaagagacagcagaagacacaacagaagacacagagcaagacg

SEQ ID NO: 24899 - DNA, 408 bp, Homo sapiens
  misc_feature 34: n = A,T,C or G
gatatgtgaaaactgcagtaaaaataaacccagnatgctaaatcattcctacaaaggtttgactgaaactgtggcagatgtctcatcttctttatatgttaagcagcatactcttctgatttttattgcaatcttttaccaagtggtgcacaaacttggtattgatgtctttattccattttgagtttagattgagaatatttttattttctgaaggcagagatatctactgtataattgcaccaaagtacatttgaaaggaaggttttcaatagtgtaatactgcagcgatgtagataaaatcacaaatgtataatgtgttaggttgaataaggtgtggaaaatgcttttctgttagtagaatgcaaaaacctacctaagccacataataataaaattcttttacca

SEQ ID NO: 24900 - DNA, 251 bp, Homo sapiens
  misc_feature 2, 6, 247: n = A,T,C or G
gnggancggggcatcagcacagcaaaggaaaaaaatcagtaaaatgaagagacaacccatagattgggaaaaaaaaattacatataacccatctcatgaggagttaatatctaaaatatataagagactcaaattactcaataacaagaaagcaaataaccctatttaaaaataaacaaagtacatgaatagacagttctcaagaaaagacatacaaatggcaaatagatatataaaaaatgcttangtcc

SEQ ID NO: 24901 - DNA, 125 bp, Homo sapiens
  misc_feature 125: n = A,T,C or G
taatataggctttaaattgctttagttgtattccattaatttttatatgtgcgcgatgactatctaggccagtggcttgagggaaacagaatttaccaagacagttgtaggcaggtgaaaggccn

SEQ ID NO: 24902 - DNA, 420 bp, Homo sapiens
  misc_feature 5, 6, 25, 28, 39: n = A,T,C or G
agagnnggagagctaaagtccaagnagnaggatccgagnaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttc

SEQ ID NO: 24903 - DNA, 473 bp, Homo sapiens
  misc_feature 2, 4, 39: n = A,T,C or G
gnangacacggggtaactcggtggtggccactgcgcagnaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtgggaag

SEQ ID NO: 24904 - DNA, 178 bp, Homo sapiens
  misc_feature 131: n = A,T,C or G
acaaatgctacattaatgtttgggtggtcagattctactttgaatctgaagtttgcagatatgcctatagatttttggagtttaccactttcttattctgtatcattaatgtaatattttaaattactatntatgttaccatttttctggatttagtaagaaatttgcagttttggtt

SEQ ID NO: 24905 - DNA, 480 bp, Homo sapiens
  misc_feature 2, 45, 64, 75, 269: n = A,T,C or G
angccgggaaaggtttggtcctggccttataattaattagaggtnaattacacatgcgaacctncatagaccggngtaaaatcccttaaacatttacttaaaatttaaggagagggtctcaagcacattaaaatagcttaagacaccttgcctagccacacccccacgggactcagcagtgataaatattaagcaataaacgaaagtttgactaagttatacctcttagggttggtaaatttcgtgccagccaccgcggtcatacgatnaacccaaactaattatcttcggcgtaaaacgtgtcaactataaataaataaatagaattaaaatccaacttatatgtgaaaattcattgttaggacctaaactcaataacgaaagtaattctagtcatttataatacacgacagctaagacccaaactgggattagataccccactatgcttagccataaacctaaataattaaatttaac

SEQ ID NO: 24906 - DNA, 111 bp, Homo sapiens
  misc_feature 3, 11, 28, 29, 85: n = A,T,C or G
ggnaggccgangtgggtggctcatgagnncaagaaatcgataccatcctggctaacatggtgaaaccccgtctccactaaaaatncagaaattagttgggcatggtgacac

SEQ ID NO: 24907 - DNA, 216 bp, Homo sapiens
  misc_feature 20, 38, 42, 55, 109: n = A,T,C or G
gtggccgggaacaaagcatnatatttcgcccactaagncaanccctttattgacncctagccgcagacctgctcattctaacctgaatcggaggacaaccagtaagctncccttttaccatcattggacaagtagcatccgtactatacttcacaacaatcctaatcctaataccaactatctccctaattgaaaacaaaatactcaaatgggcct

SEQ ID NO: 24908 - DNA, 462 bp, Homo sapiens
  misc_feature 224, 398: n = A,T,C or G
gattcaattatgttcagtatacttggttttgaaagctgatggactgtctaatacattttttaaagattttgagaaatgattcaaatttaaatggttttggaattgaagaactgtaaacttcgctcatgtaaaaaattaagctcattttttcatcatggcagatgattaagttttctaggttgcagcctttagtgttaaaactacatagtctggccgggtgcggnggctcacgcctgtaattccagcactttgggaggccgaggtgggcagatcacgaggtcaggagattgagaccaccctggccaacatggtgaaatcccgtctctactaaaaatacaaaaattagcttggtgtggtggcacgcgcctgcaatcccagctactcgggaggctgtgganggagaattgcttgaacccggaaggtggagattgcagtgagccgagatcataccactgcactcca

SEQ ID NO: 24909 - DNA, 143 bp, Homo sapiens
  misc_feature 15, 16, 20, 28, 29, 57, 60, 63, 82, 99, 107, 130, 132: n = A,T,C or G
aagaaaaaacctttnnaaanattcctgnnccctaatttgcacgaagattttctaccncangangtgccttgccttccgagantaagtattacctttaancaatatcngcgcacacacatagctgcatgtncngctcgtgtagt

SEQ ID NO: 24910 - DNA, 100 bp, Homo sapiens
  misc_feature 12, 85, 91, 99: n = A,T,C or G
attgtggctggnatggaacaacataccttggggacccctggctggcacaccttgcctctgaatttctgggcttggtcttccaggnggcatntgcctgang

SEQ ID NO: 24911 - DNA, 148 bp, Homo sapiens
  misc_feature 2, 5: n = A,T,C or G
tnttngccgggggtggtgcttgcctatagtcccagctactcgggaggctgaggcaggagaatcacttgaactggggaggcggagattgcagtgagctgagattgcgccattgcactctagcttgagtgacagagcaagagtctgtctc

SEQ ID NO: 24912 - DNA, 500 bp, Homo sapiens
  misc_feature 2, 7, 450: n = A,T,C or G
cngaaantttgctttctgaacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaagaattcaccccaccagtgcaggctgcctatcanaaagtggtggctgggtgtggctaatgccctggcccacaagtatcactaag

SEQ ID NO: 24913 - DNA, 460 bp, Homo sapiens
  misc_feature 2, 13, 27, 61: n = A,T,C or G
gncataatagagnatagaaagcacagnaaggagcgtggatcggaagagaagggatacttcnggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtggaggttccaaaatatgt

SEQ ID NO: 24914 - DNA, 359 bp, Homo sapiens
  misc_feature 1: n = A,T,C or G
ntatgtagaaagctgaaactggatcccttccttacaccttatacaaaaattaattcaagatggattaaagacttacatgttagacctaaaaccatgaaaaccctagaagaaaacctaggcataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatcggacaaagggctaatatccagaatctacaatgaactccaacaaatttacaac

SEQ ID NO: 24915 - DNA, 465 bp, Homo sapiens
  misc_feature 3, 129, 297: n = A,T,C or G
ctnaagaaaagccctcatttttataacctggcaaaatcttgttaatgtccttgctaaaaaataaataaaagctagatactggaaacctaactgcaatgtgaatgttttacccacatgacttattatgcntaaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagnaaagcttttcttttttaatttccaggaaaaaataaaaagagtatgagtcttctgtaattcattgagcagttagctcattttgagataaagtcaaatgccaaacactagctctgtattaatccccatcattactggtaaagcctcatttgaatgtgtgaattcaataca

SEQ ID NO: 24916 - DNA, 382 bp, Homo sapiens
agagaattggtaaacaaaatgcattatatacatacaatgcaatatcatttagccttaaaaacaaaattctgccatatgctacaacatggacgttatgctaagtgaaataaaccagttccgaaaggacaaatacacccatttccacttatatggggtatctaacgtcaaactcagaagaacaaagtactgcggtatttgccacaagctggtggaggagaaaatgagttgttcaatgggtattgagtgtcagccacgcaagatggaaaagctttttgagatttgttgtataaaaatatgcctatagttaacaatactcttcggtacacacaaagtatgtgaaagggtaaattttatgtgtttttatcacaataaaaattgtagt

SEQ ID NO: 24917 - DNA, 157 bp, Homo sapiens
ggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaccc

SEQ ID NO: 24918 - DNA, 254 bp, Homo sapiens
  misc_feature 107, 110, 125, 179, 220: n = A,T,C or G
ggaggcattgaggcagccagcgcaggggcttctgctgagggggcaggcggagcttgaggaaaccgcagataagtttttttctctttgaaagatagagattaatccanctncttaaaaaatatagncaataggttactaagatattgcttagcgttaagtttttaacgtaattttaatancttaagattttaagagaaaatatgaagacttagaagagtancatgaggaaggaaaagataaaaggtttctaaaac

SEQ ID NO: 24919 - DNA, 156 bp, Homo sapiens
  misc_feature 20, 26, 33: n = A,T,C or G
atcaaatgaatgaacaaagnactagnagacagnagttgcctggccttattctttaaatacccacactataggactgcaacaaaatacagagccctagtgattagaagacttcaaaagtgtgttttctttttccaggtgcatgcctttgatttcttg

SEQ ID NO: 24920 - DNA, 500 bp, Homo sapiens
  misc_feature 3, 7, 489: n = A,T,C or G
cangggnatcaatggacagtccgtggtctccgccaatgatgtcagcgacgtcattaaaagggaaagcaccctgaacatggtggtccgcaggggtaatgaagatatcatgatcacagtgattcccgaagaaattgacccatagacagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagnaagaagcccca

SEQ ID NO: 24921 - DNA, 327 bp, Homo sapiens
  misc_feature 9: n = A,T,C or G
agaacgggnataggtttggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccgcacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctcccct

SEQ ID NO: 24922 - DNA, 284 bp, Homo sapiens
gcttttacctcgttgcactgttgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttg

SEQ ID NO: 24923 - DNA, 470 bp, Homo sapiens
gataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggggggtgattattttttatactgtatgtgccaaagctttactactgtggaaagac

SEQ ID NO: 24924 - DNA, 476 bp, Homo sapiens
  misc_feature 5, 26, 30: n = A,T,C or G
ctatngaccgggaacagggcagcagnaagnaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcacttgaagagccaccctgtggaaacactacatctgcaatatcttaatcctactcagtgaagttcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgc

SEQ ID NO: 24925 - DNA, 494 bp, Homo sapiens
  misc_feature 5, 13: n = A,T,C or G
acagnaggaaagncatcacttagtgctcttacccagctgatgaaaaagatgccccatttccgaaaacagattactaagcaagttgtccatcttaacttagcagaagattgcatgaataagttcaagcttaatatagaaaagctctgcaaaactgaacaggacctcgcacttggaactgatgcagaaggacagaaggtgaaagattccatgcgagtactccttccagttctactcaacaaaaatcatgataattgtgataaaataagagcaattctactttatatcttcagtattaatggaactacggaagaaaatttggacaggttgatccagaatgtaaagatagaaaatgagagtgacatgattcgtaactggagttacctttggtgttcccattgttccccaatctcaacaaggcaaaccgttaagaaaggatcggtctgcagaagaaacttttcagctctctcggtggacaccttttatcaaagatatta

SEQ ID NO: 24926 - DNA, 269 bp, Homo sapiens
tgtagaagttatgtgtaatttttaaaaacatttcttgtcataggttctattagtaaaaatatatacagatatatatgcaaagtcttaggagatattttccatgcgaattaaacttttaactgctttaattgttttttcaaatagagaacagcatagaaaatatgacattttctgtgtgccctgttcagtttagtttacattaattaccacataaaattccaagatctatgatcaaagtttaataactgacaagttactagtaatttagt

SEQ ID NO: 24927 - DNA, 301 bp, Homo sapiens
  misc_feature 5, 7: n = A,T,C or G
tccangnaccggggaggcattgaggccgccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagt

SEQ ID NO: 24928 - DNA, 498 bp, Homo sapiens
  misc_feature 1, 3, 38: n = A,T,C or G
ngncttatggaccggggaagctttattatattttccgnatgtgattggaaaataatcttttctaatttgtgataaaaattaaatatatagatttagttatacacagttaatgaattaccttactgaagaaagtgaaattatttgaaattatagcttttgagaaagtattaattctacatcatacaaaaggctggtatttggtataacttataaaacaggtatctaggccaggcgcggtggctcatgcctgtaatcccagcactttgggaggctgaggcgggcggatcacgaggtcaggagttcgagaccagcctgtccaacatggtgaaaccccatctctactaaaaatacaaaaagttagacaggcgtggtggtgtgtgcctgtaaccccagctactcaggaggctgaagcaggagaattgcttttacccaggaggcggaaattacaatgagctgagatcacgccattgcactctctctggcctgggtaacagagcg

SEQ ID NO: 24929 - DNA, 429 bp, Homo sapiens
  misc_feature 14, 20, 22, 28: n = A,T,C or G
gggaaacttgaagnaacagnanaccagnaaagagtaaaaccttttatgacaggggctgcagaacaaatcaagtacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaact

SEQ ID NO: 24930 - DNA, 334 bp, Homo sapiens
  misc_feature 3, 35: n = A,T,C or G
aanagggccggggggatttgggaaggctttaaagnacgcatgttatggtgctaatgtactttcacttttaaactctagatcagaattgttgacttgcattcagaacataaatgcacaaaatctgtacatgtctcccatcagaaagattcattggcatgccacgggattctcctccttcatcctgtaaaggtcaacaataaaaaccaaattatggggctgcttttgtcacactagcatagagaatgtgttgaaatttaaccttgtaagcttgtatgtggttgttgatcttttttttccttacagacacccataataaaatatcatattaaaattc

SEQ ID NO: 24931 - DNA, 500 bp, Homo sapiens
  misc_feature 5, 10, 31, 32, 39, 40, 53, 299: n = A,T,C or G
cgccntatgnccgaggtccctctccatgtannaggaatnngagcccactgagngtaccagtgcattaatttgggcaaggaaagtgtcataatttgatactgtatctattttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagancaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgt

SEQ ID NO: 24932 - DNA, 471 bp, Homo sapiens
  misc_feature 139, 278, 449, 453: n = A,T,C or G
gggtttcaccatgttggccaggctggtctcaaactcctgacctcaggtgatccaccctcctcggcctcccatagtggctgggattacaggcgtgagccactgcacccagcctctatttaaaattctttatttctgtttncctaatttgattaatacagctgtaaaaatagcaaacgtgtatctaaagtgttatttcagtggcaaaggaatgtttttattttgtcgaatttatatgtgatttttaagtgaaatatttgtgtggatcttggggttttggnagcgtataaagccaataaaatcagagacttagggctacagaagggaaaaaatcctcaacatcacattcagcaatggtttagattcatgaacaagttgatagtcaaatcctgagtataaaatactttgcattctatcaacttctcaaattactagtaagaacttcatatttngggngattctctcattgactgt

SEQ ID NO: 24933 - DNA, 227 bp, Homo sapiens
  misc_feature 4: n = A,T,C or G
gganatattcattgaataaacaattaccatagttttgaatgagggagagcatgtgaaagaaaatatttgcctatgtggggtggggggaggggagagggatagcattgggagatatacctaacgctagatgacgagttagtgggtgcagtgcaccagcatgccacatgtatacatatgtaactaacctgcacaatgtgcacattgtaccctaaaattaaagtataatc

SEQ ID NO: 24934 - DNA, 319 bp, Homo sapiens
  misc_feature 4, 26, 28, 29, 30, 34, 35, 36, 38, 39, 46, 47, 48, 54, 225: n = A,T,C or G
ctgnaagcgtaaaatgattaggtccntnnngaannnanntcagaannnagagangtccacaatgctctctcaataattaatagaacaagtcaacagaaaatcttttaggatatagaaggcttgtgctatgttatcaaccaatgggcataattacaattttataaaaatgcttcatccttcaacagtgaatacatactctttaaattcaaatggttcacttacaanggttagaccatattatgggttataaaacaagtcttaagatggtgaaattaactagcaattagtaacaaagttatttccaaataaccgcatgagc

SEQ ID NO: 24935 - DNA, 130 bp, Homo sapiens
  misc_feature 28, 53, 84: n = A,T,C or G
gaaggccactatcatcctccgtctgctngcacaagtttcctgggctggaccgnatcaacagagaggcttattagactttatgcnagaagatgaggctgctgggataggcccagaagttcctgatgaccgc

SEQ ID NO: 24936 - DNA, 413 bp, Homo sapiens
  misc_feature 29, 229, 398: n = A,T,C or G
ccatttcagctgtcttttgattaatgttntcgtggcactcatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagccgggntatgtcttttctattctactgttatcacatttgtaccacttaaagtggaatctaggcactttatcaccatttagatcctattaccttttctcatctaggatatagttatcttctacataatcttgctgtatcttaaaacccatcaataaattattatatattttctacngttaaatcactcaga

SEQ ID NO: 24937 - DNA, 417 bp, Homo sapiens
  misc_feature 3, 18, 239: n = A,T,C or G
gcntgtggttaaatgtcnttgtttctatgattgtaaactattaaattctgttcctattaaagtacagatctaatctaagtattattaagttgatagccctctagtcagttatattgctattgtaaattcttgtttgttgagtaaaatgtttaaatactatatgtatctcatgtacaaagttgacatacattatattcatgtcataaaattaaagagattagattatatactgtcacttncccaagcagctaccttggtgtattcaatttctaatctgcctcaaaactgcccttctgtagtttgcaccaaaacagacccttttttaataattaaaaagggatgccccatctctctaaagttactatggcattagaaatagttattaaaatttgacttttgacgtgaatgggagccagc

SEQ ID NO: 24938 - DNA, 248 bp, Homo sapiens
  misc_feature 2, 46, 48, 165: n = A,T,C or G
anatccacagtactcactttttccaaatgatcctagtaattgcctntnaatatctttctcttacctgttatttatcaatttttcccagtatttttatacggaaaaaattgtattgaaaacacttagtatgcagttggataagaggaatttgggtataattatggngggtgattattttttatactgtatgtgccaaagccttactactgtggaaagacaactggttttaataaaagatttacattccg

SEQ ID NO: 24939 - DNA, 441 bp, Homo sapiens
  misc_feature 5, 10, 29, 110, 112, 113, 263: n = A,T,C or G
acggngactntgaagacttggaaacaggngacatgctttagggaaaatcgggccccgacactcagaatgaagatatagagaaacaagggaagaaattgaccccgacgganannaaagtgccaagaaaaagcatttggataagaagagaaaattgaaggagatgtttgatgcggaatatgatgaaggagaaagcacatattttgatgatcttaaaggagaaatgcagaaagaagcacagctgaatcacgtagaatttgaacgtnagatgatgaagccagagttcagtatgatggttttcgacctgggatgtcatccgcgttgagattgaaaatgttccctgtgaatttgtgcagaactttgacccccattaccccattatcctgggtggcttggcaacagcgagggaaatgttgacacgtgcagatgcgtctgaagaaacat

SEQ ID NO: 24940 - DNA, 197 bp, Homo sapiens
  misc_feature 21, 50, 164: n = A,T,C or G
ctagggcagccagggtagagnagtgcatttctacataaaaaagaaactgnatctttatatttttaaaaattgtttttgctgctcaagaaatggtaccctcttgtcaaaaaaggcatacattcataattgtaccattcagcattgtaaataatcttatgaaaccntttttgattgaagctattcaaaataaaaatttt

SEQ ID NO: 24941 - DNA, 423 bp, Homo sapiens
  misc_feature 3, 13, 28, 29, 37, 41, 45, 47, 81, 117, 270, 272: n = A,T,C or G
canggtgaaaccncgtgtctgctaggannacaaaaanaaantttncngggctgccatcaacgaagtggtaacccgagaatncaccatcaacattcacaagcgcatccatggagtttncttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggcngngcagaaaacgtaatgaggatgaagattcaccaaataagctatatactttggttacctatgtacctgttaccactttcaaaaatctacagacagtcaatgtggatgagaactaatcgctgatccgtcagatcaaataaagttataaaattac

SEQ ID NO: 24942 - DNA, 213 bp, Homo sapiens
  misc_feature 30, 66, 69, 120, 185: n = A,T,C or G
tggccaaagttttacacaattgaaaatggngtaaaacagacggcatgtgtttaaacctgagtttancantttggcaggaagttgcaggagagagaggcagtgacccaagccagtgcactngatgttcatggacatatattttttttaaataataaattaaaacattttaaatagaagcataaatngagttgtttgttggcgctgagatactgc

SEQ ID NO: 24943 - DNA, 100 bp, Homo sapiens
  misc_feature 16, 26, 28, 29, 43, 47, 79: n = A,T,C or G
gtagaaccgcgagggncagatgaaanannataaccgagcatantatntctaggactaacccctatacctgctgcataangaatgaactagaaatcactgt

SEQ ID NO: 24944 - DNA, 309 bp, Homo sapiens
  misc_feature 5, 21, 40, 41, 262: n = A,T,C or G
gcggnctgctgcaagagagantaggtaatctgcatcactnnagtggaagagatgcttcaaaaaatttctcctctacagaaatgtcaggaagaactgggatctttaaaagcagagctagaagagaaaaagagttctttaaagttgtatcaggatactcatcaggaatatgctcgtgtaaaggaagaatgcttgaagagtgatgctcagaagaagaaactagaagctaaggtgaagaagctgcaagaggctgctgtcaagcaanctcaggacttcaagcaactgagaaatgaaaagaaaatacttgaaaag

SEQ ID NO: 24945 - DNA, 138 bp, Homo sapiens
caggcggagcttgaggtttcccgcagataagtttttttctctttgaaaggattgagattaatacaactacttaaaaaatatagtcaataggttactaagatattgcttagcgttaagtttttaacgtaattttaatag

SEQ ID NO: 24946 - DNA, 413 bp, Homo sapiens
  misc_feature 22, 25, 29, 36, 64, 129, 251, 252, 373: n = A,T,C or G
tatcactgcggccttacggggntantttngcgtccngaagtatgagccactaacaaaagtccanaaactcccagttaatagtattgtgtctcttcaaaatatcggagaataatttctttctcgctgatngcctaacttctactgacgaagcttggaagttgcagaaggttggagtgcaatggcgcgatctcggctgactgcaacctccacctcctggattcaagctattctcctgcctcagcctgccggannagctgggattacaggcatgtgccaccgcacccagctaattttgtattttttagtagagatggggttctccatgttggcaggctggtcttgaactcctgacctcaggtgatccgcccacctnacctcccaaagtgctgggattacaggcgtgagccaccgcg

SEQ ID NO: 24947 - DNA, 228 bp, Homo sapiens
  misc_feature 41, 113: n = A,T,C or G
gagactggcctgagcaacatagcaaggccccatctctattnaaaggaaaaaaagaagaagaaggcatttttattataggagatgacagcttcatgagtgttatagcccttgangacctttcagtgggacaaaatatggaggtggaaaacagtgatattgatgatgctgaccctgtgtaggcctagactaatgtgtgtgtttgtgtcttcatttttaataaaaagattt

SEQ ID NO: 24948 - DNA, 366 bp, Homo sapiens
  misc_feature 1, 25, 30, 47, 279: n = A,T,C or G
naagaacccacacaaaggctgattnctaangtatactatgtatgcancgtgctttttcttgccagcttgggccattcttgcttagacagtcagcatttgtctcctcctttaactgagtcatcatcttagtccaactaatgcagtccgatacaatgcgtagatagaagaagccccacgggagccaggatgggactggtcgtgtttgtgcttttctccaagtcaagcacccaaaggtcaatgcacagagaccccgggtgggtgagcgctgcttctcaaacnggcgaagttgcctcttttaggaatctctttggaattgggagcacgatgactctgagtttgagctattaaagtacttcttacacattg

SEQ ID NO: 24949 - DNA, 427 bp, Homo sapiens
  misc_feature 275: n = A,T,C or G
atcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttacngaggactgtacaaacatgaaggtgtggtatcaaacttcaggttgaaactgtttgaagcattataaacattcatttcacaactagattgtataaggatattaagctgtgatgagactcactgcattatttttttttagtgaatttatgaaatc

SEQ ID NO: 24950 - DNA, 297 bp, Homo sapiens
  misc_feature 19, 47, 122: n = A,T,C or G
cacaggtgaacctatgggncgtggaacaaaagttatcctacacctgnttagaagaccaaactgagtacttggaggaaccgaagaataaaggagattgtgaagaaacattctcagtttattgnatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaacaaaagaaggatggtgac

SEQ ID NO: 24951 - DNA, 458 bp, Homo sapiens
  misc_feature 49, 123, 277: n = A,T,C or G
catgaaagggctcaagtgctgtggcttcaccaactatacggattttttngactcaccctacttcaaagagaacagtgcctttcccccattctgttgcaatgacaaccgtcaccaacacagccnatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtntctgtactgcaatctacaataagtccacttctgcctctgccactactgctgccacatgggaactgtgaagaggcaccctgcaagcagcagtgattgggggaggggacaggatctaacaatgtcacttggccagaatggacctgccctttctgctccagacttggggctagataggggacca

SEQ ID NO: 24952 - DNA, 386 bp, Homo sapiens
  misc_feature 46: n = A,T,C or G
ctgcatagcaatttgataacttcagtaattcctaggtaaggtgaanttttggttgtttcaaaaggaggggagagcaaagccagctgatagtcttatagatggccccacaaagctggtggcattagggttggctggaaatgacgagcaactgcctcaaaagtgaagatctgaggtggagcagggctcagcagagagtgagcaaccagaaagaaacatgggctgtgatctggaaatgttcactgggtcacagcccagacacttggagggaagcaggtagagacattcttgcctgtattaactctttttcattggaattgctgcaaatcaggtatgcttcattctatattattgactttttggagcttaaatacaatttggttgatctt

SEQ ID NO: 24953 - DNA, 455 bp, Homo sapiens
  misc_feature 45, 48: n = A,T,C or G
aaagaggtccttatacgtacagagttcgttttctagccaaggaanttntaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaacctattgatggattaaacccaaatgaagaagaacataggacatacttggatattgaacctataactggattcactttacaatttgcaaaacggctgcaggtcaacctattggcaagccatcagaaaaaattcaagtattaaagaatctgaagaggaactatattgtgcctattctttggcttaatgagactggg

SEQ ID NO: 24954 - DNA, 277 bp, Homo sapiens
agagcgagctgagtggttgtgtggtcgcgtctcggaaaccggtttcgcttgcagcatggcttgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggc

SEQ ID NO: 24955 - DNA, 454 bp, Homo sapiens
  misc_feature 24, 30, 45, 76, 118, 119: n = A,T,C or G
gaatggtgtaggaacacgatgaanctattntgaagcacttgaaantttttaaagtgaagttctcagatgctggccngcctatgagttttgtcttagaatttcactttgaacccaatgnntattttacaaatgaagtgctgacaaagacatacaggatgaggtcaagaaccagatgattctgatcccttttcttttgatggccagaaattatgggttgtacagggtgccagatagatcggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctgggatgatgatgctgaagctatccttgctgcagacttcgaaattgggtcactttttacgtgagcgg

SEQ ID NO: 24956 - DNA, 431 bp, Homo sapiens
  misc_feature 3, 5, 29, 41, 349, 389, 407: n = A,T,C or G
ganantttatggaagcttcatgatgtttncattctttcctncagtgtataggatgggatcctctctggggagggtcttaagacccacaattagaaaggcaagggaagattaagaagtcctgctttggggtaagatgaaaggaaaggagagagattctgtttcctgaggcttaatacacccaacattataacaaaggactgtagcaagggctatgggagttctgaagcagaaaccatgggctaaaaccaacatacatcttaataccagataccctaatcccagtcctaacttcatttaaccttggcacattgagtcattccaggatgaagtggctcaagtatttcctcanggaaaatacttctgtgccccctgatttgagggtaagaagnaagataatgaggccctgngggggtattttttcatgtctggac

SEQ ID NO: 24957 - DNA, 149 bp, Homo sapiens
ccacttgtatcaatattgtccctgttcatcgtcgccaggactgcatcttgcaccactgtgccgtcttctaggcacacacgacccgttatctcccttggaaaaattcctctcactggaaatgtacaattaaaggatgattgaaatgtttc

SEQ ID NO: 24958 - DNA, 468 bp, Homo sapiens
  misc_feature 57, 58, 285: n = A,T,C or G
aaaatgtcctttaaaatttgggagaattgtaaaacaccattatattttttcagattnnttttaaaatttattttgtacaaaatatttatagatatgaggcttcactttgttgaattcatcatacacacacacttctttttagcagaaattaatagaaagccaattctaaattaatgtaggtaatacataatctactcaactggatgaataccttggttgcaagtcttgtcctgagcgagctaagtgacaacactctcaatctactgagcttccagcatctaggcngagctcccaggacaagcagaagtcacagggaacaggaagcaggaaagagcaggaaaagattctttagttcccatgtgtaggaaacaaatgctcagctgcctctgtattgaaccatactgatgcctgccactatattgtcattgtagatagaaatcattataagttgcagtcgattagaaattg

SEQ ID NO: 24959 - DNA, 128 bp, Homo sapiens
tcgtccgacttatatgacattgaaaacttgtgtgtgcaacttttgggggacaggaatcacttaaaatcatatttatttggctttttatttaaaggattctgtcacaagtcttattgaaaagtagattg

SEQ ID NO: 24960 - DNA, 301 bp, Homo sapiens
  misc_feature 57: n = A,T,C or G
taaatttccaactgtcatggcactggtgagagtgtcttttaccatgctaatgtattngaaccttaaggatgaccagaggttgctttcgttgccatcttggtttttgtgcgttcttctggctgctttacgcatctcattttaccagtggggtctttgagatttgtaccttgtaaaaccagtcctgccaaactcctgtctcatcatgagagaatcaagttgagccaaggaggttgaggctgcagtgagctgtaatcatatcaccacactccagcctgggtgaccggagcaagaccctgtccca

SEQ ID NO: 24961 - DNA, 462 bp, Homo sapiens
  misc_feature 33, 57, 59: n = A,T,C or G
gaaattgcccgtaaacacaaaattatcagtgtnttagaaacatgagtccggactgtntnagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgcttaaacctcactgagagcgcaaaatgcagctttatactttttactttcaattgcctagcacaatagttgagtacatttggaattg

SEQ ID NO: 24962 - DNA, 451 bp, Homo sapiens
  misc_feature 24, 57, 362: n = A,T,C or G
gaaactgccaaatatgctttcagntcatacgaatccccatgactttcacatcttctntttagtctgttggtggatggaatatgaactctctggcctttctccatcattctggaagtgagaggagatgggacattataatgctcttcatcaaagcatggccctgtcagcatagctggtagtgtagctccatttaatgtggttactttaatctaggcattcacttataatgcccacttcatattatctgataaatacttggatagagatatgacacagaggttaagaactaagagttaacttttttttattaagtttcagagccctataagaataagcatcgcaaataaaaatgttggtagcgnccggaaatttgcaattgcattcttaacccttctccatccttgccaccaaccccaaagatctatgagattagtctatgagattcggcctt

SEQ ID NO: 24963 - DNA, 146 bp, Homo sapiens
  misc_feature 31, 74: n = A,T,C or G
catggtggcacatgcctgtaagtcccagccncttgggaggcttgaggtggggagggattgcttgagcccagggnggttgaggctgcagtgatccatgatgggtgtcactggcctccagcctggatgacaggaagtgagactttgtg

SEQ ID NO: 24964 - DNA, 286 bp, Homo sapiens
  misc_feature 9, 58, 276, 282: n = A,T,C or G
atttttccnaaaaaaaaagtcctcaaatcaggaagaaacatcaaagactatgtccttntggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgccaaanaaaaanaacg

SEQ ID NO: 24965 - DNA, 424 bp, Homo sapiens
  misc_feature 13, 16: n = A,T,C or G
gcggagcttgagnttnccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggttctaaaacatgacggaggttgagatgaagctcttcatggagtaaaaaatgtatttaaaagaaaattgagagaaaggactacaggccccgaattaataccaatagaagggcaatgcttttagattaaaatgaaggtgacttaaacagcttaaagtttagtttaaaagttgtagggtgattaaaataatttgaaggcgatcttttaaaaagagattaaaccgaaggt

SEQ ID NO: 24966 - DNA, 441 bp, Homo sapiens
  misc_feature 2, 15, 27, 38: n = A,T,C or G
gncgcttgcaatggntgcccgtggtgncatcgctcctnttggcgagagtttgcgctacgctgagtacttgcagccctcggcaaacggccagacgccgacgtcgaccagcagagactggtaagaagtttgatagctgtaggactgggtgttgcagctcttgcatttgcaggtcgctacgcatttcggatctggaaacctctagaacaagttatcacagaaactgcaaagaagatttcaactccttgttgtcagaaaatggtctgcagtggcttatacctagcttttcatcctactataaaggaggatttgaacagaaaatgagtaggcgagaagctggtcttattttaggtgtaagcccatctgctgcaaggctaagattagaacagctcataggagagcatgattttgaatcacccagataaaggtggatctccttacgta

SEQ ID NO: 24967 - DNA, 207 bp, Homo sapiens
  misc_feature 2, 22: n = A,T,C or G
tnactttgttgccctggctggntttgagctcctggcatcattcgtttcctccccactggcctcccaaagttctgggattacaggcatggccacagcaccaggcctcttttttattttccactttaccgttctattaaccagtcttttctttttatctgaaactaaacattaatgactaaacattattggataaaattatttgcagca

SEQ ID NO: 24968 - DNA, 447 bp, Homo sapiens
  misc_feature 45, 48: n = A,T,C or G
cgttgcgaaaagtaagagatgctttatatatttccttggtatatntantttttgttccttccttaaagtttatattttatatttacatctgtaggatatatttgcttctcaggagcttatattaatgtaaagctcatcattattttatccaaatttagataattttatattgaagcctttcttttgaacctgacttacacttttagcctcaggagtgtgagattaaactataggaggagaatcaaacttctgcttttgataagaactgttgaatatcaaaataactgttaattcagtataatttaaagaaatatctttaatagacaaaattgatgagcatcaaaaatagacatgataatatgtaaaggtaataacttttattatattaaagcaatgcaaacgaaaaacagaattgagcagtgcaaaatttaaagggactggtttggt

SEQ ID NO: 24969 - DNA, 454 bp, Homo sapiens
  misc_feature 56, 276, 418: n = A,T,C or G
aaataagccttgtaagatcccacccaacctttaataatacctttccctcgggggcnttgtaaggacttaaagatcctgtacatgaaaaaacattgtaaagtaccatgcaaatgctagttttttacatcgaattccatctattaataatcatctaaattcaagcattttctgttactagattattagctattaggtttattaatattttggtaatagatggtatgattatagtggaatttatttgtaacaggatttagcctatacttgttaatattntggttgcctaacctgggatttctcttagtgtcatagccccagtataataacgtcgataacaggcattcaagaaagatttattgtttaaagaaagttgtgtaaaccttctgcatagattaaattgaattgggttatttcttgnaatatttcaaaatatgttaagagatctggtataatt

SEQ ID NO: 24970 - DNA, 458 bp, Homo sapiens
  misc_feature 2, 57, 130, 282: n = A,T,C or G
anattcccccctctacaaccctctctcctcagcgcttcttctttcttggtttgatcntgactgctgtcatggcgtgccctctggagaaggccctggatgtgatggtgtccaccttccacaagtactcggncaaagagggtgacaagttcaagctcaacaagtcagagctaaaggagctgctgacccgggagctgcccagcttcttggggaaaaggacagatgaagctgctttccagaagctgatgagcaacttggacagcaacagggacaacgaggtggganttccaagagtactgtgtcttctgtcctgcatcgccatgatgtgtaacgaattctttgaaggcttcccagataagcagcccaggaagaaatgaaaactcctctgatgtggttggggggctgccagctggggccctcctgtcgcagtgggcactttttttttccaccctggctccttc

SEQ ID NO: 24971 - DNA, 412 bp, Homo sapiens
  misc_feature 7, 11, 54, 55: n = A,T,C or G
cagcccngccnacatggtgaaaccccgtctctgctaaaaatacaaaaattagcnnggtgtggtgacagcacatctgtagccagctacttgaatcgcttgaacctaggaggctgcagtgagccgagatcgcgccactgcacttcagcctgggtgacagagtgagactccgtctcccaacaacaacaacaacacccataaaaacccatcccaaatgttcagcatactacctaagagtattatgggtctgttttcgagaatgcaaaaataatggtcagtttatattattaaaatgtccgtaaaacctaggtattttgtgatattctttattaagtagcaagacatataacggaaagtaagttaagctatgatttaatttaaaagctattcagtatacttcaaatgacataaatcc

SEQ ID NO: 24972 - DNA, 390 bp, Homo sapiens
  misc_feature 1, 58, 289: n = A,T,C or G
naaaagctccccgtcatctagccctcttaacattgctctataggaatagggctcagantatccatgaagaaaagaaaaaaatgccgataccctggttactatcatttgtctctgactcaggagtctcatgtcttctaacagcatccatgaaactatagtgtggtaacttgttagctagtaagtagggtaaaatctcatacccttcacagttattgacacccattctttagcagataactgatatttcacaattatagacatctataggccaggcacggtggctcacgcntgtaatcccagcactttgggaggccaaggcgggcgaatcacgaggtcaggagatggagaccatcctagacaacatggtgaaaccccgtctctactaaaaat

SEQ ID NO: 24973 - DNA, 453 bp, Homo sapiens
  misc_feature 1, 56, 325, 359: n = A,T,C or G
naaatacccatagtaccgcaagggaaagatgaaaaattataaccaagcataatatntcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgccaagatagaatcttagttcaactttaaatttgcccacagaaccctctaaatccccttgtaaatttaactgntagtccaaagaggaacagctctttggacctaggnaaaaaccttgtagagagagtaaaaaatttaacacccatagtaggccttaaagcagcccccattaagaaagcgtcaagctcaacacccctacccc

SEQ ID NO: 24974 - DNA, 408 bp, Homo sapiens
  misc_feature 3, 39, 41, 260: n = A,T,C or G
cgnaggggcttctgctgagggggcaggcggagcttgagntnccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttctncatggagtaaaaaatgtatttaaaagaaaattgagagaaaggactacagagccccgaattaataccaatagaagggcaatgcttttaggattaaaatgaaggtgacttaaacagcttaaaggttaagtttaaaagttggtaggtgatt

SEQ ID NO: 24975 - DNA, 179 bp, Homo sapiens
  misc_feature 178: n = A,T,C or G
ccgaagaaaagaatagagaaggtagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatng

SEQ ID NO: 24976 - DNA, 152 bp, Homo sapiens
aaaagaatagacactaaaatcatgttgatctataattacacctatgggatcaataagcacgtcagactgattaatgtctactgtgaaaatttggtagtaaattttcatttgatattagatataaatatctgaatataaataattttaatata

SEQ ID NO: 24977 - DNA, 462 bp, Homo sapiens
  misc_feature 279, 420: n = A,T,C or G
aaagtggcccctgaagttggggcttctatctctgcctaagatcttttcccctgattttctcctgattttgaggattcatcatgttactttttttaaaatgtgatttcctgtcttatgtgcctgaaagtgtcatagcacacttgatgtcttctatttacaggccacttgacttcaaataatggagagaggaaaagagaatgaagcatctggtttatgaagaaatgcacatgaaatagtcaaacaagagaaatcttattggttgtcctttttaaaaaatgnccctttgcacaggagaatgctgtgggtcttcacgtggctctagaatagaatttactttatcctaaatgggacctgtgatgaatggtacagaaacagaagactagaaagctttcgcctatagaagactcaaggcagggtganggccgactgggtgtctgggagagaccttctactctgctatta

SEQ ID NO: 24978 - DNA, 180 bp, Homo sapiens
  misc_feature 17, 46, 117, 118: n = A,T,C or G
ctggtggtgcagaagtnagaaggtaaagcttgagaagatgaggttntttacgtagaccagaaccaatttagaagaatacttgaagctagaaggggaagttggttaaaaatcacgtcnntaaagctactaaaaggactggtgtaatttaaaaaaaactaaggcagaaggcttttggaagag

SEQ ID NO: 24979 - DNA, 245 bp, Homo sapiens
  misc_feature 2, 4, 58: n = A,T,C or G
ananggtcccctgaaggtgaattcaaggctgaaggaaatagcaaattcacctacacanttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatc

SEQ ID NO: 24980 - DNA, 469 bp, Homo sapiens
  misc_feature 1, 285, 465: n = A,T,C or G
naatacccccgaagatactggaaaagctcttgtttgtcaaggctaagttacatattgttgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccnttaatttctacaaaaatggaagattctggggtttatttatgtgaaggaattaaccaggctggaagaaagcagaaaggaagtggaattaattatccaaggtactccaaaagacataaaacttacagcttttccttctgagagggcaaagaaggagacctgcatcatctcttgacatgtggnaatg

SEQ ID NO: 24981 - DNA, 458 bp, Homo sapiens
  misc_feature 9, 16, 56, 278: n = A,T,C or G
aaaagaccncatgaanacagctggatgttcattgcagtctgaagccttgaccgttncagtctctactgaactcagcctaacacataagagtaaagaaactccaattgagtgttgtttgttgggagaaaaatggaatgaactaagataaagacagaccagtacactaaagcctaagcattccctcttcccccaacgttatgtttttttgaaattttgatggaaaaatatccagcatggtggagtggtgtttcgaagatgggtttgatcacacatacttngtcgtacgtatctacccaagctgtcactattcgctaaagtttaaaatgttcttttcctttctccaaagtaatctacattcttttcttccagccgaccccttggtgggaagtattgccactcagtatatgaccaacagagcagaacatgcagaatggccagacagtggaccaagagatcgc

SEQ ID NO: 24982 - DNA, 454 bp, Homo sapiens
  misc_feature 12, 20, 56, 278, 450: n = A,T,C or G
aacagtcccaangaggaatntggtataattatggtgggtgattattttttatactntatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactggtngggtttttgcacttcatctcttcactaatggagatagctttacactttctgctttaatagatttaagtggccccaatatttattaaaatgctagtttaccggtcagaagtataatagaaataatcttagttgctcttttctaaccattgtaattcttcccttcttccctcancttt

SEQ ID NO: 24983 - DNA, 422 bp, Homo sapiens
  misc_feature 9, 10, 360: n = A,T,C or G
aagaatggnnctttatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcagggatgagattcagaatatgaaggaggaaatggctcgtcaccttcgtgaataccaagacctgctcaatgttaagatggccttgacattgagattgccacctacaggaagctgctggaaggcgangagagcaggatttctctgcctcttccaaacttttcctcctgaacctgagggaaactaatctg

SEQ ID NO: 24984 - DNA, 300 bp, Homo sapiens
  misc_feature 3, 285: n = A,T,C or G
aanaagtcccggagaaatatagaagatagaaaaatataaagccaaaaattggataatttagcactgaaaaaaatgaggaaattattggtaaccaatttattttaaaagcccatcaatttaaattctggtggtgcagaagttagaaggtaaagcttgagaggatgagggtgtttaccgtagaccagaaccaatttagaagaatacttgaagctagaaggggaagttggttaaaaatcacatcaaaaagctactaaaaggactggtgtaatttaaaaaaaactaagngcaggaggcttttgg

SEQ ID NO: 24985 - DNA, 461 bp, Homo sapiens
  misc_feature 3, 8, 46: n = A,T,C or G
cancgagngcaggggcttctgctgagggggcaggcggagcttgagntttccgcagataagtttttttctctttgaaagatagagattaatacaactacttaaaaaatatggtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatgcagtgaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaacccgaaggggt

SEQ ID NO: 24986 - DNA, 463 bp, Homo sapiens
  misc_feature 10, 22, 57, 284, 285: n = A,T,C or G
aaacaaaccnctattgtagcanaactgcattgttggcagcaaaatgactggctggtntctttcttagtacaaatcatacctcccaaggtattgctccattgtgtttttgtgcatttggtttggatttttatggggaattgaagacaagtggatcataaagtgcaaaataaaatgctctagaaatgacagatggggcacaatttccaagaaaattcatctagacagtggcaacactgagaaaaaaaagaaacattcaagaagggagttacagtttcagacatccnnagttttggttaaaaaggtcccttttgatgagtgtgcagtcactaccagctagaacaagggccctaaagtgagggccaaccgtatataatcagagagcctgacgtcaggttgatctgaaaatatgagaactaaatggcattctaccagctttagtttagaagatatagcatgtttgatg

SEQ ID NO: 24987 - DNA, 407 bp, Homo sapiens
  misc_feature 71, 222: n = A,T,C or G
ccttggcccagatagagaactcagctgcagtgcaaaaggctattgcccactatgaacagcagatgggccanaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagngggatgacttttgtaaacagaatcaggaagcatcatcagatcgttgctcaggtttacttcaggtcattttcagtcctctagaagaagaagtgaaggcgggaatttattcgaaaccagggggctatcgctctttgtcagaagctacaagacctgaagaaaaaagtctatgaggacccgaggaaggg

SEQ ID NO: 24988 - DNA, 424 bp, Homo sapiens
  misc_feature 6, 18, 89, 90, 373: n = A,T,C or G
actcangcataatatttntaggactaacccctataccttctgcataatgaattaactagaaataactttgcaaggagagccaaagctannacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaangcagccaccaattaagaaagcgtcaagctcaacacccactacctaaaaaat

SEQ ID NO: 24989 - DNA, 453 bp, Homo sapiens
  misc_feature 6, 24, 38, 45: n = A,T,C or G
taatcncagaagatctttgtgggnacaaaaggaatccntcatttngtgactcatgatgcccgcaccatccgctaccccgatcccctcatcaaggtgaatgataccattcagattgatttagagactggcaagattactgatttcatcaagttcgacactggtaacctgtgtatggtgactggaggtgttaacctaggaagaattggtgtgatcaccaacagagagaggcaccctggatcttttgacgtggttcacgtgaaagatgccaatggcaacagctttgcactcgactttccaacatttttgttattggcaagggcaacaaaccatggatttctcttccccgaggaaagggtatccgcctcaccattgctgaagagagagacaaaagactgcgggccaaacagagcaagtgggtgaaatggggtccctgggtgacattgtcagaatctt

SEQ ID NO: 24990 - DNA, 319 bp, Homo sapiens
  misc_feature 45, 70, 78: n = A,T,C or G
gatgtcaatgtccaggacatttctgggatgggaaagggatgtganatgatctgatactgcaacttcagcnaattgctntgctgcccaaaagacgttttctttggaccaaagatctctttcgtgattccttgcaacaatcaatgagaatcttcatgtattctggagaacgccattcctgatttcccacaaactgcactacatcagtataactgcatttctagtttctatatagtgcaatagagcatagattctataaattcttacttgtctaagacaagtaaatctgtgttaaacaagtagtaataaaagttaattcaat

SEQ ID NO: 24991 - DNA, 400 bp, Homo sapiens
ccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgcaattatatattcctactcggcatactggactggcttcgttctcttaatatactcagtaatgactcaagcctctggctattaacataccctagttgccggtttttaattgccatgagccaaatacttc

SEQ ID NO: 24992 - DNA, 110 bp, Homo sapiens
  misc_feature 14, 18, 27, 31, 50, 81: n = A,T,C or G
gaaataccttgaanttcnagacttgtnaganctacaagcggttgtgctancttaattctgtgttcccagaaataaaaattncccttagttatgctgtcatttttaactaa

SEQ ID NO: 24993 - DNA, 253 bp, Homo sapiens
  misc_feature 15, 20, 27, 35, 43, 66, 97, 182, 195, 218, 236, 246: n = A,T,C or G
aatgatcccggcaanagagnagcaganaaattacncacacatntgtgcttggagctttttgccttnggaaagaaccttttgcccagagtagcagccnaacttgaggttgccccgatttctgacatcattgcaatcaagtcacctgacacatttgtgagaactatttatgccggaaatgctcnatgtacagtgaantgtgatgagaaagtgaaagtgtnttctgtccgtggaacatnctttgatgcngctcaac

SEQ ID NO: 24994 - DNA, 302 bp, Homo sapiens
  misc_feature 3, 10: n = A,T,C or G
ccnatagtgntagtgaaagttacaattacttcctttatggagtgaagcttaactatagaaaacattgtcctttcatctgtaacagttgcttaaggtaacagagacaattccatccgaaatttcactatactgtagcatatgactcctactattttaaatatgtgctccaagtatttttcatatggctagttccccacccccacacctggttttcattctttggtttaaaagaaattttaaattattaggaatagtataactaaaatatttgattaacagaaaggagataagcaaagacactt

SEQ ID NO: 24995 - DNA, 306 bp, Homo sapiens
  misc_feature 10, 11, 261: n = A,T,C or G
gtttgataannattcgacatccctttgtgacaaaagctttcaaaaactgggtataaaagagacatacctcaacaccataaaagccatatatgacaggtccacatgaaatcctttcctctaagatctgaaacacaacaaggacacccacttcataactgttactcaacatagtactggacatcccagctagagcaatcagacaagagaaagaaataaaaggcacctaaactggaaaggaagacatcaaattattcttgtttnggagatgacatgatcttatctttagaaaaatatgaagactctacc

SEQ ID NO: 24996 - DNA, 462 bp, Homo sapiens
  misc_feature 10, 14, 53, 55, 281, 412: n = A,T,C or G
aaattccatntacnaactctgctaattataccctctgagtctgtatttccagntntttattagaacacaacattacctacaggagagttgatttctaaatcagattgagtttccccacacacctctttcctctcccgggagactcaattgggtatctacatgtggcagcaaaaccagaccaaccaaattattctacagttctgatgcatcatggcaggttaagacagtagcctagccagtggggaaagatgtttacaagggcccactgattataccacctnggagatcccagagaatgattcagacctgccaaagttttttcttcaaccgatgctgcctccgcatgtttgtgtcatctgatgggcagtcttaccataactcatgtagggcatatattatcatttgtggctgnctctttctgaatcagcatttaccttgtagtaagactggtttgccacacac

SEQ ID NO: 24997 - DNA, 403 bp, Homo sapiens
  misc_feature 29: n = A,T,C or G
catcatatagacaaaacagccctgctgcntaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctgccattaagagatgcaagcattttgaactgggaggagataagaagagaaagggccaagtgatccagttctaaactttgggatatttttcttcaattttgaagagaaaatggtgaagccatag

SEQ ID NO: 24998 - DNA, 236 bp, Homo sapiens
  misc_feature 5, 18, 33, 35, 36, 44, 45, 48, 53, 54, 55, 77: n = A,T,C or G
aaagncgactgcataagntttctacatcatttntnnatgtattnnttntatannncatgaagtgtatatataatggngtgaaaaattcctttggaaaaatttatgttcctttcatttttaccaaattgcaaattttcagcatggatgagaaaagcattaaaattataactttgtgtacaagatgaaaataattcactaaatttgcccttttttacacaaaataaaatgttaaagtt

SEQ ID NO: 24999 - DNA, 205 bp, Homo sapiens
  misc_feature 28, 30: n = A,T,C or G
caagaccagcctggccaacatggtgaancnccatctctactaaagatacaaaaaaattagccgggcatgttagcatgcacctgtaatcccagctacttaggaggctgaggcaggagaattgtttgagcctgggaagcagaggttgcagagagccaagattgcaccactaccctccagcctgggcaacagagtgggactctgtctc

SEQ ID NO: 25000 - DNA, 108 bp, Homo sapiens
  misc_feature 3, 13, 23, 41, 47, 53, 59, 61, 75, 78: n = A,T,C or G
gangactatcctnagcaattttnactgccgacattccaaanaacgtngacctnactctnangggacgcacagtgnatnagtgaaggccccagattttccctgcggagg

SEQ ID NO: 25001 - DNA, 238 bp, Homo sapiens
  misc_feature 14, 24, 33, 35, 37, 40, 42, 43, 45, 52, 59, 64, 66, 75, 83,116, 124, 125, 203: n = A,T,C or G
tgaaagcgcttgcngcatggatgnccaactgantnangancnnanggcaganttcaaanaactntntcactattngacaaagntggcgatggaactataacaaccaaaggaattgngaactgtnntgagatctcttgggcagaatcccacagaagcagagttacaggacatgattaatgaagtagatgctgatggtaatggcncaattgacttccctgaatttctgacaatgatggcg

SEQ ID NO: 25002 - DNA, 500 bp, Homo sapiens
  misc_feature 10, 11, 48, 49, 51, 62, 76, 359, 420, 484: n = A,T,C or G
ccaatggatnnttaattcattatggcaataggtacattccaaagggtnncnttttttaaaangagatttttctttngggcctaagattacagtcacatggttccaaattcagagggttcaaaaggacacagaaaagcctgcctcccacttgtgcccactggcctccccttttttcgcataaatggcagtttatagctttgtctgttccttgttttttgagcttaataccttagagacagatttttgtatatctgtacctgcagaactttgtttttcttttttatggcttctgagaatttggttatatgaatgtaccagaatttattagcaactttccctattgatggctcaattaatanggttggttctaagactttgctgtggcaacctgccctccaggtgaattattatatgcattgncatttcatgcatgtccgcgtgtatctgtaggacagatcctaaacgtgagatgctacatcagcanggtatgtgcatttgta

SEQ ID NO: 25003 - DNA, 500 bp, Homo sapiens
  misc_feature 9, 12, 32, 51, 82, 125, 262, 371, 449: n = A,T,C or G
tgtgtgatnctntgttgtatttcctcagggantccaaggaggagagtcagnggaagctacatgttagctgagcatgagaaanaattttctgctagagtaagctgatgatggcagttgtgcctcanacttaacccatcagtggagtttctagcataggccagaaaaacacttggtgggaattttgggaaggaaatttaaatatagaatgattgattaaactaggatgcctttcccggacctgagagccgtaaactgacaagtnaatgctccatgatgacaaaccccaagactatctgctgaagttcctcagaacctgagatttatgtttcttttgctctccagagaagcctctcattgaaagggaagattangagaaaagaacttacaatgacagtaggtgcaagctctcagatcttacacttgagttctaaaatgacagacaaggttgnaagaaaaatccatgcaagaactgatgaagataactcctaagaaaatgtttc

SEQ ID NO: 25004 - DNA, 100 bp, Homo sapiens
  misc_feature 5, 10, 27, 49: n = A,T,C or G
caagnaccgnctgaggaatctgcaggnttcatctgaaggcaccgtatcnctcgtggccataaagggcaaccaagagagccccaaagccactggagacttt

SEQ ID NO: 25005 - DNA, 100 bp, Homo sapiens
  misc_feature 2, 3, 10, 30, 35, 45, 79, 99: n = A,T,C or G
gnntctatanaagaattattcatagatcanacatnaagagccatntgcccaacacagataacagcacaaaaaaagaaangctcagttaatgagtctgana

SEQ ID NO: 25006 - DNA, 500 bp, Homo sapiens
  misc_feature 13, 15, 28, 43, 79: n = A,T,C or G
gtgttataaggananctaacaaacaganaggacatccactttnaaaacccatctgcacatcaccatcatcaaagaccanaagtagataaaaccacaaagatggggaaaaacagagcagaaaaactggaaactctaaaaagcagaacgcctctcctcctccaaaggaactcagctcctcaccagcaatggaacaaagctggacggagaatgactttgacgagttgagagaagaaggcttcagacgatcaaattactctgagctacaggaggaaattcaaaccaaaggcaaagaagttgaaaactttgaaaaaaatttagaagaatgtataactagaataaccaatacagagaagtgcttaaaggagctgatggagctgaaagccaaggctcgaaaactacgtgaagaatgcagaagcctcaggagccgatgtgatcaaccggaagaaagggtttcggtgatggaagatgaaacgaatgaaatgaagcaagaagggaagttt

SEQ ID NO: 25007 - DNA, 500 bp, Homo sapiens
  misc_feature 29, 31, 360, 467: n = A,T,C or G
taaaaaatatagtcaataggttactaagntnttgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggngattaaaagaccttgaaatccatgacgcagggagaattgcgcatttaaagcctagttaacgcatttactaaacgcagacgaaaatggaaagattaattgggagtggnaggatgaaacaatttgggagaagatagaagttt

SEQ ID NO: 25008 - DNA, 498 bp, Homo sapiens
  misc_feature 18, 33, 51: n = A,T,C or G
gcaatccgggccacaagncacttgtatgacttnaactccacatagcgggantagtactgtattacagaacatttgaaaggtcctggagcagctatgggccagaataccaaccctcatacaagcactgtgggtttggtgcattccttagattgaagacagtttttcattgagagtttttaccttcatttaataaatccctttcgtcagtgccgtgcaggagaacttaggactttgcagcattccattcaggaactgggccaggtgacaagcagtaggtgactcatcttcacatgctctaggcaagagtccctgcccagtttccaggccattgcaaggctggagagatgaggctctgggagaggcttgtggctcctgggtgacagaactgaatggcctcctgggagtgggggcttacgcctctaatcccaacactttgggaggctgaggtgggcaagatcacaaggcaggagatcaaagaccatcctggccaacatgggg

SEQ ID NO: 25009 - DNA, 262 bp, Homo sapiens
  misc_feature 18, 26, 28, 30, 38, 47, 50, 260: n = A,T,C or G
gattggcaggatcctggnatccgctngnangtcaaaangcagatctncgngaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgctgagaggngg

SEQ ID NO: 25010 - DNA, 124 bp, Homo sapiens
  misc_feature 9, 29, 38, 70, 100: n = A,T,C or G
atctgagcngaggaacaaagctaaaggcngtaccttanatagcagggaaaactgtatttaacatatcctncagtgagctcatctcacactgtagcctctnccttaaaatttgcggagctcctgt

SEQ ID NO: 25011 - DNA, 456 bp, Homo sapiens
  misc_feature 31, 33, 52, 87: n = A,T,C or G
gcaatccgtttttacagatgttaaaagaccngnctatcgagttaaggagatnggcagcaccatgtctggcagaaaggggactgatgnttccatgaccctgcagtcgcagaagttccagataggagattacttggacatagcaattacccctccaaatcgggcaccacctccttcagggcgcatgagaccatattaaattctatttactatttgttgaatttatttttccgtcagctatgtaaaataaacatactcttcttcctcccctgattattgccattaagcctttaaattctaaacaaattataatgcatcatctatttaggagttagatttggatgtgctattgtatgattaccgaatagtctgtatgtttcaagcccttctgtaaaatatgaagaaaagtgctcttagcattctgtgtaaaactgtactgttaaatatatgtgtgtaatc

SEQ ID NO: 25012 - DNA, 310 bp, Homo sapiens
  misc_feature 30, 35, 36, 292: n = A,T,C or G
aattgacctgcaaagttaaaaaaaaattantgttnntaacaggtataagtgcacactgaatagtctaatctacatgtaacacatattttagtgtgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtnttaaagctccttagccag

SEQ ID NO: 25013 - DNA, 500 bp, Homo sapiens
  misc_feature 4, 29, 30, 43, 52, 395: n = A,T,C or G
tatntcagtatctgctacggtaacttcanntttctttcaaganggcgatgcnagcggccaagagggccgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgactataatgccaacagggcatttcagaagatggacacaaagaagaaggaggaacagttgaagcttctcaaggagaaatatggntcaacacagatccaccaaaataaatgttttctacattttcatttggactaaatcccacgaatgaaaaataccaactttttttcctttttaattaatactaaatat

SEQ ID NO: 25014 - DNA, 269 bp, Homo sapiens
  misc_feature 5, 14, 42, 77, 79, 81, 82, 92, 93, 106, 110, 111, 172, 180,204, 220, 259: n = A,T,C or G
actangaaccaaantacccctgcttgccccaaaacctatggntacagaaaattgagaagatgatatgaaagggggtntntnngaggggggcnnaggacatgagaanacanncctcaaaagaagaccaacaaatggccaacagggatatgaaaaagagctcagcaccactaancatcaganaaatgcaaatcaaaaccagagtgncataccatcttacctnaggcagaatagctattatttaaaaaaaaaacaacaagtngcagatattg

SEQ ID NO: 25015 - DNA, 489 bp, Homo sapiens
  misc_feature 33, 39, 41, 43, 46, 49, 52, 56, 72, 73, 76, 84, 93, 96, 142,155, 441: n = A,T,C or G
atgatacaaaagtgaaacgaatactgaggagcnaatatngntntcnganatncganagagagatattggaannggntgtttttnggcttggcnccntttatatgtaattgctgcttcattaggacttggaagagtttcctgnggttaaatttaancaaatagctcagaataacaaacttgtacactcaaaattccaggacagttctctataagaagcatggttttcctaagtttaaaacaaacacatatacacacatgcacacacgtaaacacacacacatcactaccaccaccaacaactagtttgtaaaatgctgtgagtgccatctcaaacctaactccctattggtagtgatttaataaatgatcatgtatagaagtataaggcataagagcgaaaccccatctctactaaaaatacaaaaattagccagatgtggngcatgtgtaatcctagctctctggaggctgaggcaggagaattgcttg

SEQ ID NO: 25016 - DNA, 261 bp, Homo sapiens
  misc_feature 4, 29, 30, 36, 37: n = A,T,C or G
tcantcaaaactgctcaactacatggaanntgaacnncctgctcctgaataactactgggtacatgacgaaatgaaggcagaaataaagatgttctttgaaaccaacgagaacaaagacacaacgtaccagaatctctgggacacattcaaagcagggtgtagagggaaatttatagcactaaatgcccacaagagaaagcaggaaagatccaaaattgacaccctaacatcacaattaaaagaactagaaaagcaagagc

SEQ ID NO: 25017 - DNA, 122 bp, Homo sapiens
  misc_feature 13, 99: n = A,T,C or G
aatcattggagcnaatatgtaacatactgtaaaagtccaaggagcaaaatttgcctgtccagctccctctccccaagaaacaacatgaatgagcaactncagagtgtcaaacaactgccatt

SEQ ID NO: 25018 - DNA, 351 bp, Homo sapiens
ctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgctcctgaactatgacacatgaatatgtgggctaagaaatagttcctcttgataaataaacaattaac

SEQ ID NO: 25019 - DNA, 461 bp, Homo sapiens
  misc_feature 3, 14, 35, 49, 51, 127: n = A,T,C or G
gcngaaagaagagngaatgcataagtgttacaacnggaacacccctggngngttcaagtaccattacaggacagccccactaagctagttcagagacaggccaggagagattaagaggaaatggggncaaagcagttaaagaagccagatcctgtagtgtaatgtaggcacaggcaggggcactgactttcactcgactaaaatgggatccactgggaagcttggagcagaaggggaacctgatctaacttcatttttaacagaactgctttagtgggctgtgttgaggatagatcatgcaggtccggatggagagcaggtggatctgttaaagagaccatagcattaacctgtgtgagagatcatgggacagagggaggggtgatggaaagtgatggatctgagtatattctgcagataggagcagacaagattttttgatgaactacaaatgccacagg

SEQ ID NO: 25020 - DNA, 300 bp, Homo sapiens
  misc_feature 14, 49: n = A,T,C or G
cgcgaacagatatntaaaacgattcgaaaagaagtgggaagatttgttnaagaacgagtgaaggattttaaaaccgttatcatcaagtacttagaatcactagttcaaacacaacaacagctgataaaatactgggaagcattcctacctgaagccaaagccattgcctagcaataagattgttgccgttaagaagaccttggatgttgctccagttatgctggattccacagtgaaatcatttaaaaccatctaaataaaccactatatattttatgaattacatgtggttttatatac

SEQ ID NO: 25021 - DNA, 195 bp, Homo sapiens
tcttatttctagttaaggattgtataagggcaaccttataatcatggagacaattcttttctcaagctaggaattgtcacttttatcaggcagagaggacaggaatgtgaaacatcctcatcatagatggctgacacctcattacagctgaggttaccaagcagcgagacaataaccctccatccatacccaatt

SEQ ID NO: 25022 - DNA, 188 bp, Homo sapiens
  misc_feature 3, 4, 30, 33, 37, 39, 41, 44, 46, 50, 180, 188: n = A,T,C or G
tanngagaaagggaacgagagcgggaaagnganaganananaangngagngagaacgagaacgggagcgagagagagagcgagagagggaactgggagcgagaaagagaaaaagacaaaaaacgggaccgagaagaagatgaagaagatgcatacggaacgaagaaaacttgaaagaaanctccaatn

SEQ ID NO: 25023 - DNA, 500 bp, Homo sapiens
  misc_feature 3, 4, 45: n = A,T,C or G
ganncatcttgcaatccactattatcagaaggccctggagctccnttcacttgtggtagagggtatagaacttgaccagttagacttacgaagagatattgcctacaacttgtctctcatctatcagagcagtgggaataccggaatggctcaaacgcttttgtatacctattgttctatataaagcaccgcaactgagaacagagcaatggcagctgctgtgtgaggaccagtgtcttctgtctcagggcttattatttgtaactccaaaatagaaatgacaatttcagaattacctaacaaacagtgtatttatttttaatatgtgataatgatcttgtggtatatatgcaaaattattcctacaaaaatttgtatattggtctgcattttcctttcacattctatagtgaattgttcccaatgttgaaatggcgtgtaagcctttgagctagcttgggagtcgaatcactattttcactcacaccatttatcatctt

SEQ ID NO: 25024 - DNA, 497 bp, Homo sapiens
  misc_feature 129, 165, 254, 395, 420, 438, 441: n = A,T,C or G
caccaggactgtgttgaagggcgtagggtttcttttaaatgtaatacctgctcatcttttcttcttgcacagtgtctgagaacatttacattatagataagtagtacatggtggataacttctactttnaggaggactactctcttctgacagtcctagactggncttctacactaagacaccatgaaggagtatgtgctcctattattcctggctttgtgctctgcaaacccttctttagcccttcacacatngcactgaagaatatgatgctgaaggatatggaagacacagatgatgatgatgatgatgatgatgatgatgatgatgatgatgatgaggacaactctctttttccaacaagagagccaagaagccatttttttccatttganctgttccaatgggccatttggatgncaggtgctattcacgagntgnacattggctcaagattaaggtttggacctcagtcccaaccaacattccatttgata

SEQ ID NO: 25025 - DNA, 498 bp, Homo sapiens
  misc_feature 26, 50: n = A,T,C or G
accaaaggaaagctattttgcgaacngtcttctccagcggagatggccantgtgctttgtaacagagccagactggtttcctatctcccaggattttgctctttagttaaaagggttgcaatcccaaagccttttcgactgcaggatcatcgggttcggatgagtctcatgtggctgctgcacctccagatatatgctctcgaacagtgtggcctgatgaaactatgggaccctttggacctcaagatcagaggttccagcttcctgggaacataggttttgattgcacctcaatgggactgcttcacagaagaaaagcctggtcataaaactttgcctgatgttctagcagaacctttatcaagtgaaagacatgagtttgtgatggcacaatatgtgaatgaattcaggggaatgatgccctgttgaacaagaaattaacagtgcagaaacttttgaaagtgccagagtagagtgtgcaaatacaaacatgtccag

SEQ ID NO: 25026 - DNA, 431 bp, Homo sapiens
tgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaacta

SEQ ID NO: 25027 - DNA, 497 bp, Homo sapiens
  misc_feature 77: n = A,T,C or G
caaaatcttgttaatgtcattgctaaaaaataaataaaagctatttactggaaacctaactgcaatgtggatgttgntacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagcttctgtaattcattgagcagttagctcatttgagataaagcaaatgccaaacactagctctgtattaatccccatcattactggtaaagcctcatttgaatgtgtgaattcaatacaggctatgtaaaatttttactaatgtcattatttggaaaaaataaatttaaaaatccattcaaaat

SEQ ID NO: 25028 - DNA, 500 bp, Homo sapiens
cagagcttcaacatgcatgaagcaaatagctgacaaaattgaaatgagaagtggacaaatccataattatagttggagatatcaccactcttggtaattgatagatcaaatagaaagaatgtcagtgaagatatagaagactttgacactcacaaccaatttgatctagttcacatttctagattgcttaacaacaacaaatatacacattattttcaaatacacattgaacatttggtaagatagaccatatttggggtgataaatcaagtctcaataaattttaaaatatttaaatcacatacagagtatactatgtgccacaacagaattaaattaaaactcagtaacattaagatcattggtaagccccaaatatttgaaaattaagcaacacatttctaaatacccgtgggctccaaagaagaaatcacagggtaatttgaaaacattgtgaattggctaaaaataaaaacacggcatttcataatttctggatg

SEQ ID NO: 25029 - DNA, 500 bp, Homo sapiens
  misc_feature 28, 29, 452, 465, 469: n = A,T,C or G
aaattatacttgtgtttaattttcagtnncacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcaggtatgacttcaggagaaatggtgtatttttacatattattgttagcctggtaaaagatgaaactaattgggaagttcattctaatcctgtcagggatgatttctttattatattcagttggaaaaatattagaaatactttgattaccaaagtaatcacagtttctcaatgatggccattgataattttaatgattttaagcttcagtactttaattcctactacacatacacacagctgtgatttagagacttgaatcacaggcatgggnggcttgagtttgnagtnctagctactcagggaggctgaggcaggagga

SEQ ID NO: 25030 - DNA, 356 bp, Homo sapiens
  misc_feature 9, 33, 35, 36, 37: n = A,T,C or G
ccttgcatnctgcccattattgaaaatgggatnannnttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgc

SEQ ID NO: 25031 - DNA, 456 bp, Homo sapiens
  misc_feature 29, 64, 65, 355, 371, 412: n = A,T,C or G
aacttcccgtgcttactgcaaacctggtnttgttgaaatgtttagaaaggctgaatttctgttnnactttgctcttctaactccagattaacatttccctctaacagaaatgctgtatcacaactaggacaggacaggacaggatctgttcctcctgtgtctaaccacactgctctgaccctgcctgcttctcctccttaagtgaagatcactgactgaaaaaaaacaggttgtagaaaagcatgtataatatgacctcattttactaaaaatacatatgcaggctcgtgcatggagagagatcaggattggtgagcaaagtggtgatctctgagtgcgggcatgcatagttggncattttcagtttttgnttatctgcattttcttcttctaacatgtgcataggttctgntataagttatttctctttaaggggagaggtgagatcaaaaaatc

SEQ ID NO: 25032 - DNA, 319 bp, Homo sapiens
  misc_feature 27, 28: n = A,T,C or G
tgagggaaattgacatcacgtcttaanngttttttatggggttgggccggatggctcacacctataattccagcactttcagaggccggggccgggtagatcatttgaggccaggagttcgagaccagcctggccatggtgaaaccccatctccactaaacatacaaaaattagccaggcatggcagcacatgcctgtaatcccagctactctggaggctgtaacacaagagtcacttaaacctgggaagtggagtttgcaatgagccaagatcacgtcacttcactccagcctgggcaacagagcgagactccatccc

SEQ ID NO: 25033 - DNA, 498 bp, Homo sapiens
  misc_feature 27, 28, 30, 35: n = A,T,C or G
ccagcacctcctctcttctccttttgnncnttctnacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgtttctttggaccaaagatctctttcgtgattccttgcaacaatcaatgagaatcttcatgtattctggagaacaccattcctgatttcccacaaactgcactacatcagtataaccgcatttctagtttctatataggc

SEQ ID NO: 25034 - DNA, 282 bp, Homo sapiens
  misc_feature 15, 19, 28, 30, 33, 35, 40, 41, 62, 80, 163, 170, 207, 212,237: n = A,T,C or G
tgctagcgtgaggantacnctggatgtnanttnanaggcnnagaagcgataatgggttcaanacaaagtgagatgtatgnattttacactcaagtgcacgcatagacaataacttatatagattaatatgtgtatttcaagcaaaggcagagaaatactaagnatttgtnatcttggtgtaatttaccctttcacacattttgcatngtctntaaataacaaaactaagcattaggnagacattgagtcaaagaaatttgaaccatacagagagtgaatttg

SEQ ID NO: 25035 - DNA, 259 bp, Homo sapiens
  misc_feature 30, 170, 174, 211, 227, 250: n = A,T,C or G
tcaagctaattttctttttctgaagcctgnaacaaatgatctagttcagaaggaagcaaaatcccttaatctatgtgcaccgttgggaccaatgccttaattaaagaatttaaaaaagttgtaatagagaatatttttggcattcctctaatgttgtgtgtttttttttngtgngtgctggagggaggggatttaattttaattttaaaangtttaggaaatttatncaaagaaactttttaataaagtntattgaagg

SEQ ID NO: 25036 - DNA, 209 bp, Homo sapiens
  misc_feature 2, 11: n = A,T,C or G
cngacgctacncggactaccccgatgcatacaccacatgaaatatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaag

SEQ ID NO: 25037 - DNA, 103 bp, Homo sapiens
  misc_feature 1, 82, 98: n = A,T,C or G
nctcagagtagtgccttgcacctagagtgcgtgcataatccatacaaggacggatgtaatgtatgtattatgaaaagtagcncacatgggcaccaggnggcta

SEQ ID NO: 25038 - DNA, 323 bp, Homo sapiens
  misc_feature 8, 246: n = A,T,C or G
gctatagnccaaaggcatttctgcttagaaatgtttgtaaggttgtttctttccccagtaactggattctaatgaggatagcaggtattagtgtctgctgaactgatggttgctcccggagatgtgttggtattccctatgtgttaccatgtgtgttttttaatcctttttttaactacttttgataaagaaataaggaaaagaatattttttttcactatttctattgttgatatttcaagaatngtgatattcttggagtttttcgtatggtaccttttctatattgttccaaatcagtggcattttcaggtatgttgagg

SEQ ID NO: 25039 - DNA, 500 bp, Homo sapiens
  misc_feature 19, 24, 37, 498: n = A,T,C or G
atgtacaatttacagaatnactancaaaaccaatcantttgacaccgaaaatacaaaaatttgattgacttcaaactgaactggaaacccattggagtagatatttagcctttttgtgtggcatggtagtctacaattctgtcagcatctgttttccatacaagactgtcacgcaaaggatcaatttgtgcatgtgccagggcacctcatggcttgctccctggccaaaaccacaggcaggcagggctggggtggacagtccagtcattcctgcaccttcacttccagtgaagcccacaattctgggagaaagtgaggccccagctcccctaactggagcccaagaattgctgaattagcagagaagatatttttggtgaccaggtttttttcagaactgtacaaatgttgagaaaaatgttttgtgtctttactaaaaggatgaataaaatcatccatcatcatcttgctttcccgcacaaaagatgatcactgggngg

SEQ ID NO: 25040 - DNA, 189 bp, Homo sapiens
  misc_feature 29: n = A,T,C or G
acactgaagctggagctgttaaatttatnttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatgt

SEQ ID NO: 25041 - DNA, 493 bp, Homo sapiens
  misc_feature 381, 447, 466, 467: n = A,T,C or G
gcattttgaaactctgcattcatggtgctttgttaggattccctctgcaatataggatcacagtacatgattactatggttattttcaaaaagtcaacagttccttcagattgcttggaagcagttgtgaacaattaagagaagtggatatgaccctgtaatgtatttcccgtatagaaagaagcagagggtatctgtagttcaagtgtgtttccaccaattaaactgtaattgtactctttccttacatgtttaatcttagggactaatatgcaaacaacaatgttctcacacaaaacaaattaaactcaacttactttcaatacaattaaccaataacaatttttttcataaatacatgggatttcaactttatattgnaagtcattctgaatagaagtccatgtcaggaaattagtatgttaattatcaacttagaaactctgngctggaatgatccctgggnngaatgatggttacacaccctattatt

SEQ ID NO: 25042 - DNA, 466 bp, Homo sapiens
  misc_feature 27, 122, 190, 214, 238: n = A,T,C or G
tacatcccatatgcaagggatgcagtnattaaatgctgttcttctctcctaagttgaaaatcagaaacttgtggaaaagagcacttgaatgttggtactctatgtttggtgaagattgcttntccccataaaacactccaggaacaactgacgtgacagttgaagaccgttttgtactaagtctcatttngtatactggtaaaaactacatgcntgattaaaccattaaatgcttgtnactttaaattcattatgtgtcattaatatacttttccaaagataagatttttaatcactgccagttgtaaattatttttagccaatttttaaatcttttcaaagcagctttgaaatgtgaatatttaaaggtagacctgtgccgcaagataattaaacttttttgcttttaaaaaatgtctgcatttttaagatttttttactttaaacgtgaacttattttaagcta

SEQ ID NO: 25043 - DNA, 441 bp, Homo sapiens
  misc_feature 6, 21, 28, 31, 51, 53, 419: n = A,T,C or G
ctgcantcccgacaaatgcangattatnatnttgatcattccaaaccaacngntgaaacggtagcacccgacaacactgcaatccccagtttaagggctgaagatgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtgacttaagtgtgaatttggagtatgcaccaactgaaggtcattggacataaaagaagatatgagtgagcctcaggagaaaaaactctcagagaacactgattttttggctcctggtgttagttccttcacagattctaaccaacangaaagtatcacaaagagagagg

SEQ ID NO: 25044 - DNA, 492 bp, Homo sapiens
  misc_feature 7, 15, 46, 173, 209, 225, 244, 247, 274, 320, 347, 349: n = A,T,C or G
agagaantgactggntataatattaatacctgtgtgcataaatcantattgtatcttgctgataaatctcacaacagttaattattttattccccatttcatacttagctctattttaggcaagttcacaaatatcattgaatgagttcattcaatgtcatcatgatgatatngaaatgtcaatagcagatgacttgtttctggggtgntaatatgcctgttggntacatttgtgttttttggnggnggaaggcagcactgaggcaaacagcangaatacagctaaagcctctaactgcatactcttctcactcgtgctnaaaactgaagcgtggataattgggggngnattccctaaaaaggtatggcatgatgcagtagagaaataaggtaactttcctatccctgtatcaaagttctttggaaggaactgagacagcccaaataagggcagaggttctggggaatcatgaaatctttctaaacaattgg

SEQ ID NO: 25045 - DNA, 282 bp, Homo sapiens
  misc_feature 12, 31, 33, 34, 52: n = A,T,C or G
cccgcctagacntcccaaagtgctgggagtncnngcgtgagccagcgcgccnggcccccaccagggggttaattctcttagtaaaaaggccagttcagagaggggccctgtcttgtccccatccaggggagaagatctacagagcaccctgggaatgtccaagcccagtacgtattttatttcaaacttcaaaatactgccctcttctctctagtattatgaggtttgatgaacaaacctataagttagttatactttcccctttctcctaaattttcatct

SEQ ID NO: 25046 - DNA, 480 bp, Homo sapiens
  misc_feature 33, 41, 73: n = A,T,C or G
cataagtaagttcacttatagtatttctataanttgattcnttgccgtaatagagccatgtaggaaatgcacngattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgctttggcagtgagtaaatagcatattttgaagtagagttgtatactttttcataagatgtttgggaatttttttcctgagtaataatttatccacatctacatcagtgaaagctatctacctatcctgagctatcttaaagg

SEQ ID NO: 25047 - DNA, 261 bp, Homo sapiens
  misc_feature 9, 27, 28, 32, 36, 49, 58, 69, 94, 114, 120, 164, 192: n = A,T,C or G
ccagagagngcaccctctaaatcaccnngatnaaangggacaagcatcnagcacgcancaatgcagctnaaaacgcttagcctagccacacccncacgggaaacagcagtgatnaacctntagcaataaacgaaagtttaactaagctatactaaccccagggntggtcaatttcgtgccagccaccgcggncacacgattaacccaagtcaatagaagccggcgtaaagagtgttttagatcaccccctccccaataaag

SEQ ID NO: 25048 - DNA, 454 bp, Homo sapiens
  misc_feature 45, 48, 79, 418, 452: n = A,T,C or G
gccagctgctggaggtgccgagaatctgagtttcggcaagcagcnttntctggaaactaatattttaaaaatgactacnccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaactcggaagtgaagaatcaagtgagantggaggaggtgaagctcttatcactaaaaaaatntc

SEQ ID NO: 25049 - DNA, 351 bp, Homo sapiens
  misc_feature 8, 22, 27, 45, 76, 80, 88, 215: n = A,T,C or G
aaaaaatntgtgaaggtggaantttgnttttagtatcgtattttncctcttcactatccaataaaaataagtgagnttancaaccctncaggatggcccagaaaagtgagagaatgataaatttaaacaaacagaatgttaacccacctaagtgaaactattagaggaaacagcttcaacaacaacaaaaatgggcacttaagaaaattcaagtncagcataaaaatacttttctgagcttaaaactcagttgatgaagtgggggatagtcactgtggagacttaaattattcaactggagacttcaattattagactggaaaaataagataaatctccaaaacatagagc

SEQ ID NO: 25050 - DNA, 283 bp, Homo sapiens
  misc_feature 29, 36: n = A,T,C or G
tacacaatggaattatattctaccatatnttttatnaaaatgaaattctggcatttgcagccacatggatagaattgagatcattatgttaaatgaaataagccaggcctagaaagacaaatatcacatgttcttactgatgtgggaactaaaaaaagttcgtctttagccaggagtcgtgatgcacccctgtagtctcagctacatgggaggctgaggcaggaggattgcttgagtccaggagattgattccagtctgggcaacatagcaagatgtcatgtc

SEQ ID NO: 25051 - DNA, 104 bp, Homo sapiens
  misc_feature 22, 43, 54: n = A,T,C or G
attgtgactgccaaaatatttngtcatcgagatattaattatnttcaagtggcngactccatacaagaaaataataaaagtatcagaagttaactgtgattatc

SEQ ID NO: 25052 - DNA, 203 bp, Homo sapiens
  misc_feature 4, 9, 15, 17, 19, 20, 22, 25, 33, 66, 96, 113, 114, 199, 201: n = A,T,C or G
gatnacatncaaggntnannanacntgagcganaaccaatctaaattggattctttaatgttgttnaccataacacaaaaagcatgaacttgtatnaatcctatataataganngatcatgcaccatatccacaggaggttggaaaaaccatgccattttctggaatttaagggtgttgcattatttcatcaatcattngntg

SEQ ID NO: 25053 - DNA, 499 bp, Homo sapiens
  misc_feature 33, 445: n = A,T,C or G
atcaatgcctgattctaggtgcatgcgggtganagaacaaaatgggtctgagacacctgttgttgttaagaaaataaggaagtctcaactaatgattgagacatgccaaagaacataggagctaactagaagtggctctcagtgacccaaactgagataaattgaacaagggaataaataatgatggcaatagattattcagattaattaaaccaaatacacacgaatccacactaatataaataaataattggataaataagaaaagtgggacaaaggaaagcttttccatacagtagaattctaatcaataaatatagaaagaatagtggaaatagattctcatttcttggcaaataccacataattgttgcagacaagtctgctaaaattagtggatacaattatgagaaacaaggatatttacataatctccaagtatctntcaacaaaatactgattttaaaaatggtaactttgaagtggagaaatgtggcag

SEQ ID NO: 25054 - DNA, 499 bp, Homo sapiens
  misc_feature 6, 32, 37: n = A,T,C or G
tgccangaaacccttaagaaaaagcgaaggantttcncagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacaagataacgctttgattgctcgatctctt

SEQ ID NO: 25055 - DNA, 494 bp, Homo sapiens
gacagccaggggagggaagggcctctagggaactttgctttttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgctttacaaagataataacagttgtgttctttgctctcgttttggatgcatagactgaaaaattaaaacaaataacttgtaaaatggcttgtaaaaaatacaatt

SEQ ID NO: 25056 - DNA, 473 bp, Homo sapiens
  misc_feature 26, 27, 28, 30, 185, 418: n = A,T,C or G
ggagtcaaacactggatgcagaaatnnngnatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgtngtatgtcagtgtaacatgcagatgtatattgcagtttttgaaagtgatcattactgtggaatgctaaaaatacattaatttctaaaacctgtgatgccctaagaagcattaagaatgaaggtgttggactaatagaaactaagtacagaaaatttcagttttaaggtggttgtagctgatgagtattacctcatagagactataatattctatttgggataatattattggangttgctggtcttcaaacatttaaatcaagcctttggactaaattatgctaatttg

SEQ ID NO: 25057 - DNA, 311 bp, Homo sapiens
  misc_feature 26, 74: n = A,T,C or G
gaaaggttaaaatatcaatgtttggnatttcaaattaaatctatttagtatgttattactggtaataaatgagnaacattataaaatataagggttttaaaaccatgaactcttccagcctgccacctaattggtaatgagttacaacacaatttgtgaatactgtgggccttttcaaaacagaatattttaggactgggcacagtggctcatgcctgtaatcccaacagtttgggaggctgaggcaggaggattgcttgagcccaggagttcgagaccagcctggacaacatagtgagacccctatttcc

SEQ ID NO: 25058 - DNA, 420 bp, Homo sapiens
  misc_feature 1, 8, 25, 45, 54, 74, 89, 95, 96, 104, 108, 115, 180, 234,266, 408, 411: n = A,T,C or G
nttaaaanaacaaatgcggaggagncttactgcttgattgaaagncacactatnaagctatagtaatataaggnggcattgaggaatantatacnncctttacnaaancatttgnaacagggacgtggtgtctaaacatagttccacacatatatagccagctagtattctacaatggtngattttcaatggtgaaagaacagactttttacaaatgatgcttgattaacttgntgatcaaatgaaaaaagatgagtcttgatctncacctttcttgttatagaaaatattaagttgaaatagatcagagacctggatgtaacatgtaaaactctagaactctagaagaaaatatttgagaaaatctttatgaacatgggttagggaaaagatttcttagataaaggngangaaaaatgg

SEQ ID NO: 25059 - DNA, 500 bp, Homo sapiens
  misc_feature 4, 5, 45, 384, 409: n = A,T,C or G
ctgnntccacatttacaaattgtgtacttaaatgaacctcatttnttttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtcatttcaacatataataagcaaaaaaattactaatcagctaataaaaacantcttgtctattcctaaatgtaattngggggggctaagcactttgtgtagtaaaatgatatgtgtctgctctatcattagacatttaaaagtttcatgtcttcacgtgaataatcac

SEQ ID NO: 25060 - DNA, 493 bp, Homo sapiens
  misc_feature 24, 465, 479, 492: n = A,T,C or G
caacaaaatattttgagacatgcnaagaaacagaaaagtgtgacctatatacaggaagaaaacaaaagtaactgcccgtgagagggtccaaatgttggagctagcaggcaaagacttcaaagcaacaattataaatgtgttcaaagaactacatgaaactttctaaacaattaaaggaaggcatgatgacagcatctcatcaagtagagaatatcagtgaagagaaattgttagaaaagaattataaaaatgaaaattttgagttgaaaagtataataactggaatgaaaaattgactagaggggttcaagagtagattttaatctgacagaagaaaaatattggcagatttgaaggtaggtcaataaagattgtgtatgctgaagagcagagaaaagagagtgaaaataaataaacagagctcctaagaaatgtgagataccatcaagcacacctacatatgcntactgggacaggtnaaaggaggagggng

SEQ ID NO: 25061 - DNA, 291 bp, Homo sapiens
taattcaggaacacagaaccaaatactgcatttttttaaataagtgagaactaaacattgagcatatgtggacacagaaaaggaaacaggagacatggaggccttcttggggtggagggtaagaggagggtgaggactgaaaaactacctgttggatactatgctcattacctggatgacaaaataatttgtacaccaaactccagtgacacacaatttacccatgtaacaaacctgcacatgtaccccaccaaacccaaaatgaaagttggaaggaaaaaaaacactgcg

SEQ ID NO: 25062 - DNA, 498 bp, Homo sapiens
  misc_feature 2, 42, 43, 73, 76, 441, 488: n = A,T,C or G
cngacagcattcgggccgagatgtctcgctccgtggccttanntttgctcgcgctactctctctttctggccnggnggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgctgnctgctttttaatattgatatggcttatacacttacactttatgcacnaaaatgtagg

SEQ ID NO: 25063 - DNA, 442 bp, Homo sapiens
  misc_feature 5, 27, 31, 376, 396, 401: n = A,T,C or G
acttntacctataaaaaccacttttanggcngtttgactgcattgagcggctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactaagacatttgtactaaggtatttcaagttatgtaaactcagcctgggcactttctggataactgtaaaatgttttataagatcatgattattgaagatcattttggaaaattttaaatgtcggtgagcagcttaactacttttgnatctagccttttttaacccncctgntacatttacttttttaaataaagaaattccagaagaaatgc

SEQ ID NO: 25064 - DNA, 288 bp, Homo sapiens
  misc_feature 12, 29, 53, 54, 55, 56: n = A,T,C or G
tacaagccagangagagtgggggccaatnggttaacattcttaaagaaaagannnntcaacccagaatttcatatccagccaaactaagcgtcataagtgaaggagaaataaaatagtttacagacaagcaaatgctgagagatttttgtcaccaccaggcctgccttacaagagctcctgaaggaagcactaaacatggaaaggaacaaccggtatcagctgctgcaaaatcatgccaaaatgtaaagaccatcgagactaggaagaaactgcatcaactaacgagc

SEQ ID NO: 25065 - DNA, 500 bp, Homo sapiens
  misc_feature 22, 47, 58, 77, 79: n = A,T,C or G
gacggaacaaaatcagctgagntgatgcagctagcctgaaaggtttnaataatttggntaagttgggattgagtggncnacagcatctctgctgttgacaatggctctctggccaacacgcctcatctgagggagcttcacttggacaacaacaagcctaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctgcaaaatcttgttaatgtcattgctaaaaaataaataaaagctagatactggaaacctaactgcaatgtggatg

SEQ ID NO: 25066 - DNA, 497 bp, Homo sapiens
  misc_feature 28, 30, 36, 50, 52, 290, 444: n = A,T,C or G
ccgcagataaggttttttctctttgaangntttagnttaatacaactacntnaaaaatatagtcaataggttactaagatattgcttagccgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggctacagagccccgaattaataccaatangaagggcaatgcttttagattaaaatgaaggtgacttaaacagcttaaagtttaagtttaaaagttgtaggtgattaaaataatttgaagggcgatcttttaaaaagagattaaaccgaaggtgattaaaagaccttggaaatccatgacgcangggaggaattgcggcatttaaagcctagttaaccgcattactaaacgcagacg

SEQ ID NO: 25067 - DNA, 426 bp, Homo sapiens
  misc_feature 11, 14, 37, 39, 52, 56, 68, 71, 86, 92, 93, 116, 134, 146,150, 179, 203, 210, 238, 256, 288, 291, 348, 360, 376, 425: n = A,T,C or G
gctgatgattntanagagagaatatgagccctcagangngtcgcacgaggangganaagataaaaggnctnaaaaacatgacgggngttganntgacgcttcttcatggagcaggnaaacgtgatctaaaaganaattgtgggatnggcncagcccccgaatcactccaatagaagggnatgcttttagattaaaatgaaggngacttanacagcttaaagtttagtttaaaaggtgnagggtgattaaaataatntgaaggcgatctttaaaaagagattaaaccgnggngattaaaagaccttgaaatccatgacgcagggagaattgcgttatttaaaggctagntaacgcatttantaaacgcagacgaaancgggaaagaataattggggaggggaagacggaaacaatttggagaagana

SEQ ID NO: 25068 - DNA, 500 bp, Homo sapiens
  misc_feature 29, 439, 452, 487: n = A,T,C or G
gcgctactctctctttctggcctggaggntatccagcgtactccaaagattcagggttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgcacagcccaagatagttaagtgggatcgagacatgtaagcagcatcatggaggtttgaagatgccgcatttggattggatgaattccaaattctgctgcttgctttttaatattggatatgcttatacacttacactttatgccaaantcgcgcggttccnataatggtaacatggacatgatcttttccccaatnctactttgagggc

SEQ ID NO: 25069 - DNA, 249 bp, Homo sapiens
actcctagaagaaccaaatacctcaatttttgtttttgagtactgtactatcctgtaaatatatcttaagcaggcttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattg

SEQ ID NO: 25070 - DNA, 176 bp, Homo sapiens
  misc_feature 5, 32, 40, 60, 62, 76, 107, 155: n = A,T,C or G
tgttnaggatcaaattataatattgaaataanaacagctnacatttatatagcatgtttncntatctcaactaatnataaatgggaaaatgggcaactgggcaggcngaacccagagggaagcctgccctcattagaccaagacagcaaggtttnccctggtcactagatgaaatt

SEQ ID NO: 25071 - DNA, 154 bp, Homo sapiens
  misc_feature 2, 50: n = A,T,C or G
gngacatattgtccaaactagaaagctggtgaaatttcactgggcacagnggcttatgcctgtaatcccagcactttaggaggccgagacaggtgaattgcctgagctcaggagttcgagaccagcctgggcaacatggtgaaacctcatctct

SEQ ID NO: 25072 - DNA, 342 bp, Homo sapiens
  misc_feature 32: n = A,T,C or G
caggcctgccctaaaagagctcctgaaggatnctcttaacatggaaaggaacaaccggtaccagctgctgcaaaatcgtgccaaaatgtaaagaccatcgagactaggaagaaactgcatcaactaatgagcaaaatcaccagctaacatcataatgacaggatcaaattcacacataacaatattaactttaaatgtaaatggactaaattctccaattaaaagacatagactggcaaattggataaagagtcaggacccatcagtgtgctgtattcaggaaacccatctcacatgcagagacacacataggctcaaaataaaaggatggaggaagatcta

SEQ ID NO: 25073 - DNA, 498 bp, Homo sapiens
  misc_feature 5, 9, 30, 394, 418: n = A,T,C or G
agganggtncttgttagaaccatgtgacgntgtcacagcccaagatagttaagtgggatccgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggcagattttgaactcttcaatctcttgcactcaaagcttgntaagataggtaagcgtgcataagntaacttccaatttacatactctgcttagaatttgggggaaaatttagaaatataatttgacaggattattgggaaatttg

SEQ ID NO: 25074 - DNA, 496 bp, Homo sapiens
  misc_feature 27, 218, 410: n = A,T,C or G
acactaaatgcttcaaagataagaaanttcatcctaatgatttctaaagagcagttaaaagcattaaaataagtaggtaggctgttaagattaaaattaacattttggggacagaattgtgtctgtaaaaatgtcattggttttattacaagcggattattttattcatattttaaaacaaatgtttaagccacattgatttatcctcattgaggatnatggtctgtgaccacagtaatatccacttatataaatgccaaataatcagagagcttataaagtacaattgtttttgcatcattttctgaatttctttctcttcttttgggtttgtcctctcattgaagtccagtggtttggaaattagttttggcacattgtcttaatgtacctgaaaattgctctgctgnattttgcagcgttcttcatttaattataatgggccatattagacacatttggaaagagaagtccaggacacatttaggggccatgg

SEQ ID NO: 25075 - DNA, 500 bp, Homo sapiens
  misc_feature 9, 14, 53, 499: n = A,T,C or G
ctctggganagatngagattaatacaactacttaaaaaatatagtcaataggntactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggaggaattgcgtcattcaagcctagttacgcatttactaaacgcagaacgaaaatggaaaggattaattggggagng

SEQ ID NO: 25076 - DNA, 299 bp, Homo sapiens
  misc_feature 6, 40, 47, 107, 266: n = A,T,C or G
tcaaanctggagaagatcttagaggttgaagcccaccttntcttttnacataggagggaacagaccatggaaatttaaacgacttcctcacggtcacagaactagtnttttaatcctcaggcagtgcatccccccaccctacaactgagcacaacctctttccccacagtgcaattcagaatatgctcagggaatgccagccaccttgtaaaactgctggggagaaaagcatgattcccacaaggactaagtatcaggggatttgnaattttcctgttttgtattatctgctttgctga

SEQ ID NO: 25077 - DNA, 413 bp, Homo sapiens
  misc_feature 3, 18, 32, 42, 51, 53, 54, 56, 62, 64, 66, 68, 70: n = A,T,C or G
gtnactggaatgtctgancttcaacaaatttnacaaaaacantgatgtggncnncnaacatntntnananagcccaacatcactgatagagaaatgcaaatcaaacccacaatgagataccatctcatgccagtcagaatggcaattattaaaaagtcaagaaacaatagatgctggtgaggctgtggagaaataggaatgcgtttacactgttggtgggaatgtaaattagttcaagcattgtggaagatattacggtgattcctcaaggatctagaaccagaaataacattttgacctagcaatcccatcactgggtacgtacccaaaggaatataaatcattctactataaagacacatgcacacacatgtttatcgcagcactatttataatagcaaagtcatagaacc

SEQ ID NO: 25078 - DNA, 302 bp, Homo sapiens
  misc_feature 11, 19, 29, 30, 32, 39, 55, 56: n = A,T,C or G
aacctgagaantttccttntggggagggnntnttggagngaacccttctaagcanntgtcagaaaaccatgggacttaatcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttatttttttttt

SEQ ID NO: 25079 - DNA, 487 bp, Homo sapiens
  misc_feature 12, 15, 43, 66: n = A,T,C or G
taagttacaacnttntgagagctgagaattttccttttggggnggggctggaggggggatgctttnctaagtctctgtcaaaaaggtcttcttttaattagaactttatctctgtttctcactgtaaatggctgtgaatgacttcccccgctattcctataaacatctgccacgcatatgaagtcagctttccaagtggtatcttgatatcttgcaatgtttctggctagcactgagaatcatcttatactggctccatgccaatgggagacctactttagcttaatttactggtaattaactccacaggactgattcacttttaatttcaaggtagtaatgatgtgctgaaaatggcttaccagggcactaagctgtgagtgttgggagttgttggatttacaaattaacagagatcatgttttatttaaatgaaaccgcgtattatccactcaggaataaaaaaaatcctaattgctgtgggggg

SEQ ID NO: 25080 - DNA, 170 bp, Homo sapiens
  misc_feature 31, 101: n = A,T,C or G
gcacctgcagaggcaggcttcagagctggancagccatcaatgccaggctgccctttaacttcttcttcccgtttgtttgacaatgctcagatgcatcagntccttaatatacacgtgaaatttgaaaactgtacattcggtgagattaaattttatatacaactagcgg

SEQ ID NO: 25081 - DNA, 495 bp, Homo sapiens
  misc_feature 13, 26, 30, 52, 54, 55, 77: n = A,T,C or G
gctataagtaatnctcaagaaagccntcanttttataacctggcaaaatctngnnaatgtcattgctaaaaaataantaaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaaatccccatcattactggtaaagcctcatttgaatgtgtgaattcaatacaggctatgtaaaattttta

SEQ ID NO: 25082 - DNA, 304 bp, Homo sapiens
  misc_feature 2, 42, 50, 54, 82, 84, 86, 172: n = A,T,C or G
gntaaaagaatgtcgtgtttcataatgacttttaacttgggnaaaaaatntttnttgcacgaaagtaccttgaatgtatggntnangctggaaatttcggaagtattttgggggtgttctttgtctaaaaataagtctggtttttgtcaagtccttcagaatattatttatnccggaagaattggtcctcttgcacttggcaggtttattttccggggatacattgttggggggagaaggggtttcttgccactctttccagattgaggtctggtgctggttaaggagggactacccatcctgc

SEQ ID NO: 25083 - DNA, 500 bp, Homo sapiens
  misc_feature 49, 370, 495: n = A,T,C or G
aagctgacagcattcgggcccgagatgtctcgctccgtggccttagctntgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggctttctatctcttgtactacactgaattcacccccactgaaaaagatgagtatgcctgccgtgtgaaccatgtgactttgtcacaacccaagatagttaagtgggntcgagacatgtaagcagcatcatggaggtttgaagatgccgcatttggattggatgaatttcaaattctgcttgcttgcttttaatattgatatgcttatacacttacactttatgcacaaaatngtagg

SEQ ID NO: 25084 - DNA, 496 bp, Homo sapiens
  misc_feature 35, 52, 492: n = A,T,C or G
ccgcagataagtttttttctctttgaaagataganattaatacaactacttnaaaaatatagtcaatagggttactaagatattgcttagccgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatctttttaaaaagagattaaccggaaggtgattaaaagaccttgaaatccatgacgcaagggagaattgcgcatttaaagccctagttaacgcatttactaaaccgcngacg

SEQ ID NO: 25085 - DNA, 498 bp, Homo sapiens
  misc_feature 7, 17, 51, 391, 490: n = A,T,C or G
gctgctncgagctgagnttgtgccactgtactgcagcctgggtgacaggantgagactgcatctcaaaaaataataatgaaactttccaaaacaaagtgccaggaccagctgggttcactgatgtgtttttgagatacttaaggtagaaatgataccaagtctctaccatctctttcagaaaataaaagcagagataacacttcccaactcattttgtgaggccagtattactctaatagcaaaaccaggcaaagatattacaagaaaggaaaactacagatcaatatttccattgaacacagatgcagaaatcctcaaaatattagcaaatcaggaatgcaaggcttgttcaacatttgatattcaagtgtaatccattgcatgcattancagctcaaagatgaaatacgatcatatcaataggtcagaaaaagcatttgacaaaatccaatatccattcatggttaaaacctctcaacacagaaggantacaggag

SEQ ID NO: 25086 - DNA, 497 bp, Homo sapiens
  misc_feature 6, 206, 288, 317: n = A,T,C or G
aaaggnttctggggagccgcagcttccaaacgtataaattattgcctttgtccaagttaaatgtctgggtaggaaatggcattgtcaccgtagtggtgaaaaagatttagtgccttgaaaaaaatcatgcatgtaagccagtctctgagccggattctcgtcatcacctctctgaaagcttctgatgctcatctatatggatgcangagatgcagatactacaggtgaaaagattaagtcactgaggagttgcgggaattgatcattgtagctcactataaatattgnattatcattatcctcatttcctttatgtngttatttcacaccacttactatacattagcattgtgacagtgatcaagtgtgagcctccgtgtgtctttagtccacgttgcttgcacaggcctagcaccttactcctgtggaaccagaggtcccagctggcaatcactcacatgggataaacagcagagcattttgctgcctaggcaaac

SEQ ID NO: 25087 - DNA, 286 bp, Homo sapiens
  misc_feature 7, 56: n = A,T,C or G
taaaganccataaagatgaagttcacccagaggtgaagtgtgttggctccgtagcnctgactgccttggtgactgtatcctcagaagaatttgaagacaagtggttcagaaagatcgaagaccatttctgtccatttgaaaatcagttccatacagagatacaaatcttggcttagtgggttataaaaaacaaaaccacaaatatcttgtactgtattaattgtccttgtttacttcagacaggatccattgctaatcatggagtataaatgattatttatgtttt

SEQ ID NO: 25088 - DNA, 276 bp, Homo sapiens
  misc_feature 2, 15, 49: n = A,T,C or G
cngccagcgcagggncttctgctgagggggcaggccggagcttgaggtnccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagc

SEQ ID NO: 25089 - DNA, 500 bp, Homo sapiens
  misc_feature 12, 14, 39, 41, 497: n = A,T,C or G
gcggcttccttntnaccttgaagaataatcctagaaatntnacaaaatgtgatgcttttgtaggtacctggaaacttgtctccagtgaaaactttgatgattatatgaaagaagtaggagtgggctttgccaccaggaaagtggctggcatgccaaacctaacatgatcatcagtgtgaatggggatgtgatcaccattaaatctgaaagtacctttaaaaatactgagatttccttcatactgggccaggaatttggacgaagtcctgcagatgacaggaaagtcaagagcaccataaccttagatgggggtgcctggtacatgtgcagaaatgggatggaaaaatcaaccccataaagagaaaccgagaggatgataaactggtggtggaatgccgtcatgaaagggcgtcactttcacgagagtttatgagagagcattaagccaagggacgttggccttggactgaagtcgcattgaactctaaacactctgnggg

SEQ ID NO: 25090 - DNA, 464 bp, Homo sapiens
  misc_feature 44, 47, 48, 78: n = A,T,C or G
ctggcgctgtgacaactgccgcagacctgggggtgaacccagtnttnnaaggcactactggccagtcctacaaccagnattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcaggacccagcttagagttcttctttctttcttaagccctttgctctggaggaagttctccagcttcaagctcaactcacagcttctccaagcatcaccctgggagtttcctgagggttttctcataaatgagggctgcacattgcctgttctgcttcgaagtattcaataccgctcagtattttaaatgaagtgattctaagatttggttg

SEQ ID NO: 25091 - DNA, 498 bp, Homo sapiens
  misc_feature 1, 3, 36, 37, 480, 482: n = A,T,C or G
nancacaaggagatccgacggccgtcttaaggagtnnagggaacaattaaaagaacttaccaagcagtatgaaaagtctgaaaatgatctgaaggccctacagagtgttgggcagatcgtgggtgaagtgcttaaacagttaactgaagaaaagttcattgttaaagctaccaatggaccaagatatgttgtgggttgtcgcgacagcttgcaaaagtaagctgaagccaggaacaagagttgctttggatatgactacactaactatcatgagatatttgccgagagaggtggatccactggtttataacatgtctcatgagggccctgggaatgtttcttattctgagattggaggctatcagaacagatccggggaattaagagaggtgataagaattacctcttacaaacccagagttatttcagccgtgtaggaataatacctccaaaaggctgttggtatatggccaccaggtncngggaaaaacactcttg

SEQ ID NO: 25092 - DNA, 493 bp, Homo sapiens
  misc_feature 11, 40: n = A,T,C or G
tcagcctgtantaaaagtcctagtagtaaatatgttcatncttgggggctagtagtaaatatgttcagccttgggggctattttgttaactgctctttgagctctggcctggtagtgggaaagcagccacaggcaatacataatcgaatgggtgtggctgcttgtctttaataaagacaagcagagggccatagttgcagaccccagatttagaccatgaataagccctttgactctcttttagatagtaggtagattttcctttcatacctctactcccaggagtttgaattaattttcacatgaattgctcactatgatgattggttgccagacattcgcagtttccaccagaaatgtttttccttatgttgccagttcttccttggatgctgagtgagcatcttcattcattgtgcttgaacacaatgagtgggtcaggtatcagtagtttggtgcactttatatagtttggatttattaactgtttgag

SEQ ID NO: 25093 - DNA, 336 bp, Homo sapiens
  misc_feature 4, 8, 30, 63, 207, 225, 257, 267, 297: n = A,T,C or G
caanatgnagaaacctcatctctactaaantttcaaaattagccgggcttggtggcgcatgcntgtaatcctagctactcaggaggctgaggcaggagaatcgcttgaactcgggaggcagaggttgccatgagccgaggtggcaccactgcactccagtctggacaacaagagcaaaactccatctcaaaaaaaaaaagccgccgnggtagctcacatttgtantcccagttctcaggcagctgaggcagggagantcggcttgancctaggaggcagaggttgcagtgagccganattgcgctactgcactccagcctgagcggcagagcaaga

SEQ ID NO: 25094 - DNA, 338 bp, Homo sapiens
  misc_feature 1, 11, 58: n = A,T,C or G
ntatttcaccncttacactgaaataaattgcagattgaacaaagattcaaacataaanttttaagctataaatacatagaaggaagcaagggtgaataaatttatacacttgcagtggaaagtctttgtaatcaggacacaaacccagaatcacaaaagagaaaaatgacaaatttaactacataaaattaataacttgtgcttggaaaaataattcataaattaagtttaaaaaagagacaaagttagaaaacagtatttacaacaccaatgtcagacacatggctaatttcattcattaacaaagagcttataagaatcaataaagaaagataaac

SEQ ID NO: 25095 - DNA, 498 bp, Homo sapiens
  misc_feature 8: n = A,T,C or G
ataagtgnccttttgggctttccctcttttttgtaaagcaatgtctgcctagtttattgtccagttaactttagtgaccttttaaaagttggcattgtaaataaaacaacttgcaaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagtttaaatatatgcctagagactcaagtactacccagtttgtggtttttgggagaaatgtaactggacagttagcttttcaattaaaaagaccttaacccatgtgggatgcatcttttataattaggggtcccatgtggagaaaattattcacactactt

SEQ ID NO: 25096 - DNA, 403 bp, Homo sapiens
  misc_feature 1, 57, 287, 305, 321, 397: n = A,T,C or G
naactaaaccagccgaaccttgtttgaggtatgaaagcagctgttataataaactcntttgctctacctcttttcctgttatggtggaatgggctggtttaaagtaaatgtctccaatccatggattttctggggtcatgaaacattgtttaattggcagactggtattacattttttggggaagttaggaagtaacaggaatgccacacgcccatggttagaatccatgcagtgtaaaaggtctgtaaaggaaaccggtccctgggaattctggagcccattattncccactttccaacccccnggggtgggcccagccntctcaaggttttgaggttgttccaaaaaagaatgggatttctgcctctcttttatcccaggactttcaaaggagancaaggg

SEQ ID NO: 25097 - DNA, 500 bp, Homo sapiens
  misc_feature 2, 3, 57, 59: n = A,T,C or G
gnnaattgcccagccagcgcaggggcttctgctgagggggcaggcggagcttgaggntnccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaaggcaatgcttttagattaaaatgaaggtgacttaaacagcttaaagtttagtttaaaagttgtagggtgattaaaataatttgaaggcgatcttttaaaaagagattaaaccggaaggtgattaaaagaccttgaaatccatgacgcag

SEQ ID NO: 25098 - DNA, 498 bp, Homo sapiens
  misc_feature 2, 439: n = A,T,C or G
anacgagaccactgcaaaatattttccttttatactacagaaatgagaatattcacattaaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagtctacacattacattgaagttaaacacaaaattatcagtgttttagagacatgagtccggctgtgtaagtaaaagtcaaacattatttccaccataaagtatgtattgaaatcaagttgtctctgtgacagaatcatacttattcccatttttaagcatttgcttctggtttccctacctagaatgtcagatggttttcagttatctcccattgncaaagttgacctcaagatacatttttcattaagcatctgagatctaagacacaattatt

SEQ ID NO: 25099 - DNA, 498 bp, Homo sapiens
  misc_feature 17, 36, 58: n = A,T,C or G
aaaggcacctgtaaggntcgtctaaaagctgatggntatgtaagttgctcaggcactnagatgacagcagattctgggttctgggagtgttctgtgtctcttacatgccctggaggcctcacggtctcagtgctgaggcggcacacctgtagcacacctgcgtaatgtgcggctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgacatatttatttacttttctaactgctccaacagccaaatgccttttttatgaccattgtatcagttcattaccaaagaaatgtttgcactttgtaatgatgcctttcaagtcaaataaatgggtc

SEQ ID NO: 25100 - DNA, 293 bp, Homo sapiens
  misc_feature 4, 5, 58, 59: n = A,T,C or G
gaannaatcctatcaacagataactttcataaaaaggaatacaggaaagaaagaaagnnggaagagaagaccacaaaataaccagaaaacaaataacaaaatggcaggagcaagtccttacttatcaataataacattgaaagtaaatggactaaacttttcaatcaaaagacacagagtggctgaataaatcaaaaagcaagacccattgatctgttgcctacaagaaacatacttcacctataaaaacacacacagactgaaaataaagaaatggaaaaagatatttcaca

SEQ ID NO: 25101 - DNA, 197 bp, Homo sapiens
  misc_feature 17, 50, 196: n = A,T,C or G
gattgcgagggagcatngtaagagctagtatctcttctcagtcatagtgntggttttcctagctgctatggaaaggtttgttcacttatgagattaggacttttcttaaattcctcattaaatatgaacctaaggcatacccatcatttaccttgattcccatataatttgtgtaagtcatatataagtccattgnc

SEQ ID NO: 25102 - DNA, 500 bp, Homo sapiens
  misc_feature 6, 9: n = A,T,C or G
gaaggnagnccatcaaaacaaccagaaaataagcaacagaatggtagtagtaagtccttgctttatcaataataacactgaatgtaagaggactcggttctccaattaaaaggcatagaagagctgattggataaaggaacgagacccaactatatgctccttcaagaaacccacttcacctacagagacacacatagactgaaagtaaagggatggaaaaagattttccatgcaactagaaaccaaaaaagaacatgagtatacttacatcagataaactacaaatcaaagactgtaaaaagaaacacagtcactctgtaataataaagtgatcaattcagccagaggatgtaacaatgataaatatccatgcacccaacaccagagctcccaactatataaagcaaacatgaatagatctaaagggagagatagactgcattaatattaggagactttaacaacctgttctcagtaatgaatagataatccaaacaga

SEQ ID NO: 25103 - DNA, 380 bp, Homo sapiens
  misc_feature 8, 11, 377: n = A,T,C or G
atgccatngcnctccagcctgggagacagacccagaccctatctcaaaaataaataaataaataaaaatatagggaaagttgtttaaaaaaatcataggcttctgctgtctgattcctcttaagtactccacattcactttgttttatcaaagaaatcaaagctggaaattgaaaagtacattctatgcacttatatagtgtggtattctgtaactccaaactagttcagtactcaaaaggacttgcctgattatatgttgtaagattgatgaatgagtcacattatatgttagaaaaattttaagggaggtttgtatttctcttgatgaaaaatgttatatatatgaaagaaaagagtggtattatcactcaaatnagc

SEQ ID NO: 25104 - DNA, 288 bp, Homo sapiens
  misc_feature 2, 13, 32, 38, 39, 40, 43, 49, 50, 52, 65, 69, 77, 83, 158: n = A,T,C or G
gnaagacagcccngggcgcggtggctcacgcntgtaannncancacttnngnaggcttggcgggnggancacctganatcggnagttcaagaccagcctgaccaacatggagaaaccccgtgtctactaaaaatacaaaattagccagggtggtggcngcatgccttgtaatgccagctacttgggaggctgaagcaggagaatcgcttgaacctgggaggcggaggttgcggtgagccgagatagcaccattgcactccagcctgggcaaaaagagcgaaactccgt

SEQ ID NO: 25105 - DNA, 497 bp, Homo sapiens
  misc_feature 10: n = A,T,C or G
aagaaggacnggcaacccatgtctatcgttatcacagaggcgagtcgaagctgcgcatgtgcttggacatagggaatggtcagagaaaagacagaaaaaagacatcccttggtcctggaggcagctatcaaatatcagagcatgctccagaggcatcccggcctgctgagaacatctctaaggacctctacatagaagtatatccagggacctattctgtcactgtgggctcaaatgacttaaccaagaagactcatgtggtagcagttgattctggacaaagcgtggacctggtcttccctgtgtgatgttgaccatcactgccatcacatcacctttttttaagtagtaagaataaagccactgtatgattctcttaatagctatacatcaatcctgttttaagtgctgactgggtcagcccttccgggactggagtctggtctctttcagtgctttttggttggttggttggttcaccatgttggccaggatgg

SEQ ID NO: 25106 - DNA, 500 bp, Homo sapiens
  misc_feature 20, 76, 77, 78, 361, 364, 396: n = A,T,C or G
cgactgtggatgtggtaganacagcaagagaacttgaattagaagtttccctgaaaatgtgactagattgctgctnnntcatgatcaaatttaaatggatgaggagttgcttcatagggatgaacaaagaaagtggtttcttgagatgagatccactcctggtgaagatgctgcgaacaacgttgaaatgacaacaaaggacttaaactatgacagaaacttaagtgataaagcagtggtagggtttgaaaggactgactccaattttgaaagaagttgtctggtgggtaaacagcattgcatgatacagagaaattgttcatggaaaggagagtacatggatgcagcaaaacttcattgntgncttatttaagaaattgccacaggcactccatncttcagcaaccaccaccctggctattagaaccatcaatatcaaggcaagatcttcaccaacaaaaagcttatgactcactgatggctcagatgatcatttagca

SEQ ID NO: 25107 - DNA, 359 bp, Homo sapiens
  misc_feature 9, 11, 27, 31, 38, 51, 58: n = A,T,C or G
aaatctccngngaggactttcaaatgnggtnacctcanctatatcactgcncaacttnagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatctg

SEQ ID NO: 25108 - DNA, 498 bp, Homo sapiens
  misc_feature 24, 57, 473: n = A,T,C or G
tgaattgcccagccagcgcagggncttctgctgagggggcaggcggagcttgaggtnccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaagggcgatcttttaaaaagagattaaaccgaaggtgattnaaagaccttggaaatccatgacgca

SEQ ID NO: 25109 - DNA, 298 bp, Homo sapiens
  misc_feature 4, 14, 15, 16, 17, 18, 20, 22, 27, 31, 32, 33, 35, 38, 42,45, 46, 52, 54, 55, 63, 67, 68, 71, 73, 76, 77, 78, 80,83, 85, 131, 144, 181, 182: n = A,T,C or G
actnacgactggcnnnnntntnagaanctgnnngntangatnacnntgcccngnntccagacnaatnnttntncgnnnangcncnttgtggaccaggtagagcaattactactcgttctgggcagaccttntccaaagtttggnacaactgtccttagactgatgagcaaaggaggagtcnnctaatgaagaaatgaataataaattttgacactgaaaaacattttattaataaagaatattgcatgagtataccagtttatatataaaaatgtttttaaacttgacaatcattaca

SEQ ID NO: 25110 - DNA, 500 bp, Homo sapiens
  misc_feature 12, 49, 52: n = A,T,C or G
cgaagaaaagancccgaagtattcaggctgccctggatagtgcatacanttnaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtgggggaccttaggcttgcattgcagcgtacagaacaagcggctgccagaaaggaggattatttacgccatgagatcggtgaacttcagcagagactccaggaagcagagaatcgaaaccaggaactgagtcaaagtgtttcatcaacaacaagaccattgcttcgacaaatagaaaatttgcaagcaccctgggatcccagacatcgtcgtgggagaaattagagaagaatctttctgataggcttggtgaatcccagaccttgctggcagcagcagttgagaaagaacgt

SEQ ID NO: 25111 - DNA, 427 bp, Homo sapiens
  misc_feature 3, 4, 57: n = A,T,C or G
aanntcgcccttcctttagtcaggaaggacgttggtgttgaggttagcatacgtatnaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcataccgcagatttctacagaaactacgatgtcatgaaagattttgaggagatgaggaaggctggtatctttcagagtgtaaagtaatcttggaatataaagaatttcttcaggttgaattacctagaagtttgcactgacttgtgttcctgaactatgacacatgaatatgtgggctaagaaatagttcctcttgataaataaacaattac

SEQ ID NO: 25112 - DNA, 258 bp, Homo sapiens
  misc_feature 3: n = A,T,C or G
canctgcccccagcactttgggaggcggggcgggcacatcacctgagttcgggatacagagaccagcctggccaacatggtaaaaccccgtctatactaataatacaaaaattagttgggcgtggtggtgcatgcctgtaattctagctactcaggaggctgaggcaggagaatcgcttgaacccgggaggcggaggttgcggtgagccgagatctcgtcattgcactccagcctgggcaacaagcgtgaaactccgt

SEQ ID NO: 25113 - DNA, 500 bp, Homo sapiens
  misc_feature 5, 10, 54, 491: n = A,T,C or G
aaaanctggncaacaatttttgtaaaagatggctactctgtagtgctttaactngacctatttagacaatgccttacacactggaggacgatactgtgtaaatctaataagtctacaagacaatacttctgtcttttggctctctccttcctctccagggtgatgacaaatcgtgagggtggagattatacctctctcatcatttcagcaccaaggaagtaaattagtggcagagtaagggaaacttgatgagtacatccaattgttgacatagttctgggtggagaaattttgctattatatcgacttcttaaaatagtctagtgggattaacttggtttcaattcacagagatctggaagcgaggatcttttaaaaatcctgaaatatacactgcaataaaagaacaaagcatacacctcagccttaaatgactgaagaagtatgtcaagtagcagcaggtgggaaagtggctttgggtttcagtttgngagctctga

SEQ ID NO: 25114 - DNA, 498 bp, Homo sapiens
  misc_feature 5, 53: n = A,T,C or G
gaccngggttaatagccagatagtaagaaccagtgaggagatgcggccaaagnttctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgcctcagggactgcaccctgacaagtgttaaggcaacattcctttcttgtgccctgggccaaaaccaatgctgatgaccttatcagcttctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcaagttataaaggcaaaggacgaatttgcacagtggatata

SEQ ID NO: 25115 - DNA, 500 bp, Homo sapiens
  misc_feature 9, 13, 55: n = A,T,C or G
tgggccagngaanatactgcaggcaggcttcagccatgttgtgaaactgataaangcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttgctgagtgaaggaatgatattcatatattcatttattccatggacatttagttagtgctttttatatcca

SEQ ID NO: 25116 - DNA, 429 bp, Homo sapiens
  misc_feature 4, 6, 53, 54, 56: n = A,T,C or G
cctncnaagttaattggtcccccagaaatgcacaaatatcactgtgaactcanntncttaagggagaaagaaaaacagctcgagacctcatgcaaagagaaaactgagtatctacagaaagtggttcagaggaatgaaagatataaacaagatgtggagaggttctatgaacggaagcgacatttagatttaattgagatgcttgaagcaaaaaggccatgggtggaatatgaaaatgttcgtcaggaatatgaagaagtaaaactagttcgtgaccgagtgaaggaagaggtcagaaaacttaaagaagggcagattcctataacacgtcgaatcgaagcaatggaaaacgagcgtcacaatttggaggctcgaatcaaagaaaaggcacagatattaaggaggcatctcaaaaatgcaaacagaagc

SEQ ID NO: 25117 - DNA, 500 bp, Homo sapiens
  misc_feature 2, 7, 56: n = A,T,C or G
anactgncctttggatatgtggaatcttatattatagtgtaagttctaatcttttnacaaggattttagctttttgtagctatagtactgtacaaacagcagaagcatggtacttgttgagaagtaggtgagaaactgtagttccaagctccttaaggatagagacatgatgtttactgttcttacccagtggctggcacagtataggcactgaatatatgttgactgaatgactatgaggaaaaacaagtattattaacattagctcatttcggtaaacctagcctaacacttaaaatatttctcataatattctaattggtcttattgtctacttattgccagaagttaaaatgcattttgctaatcagtcaatagaacctttgggaagaaaagtggaagggtctgaaacttcctccctcccacaaaaaggcctgaagattcctggcttagagcatgcgagcattgaaggaccaatagcaaacttatcaggtcttgga

SEQ ID NO: 25118 - DNA, 495 bp, Homo sapiens
  misc_feature 1, 56, 399: n = A,T,C or G
naatgatcccatttcaagcgttttaatgcattgcagtatctgcgtttacctcacancgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcaagaaaccagtcttccaccggatatgtatgaatgtctacgtgttgctaacgaagcactcttaattaatatctgtatcctggacaatattttatgggtatgtttttctgngggcaggtttcatagtatccatatttattactggttattacttccatgaattttaaaatctgagggaaatgtttgtaaacatttatttttttaaag

SEQ ID NO: 25119 - DNA, 146 bp, Homo sapiens
  misc_feature 1, 2: n = A,T,C or G
nnacctcacaccacctgagcaaaaaggcctacggtacggaataatcctatatattacctcagaagtttttttcttcgcaggagggggctgagccttttaccactccagcctagcccctaccccccaattaggagggcactggcccc

SEQ ID NO: 25120 - DNA, 497 bp, Homo sapiens
  misc_feature 1: n = A,T,C or G
naagtttccattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgtcagtttggtgcatttgctgctgctgttgctactgtttgcctcaaacgctgtgttaaacaaccgttaaactcttagcctacaaggtgctcttatgtacatagttgttaatacatccaattaatgatgtctgacatgctatttttgtagggagaaaatatggctaatgatattttgagttaaaatatcttttggggaggatttgctgaaaagttgcacttttgttacaatgc

SEQ ID NO: 25121 - DNA, 500 bp, Homo sapiens
  misc_feature 14: n = A,T,C or G
cagccagcgcaggngcttctgctgagggggcaggccggagcttgaggtttccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaggataaaaggtttctaaaacatgacggaggttgagatgaagcttcttcatggagtaaaaaatgtatttaaaagaaaattgagagaaaggctacagagccccgaattaataccaatagaaggcaatgcttttagattaaaatgaaggtgacttaaacagcttaaagtttggtttaaaagttgtaggtgattaaaataatttgaaggcgatcttttaaaaagagattaaaccgaaggtgattaaaagaccttgaaatccatgacgcagggagaattgcgt

SEQ ID NO: 25122 - DNA, 100 bp, Homo sapiens
  misc_feature 2, 11, 54, 61, 92: n = A,T,C or G
gnccgaaaaangtctctgttgaacgtaatgctacctgactgctcgatctatcangcgccgnaaaggcatcggatagtccgaaatgtaacagntgtgggtt

SEQ ID NO: 25123 - DNA, 130 bp, Homo sapiens
gatgtttgcaatatgcatcaagtttgaggacctctgatttaagctgtgtgaagtgttttcaactgtcccgattcagagaacagagtcatgtaatggctcagaggattcctccacccacttacacacacac

SEQ ID NO: 25124 - DNA, 497 bp, Homo sapiens
  misc_feature 2, 9, 37, 41, 57: n = A,T,C or G
ancaggccnagccaaaaccctgatttataatcctttntttntcatgagtcattttcnttactattattccaaccaaaatcattaatcacattcaacctaatgacccaactcaagttgatgctaaagagcacaaaaatgacacttgaaactgaccatgataacaagcttcttcgatcaattcgcaagcccctaccttttaggtatcccccttatcctcgttgccatacttctaccttgacttctttttcctgctccaacatcacgatgaatcaacaatcgacttatcaccgccaaacatgattgactggacgattcacaaaccaacttatgaccccactaaactttagcggccacaaatgagcacttttatttgcctctctaatagtattcttaatcacaattaatcttttaggacttcttccttatactttacaccaacaacccaactctctctgaatataggatttgcagtacccctatgacttgccacagtaatt

SEQ ID NO: 25125 - DNA, 499 bp, Homo sapiens
  misc_feature 2, 33, 39, 67, 75, 284, 335, 362, 484, 487: n = A,T,C or G
anactcatggcacaattgacttccctgaatttntgattntgatggcaagaaaaatgaaagacacagncagtgaanaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggtcaagtaaactatgaagagtttgtacaaatgatgacagcaaagtgaagaccttgnacagaatgtgttaaatttcttgacaaaattgtttatttgccttttctttgnttgtaacttatctgtaaaaggtttctncctactgcaaaaaaatatgcatgtatagtaattaggacttcattccttcatgtttcttcccttatcttactgcattgtcctaaaaccttattttagaaaattgacaagtacatgttgcatgnggntactctggatat

SEQ ID NO: 25126 - DNA, 208 bp, Homo sapiens
  misc_feature 40, 96, 171, 194: n = A,T,C or G
attcgggccgagatgtctcgctccgtggccttagctgttntcgcgctactctctctttctggcctggaggctatccagcgtactccaaagattcangtttactcacgtcatccagcagagaatggaaagtcaaatttcctggaattgctatgtgtctggggttcatccatncgacattgaagttgacttactgnagaatgggagagag

SEQ ID NO: 25127 - DNA, 254 bp, Homo sapiens
  misc_feature 1, 58, 228: n = A,T,C or G
naaaatgccccagaaagcgtggggaaaagagctctctgggatccttcttataaggctnctattcccattcggagggctccactgtcatgacctagttaccttccaaaggcctcatcttcaaattggggattaagatttcaacatacgggttttggggggacacaaacattcagtccataaaagtcattatagtcctttgcagtcaatagttgcctctccctactcctnctaagagacaaccatcattctgactt

SEQ ID NO: 25128 - DNA, 500 bp, Homo sapiens
  misc_feature 8, 9, 493: n = A,T,C or G
aaccgatnncagagaaaattttgcatgcaaaaatttaggaagatgaatgatactcattattattattctttcagtccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgcattgttgaaaggacaccgcagggaccactggcagtacctatgtggaataagcatggatgctagttcactgtggagttgagatgcattttacataattatgagtttggtcatataaagaaaagctgtggaaaaagagtcttagagattttgtaatatcattctaaatagattaagaaaagatataatttctttactgcagtaaatcatataatgtttgnatgatta

SEQ ID NO: 25129 - DNA, 100 bp, Homo sapiens
  misc_feature 22, 26, 31, 37, 56, 57, 58, 87, 98: n = A,T,C or G
aaaatgtccgtgaaaatgaganctangcatnactttngccaaagtaaggcctttgnnntatatttatataggccatacatagagaantcacctagctnta

SEQ ID NO: 25130 - DNA, 180 bp, Homo sapiens
  misc_feature 10, 26, 29, 40, 49: n = A,T,C or G
atactatatnaaaacaaacaacaacnacnctttctgattngtctaccangtctggtccaggtatagtacaaagaagtgaaatgttctcagccaaaacataaaagattgtttaatagttataaaatgaacatttaacacaaaatttctgggagcaaatatgagaaaattctgctaatatag

SEQ ID NO: 25131 - DNA, 498 bp, Homo sapiens
  misc_feature 1, 2, 58, 59, 377, 400, 465, 487, 494: n = A,T,C or G
nnactaccccgtcataaaaaagaataaaagcatgtcttttgcagcaacatttaatgannctctaggccattatcttaagtgaagcaactcagaaacagaaaaacaaataccacatgttctcacctaaaagtgggagcttaatacttaatgagtacaatgtacattattcagtgatgaacactctaaaagcccagacttcaccactatgcaatatattcaagtaacaaaattgcacttttgccccttaaatttatacaagtataaagaactgcacaattaaagcaaaatagtacagtatacaaccaatataaatggtgcaactcatctacttaaattttgaaaaaagaaaaagctaaggtgtattaatcaaatgctgngggtgtgatactgggaccagatnaagataatttagtatacaaatatgctggaaggtcagccattaaggttcaaatcaaacgaaaattncacaataaggctacttcagctnattaatnaatt

SEQ ID NO: 25132 - DNA, 271 bp, Homo sapiens
  misc_feature 6, 48: n = A,T,C or G
ctgggntgaggcggaggagaacttccagaattatggcgaagtccgttntgaggcaggacccgcagagcacagctgcaagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtcttgga

SEQ ID NO: 25133 - DNA, 237 bp, Homo sapiens
  misc_feature 1: n = A,T,C or G
nacaaacccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattc

SEQ ID NO: 25134 - DNA, 133 bp, Homo sapiens
  misc_feature 15, 49, 110: n = A,T,C or G
cagccagcgcagggncttctgctgagggggcaggcggagcttgaggttnccgcagataagtttttttctctttgaaagatagagattaatacaactacttaaaaaatatngtcaataggttactaagatattg

SEQ ID NO: 25135 - DNA, 498 bp, Homo sapiens
  misc_feature 1, 7, 239, 464: n = A,T,C or G
naaaggncccgaaaacacttcccatttacctgttgttgctgctgtctgttttcgtgtttcagcaagtttcatctcaagagctttcctgtaaaggccgctgctttgagtccttcgagagagggagggagtgtgactgcgacgcccaatgtaagaagtatgacaagtgctgcccgattatgagagtttctgtgcagaagtgcataatcccacatcaccaccatcttcaaagaaagcacctncaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcggaaaatcaagtcttccaaaaattcaagctgctaatagaggaattacnggaagaactcaaagtaaaagataccaaggaggac

SEQ ID NO: 25136 - DNA, 108 bp, Homo sapiens
  misc_feature 89, 95: n = A,T,C or G
tacgactatagagactagttcaggcctcccagatactgacaaacgtggggaagtgacccagctggctggcaacctggcagaggaccatnatgccngctgtcaaaagag

SEQ ID NO: 25137 - DNA, 178 bp, Homo sapiens
  misc_feature 18: n = A,T,C or G
aagagcacaaggaggttnagagagaccctcactgctggggagtccctgccacgctcagtcccccaccacactgaatctcccctcctcacagttgccatgtagaccccttgaagaggggaggggcctagggagccgcaccttgtcatgtaccatcaataaagtaccctgtgctcaaccg

SEQ ID NO: 25138 - DNA, 330 bp, Homo sapiens
  misc_feature 47, 327: n = A,T,C or G
actaaagaaagattatatataactatgctaattgttcataatcaacntaaaccaagatagagctacaaactcagctgtacagttcgtacactaaactcttcttgcttttgcattataaggaattaagtctccgattattaggtgatcaccctggatgatcagttttctgctgaaggccctactcagtatcttttcctctttatcactctgcattggtgaatttaatcctctcctttgtgttcaacttttgtgtgcttttaaaatcagctttattctaagccaatctgggctactttaaaaaactgggaatgggaaaaaaaataatcnttg

SEQ ID NO: 25139 - DNA, 475 bp, Homo sapiens
  misc_feature 2, 390, 410, 429, 432, 462, 465: n = A,T,C or G
tnaaaaacccgcttgctttcatattagttttttttatatttttatatcttttggatttattttcttggaacccaattggaaataagtcaggtatgaccatttaaagagactaaagaagtgattcagtttctcatgtaaggaaaatattttagtttgtggggagatcaagtcattgcagcctagactgttaactatcttcaacacattttctaatattgtagcattgcctatcaatttatattacatataagcctcagctatgtttactgccagtaatattgctcactggaagatcaaggccacatgaaagccatttttcaaatagttcacatatatctatattgcacttaacaaacttttgggccggcacagtggctcacacctgtaatnccagcccttgggaggccgangcaggcgcatcacctgagncangaggtcaaaaacagcctggccacatgatgnaancccatctttt

SEQ ID NO: 25140 - DNA, 476 bp, Homo sapiens
  misc_feature 2, 342, 400, 420, 444, 460: n = A,T,C or G
gncaaaaacccgtcattcaaggacctccaaaactttaagtaccctatcattaaaaatctggttttaaaagtagctcaagtaagggatgctttgtgacccagggtttctgaagtcagatagccattcttacctgccccttactctgacttattgggaaagggagaactgcagtggtgtttctgttgcagtggcaaaggtaacatgtcagaaaattcagagggttgcataccaataatcctttggaaactggatgtcttactgggtgctagaatgaaaatgtaggtatttattgcagatgatgaagtcattggttttttcaaaattggggtgaaatatcactgnccaatgtgttcacttatgtgaaagctaaattgatgagcaaaaagagcaaataggttgnatatttggtaatccttttgnatttcttacaataaaaatattggnagccaataaaataatnaaaccatacctttaac

SEQ ID NO: 25141 - DNA, 498 bp, Homo sapiens
  misc_feature 7, 55, 57, 449: n = A,T,C or G
taaaggnccccacttccggcgtagccatggcggctaacgctactaccaacccgtntnagctgccgcccttagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgcttacactagattttgttttggcttataatgacaagaaaatggaattttttttcccactttctaatgtttaaatcccataaagctaagtttcccgttaaagggaaagtgctttgaagatgtgtcccatttttgnaaggtaatcatgattatcctggaaaaagaagaaaagagcttcttctttg

SEQ ID NO: 25142 - DNA, 289 bp, Homo sapiens
  misc_feature 12, 40, 43, 44, 53, 59, 75: n = A,T,C or G
gcagcgcagggncttctgctgagggggcaggctggagctnganntttccgcanataagnttttttctctttgaangatagagattaatacaactacttaaaaaatatagtcaataggttactaagatattgcttagcgttaagtttttaacgtaattttaatagcttaagattttaagagaaaatatgaagacttagaagtacgggaaggcgaagaaaagaatagagaagatagggaaattagaagataaaaacatacttttagaagaaaaaagataaatttaaacctg

SEQ ID NO: 25143 - DNA, 349 bp, Homo sapiens
  misc_feature 2: n = A,T,C or G
anataacctataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtatatcagtttatatataaaaatgtttttaaacttgcaatcattacactaaaacagatttgataatcttattcacaggtgttattggttacagaccatttaattaatatttcctctggttattcctcctcttcctcccattgcatggtcacacctgtt

SEQ ID NO: 25144 - DNA, 252 bp, Homo sapiens
  misc_feature 16, 26, 42, 50, 63, 67: n = A,T,C or G
taaccttcctgtactntagtccaggngccaagaatttccctnctaccctntattttcttgtgnccgnaagttacaaagtcaggaaaagtcttggctggacccctttcctgctgggtggatgcatgtggtccaggactggggtctgggcccaggtttgagggagaaggttgcaagagcacttcccacctctctgaatagtgtgtatgtgttggtttattgattctgtaaataagtaaaatgacaatatgaatc

SEQ ID NO: 25145 - DNA, 500 bp, Homo sapiens
  misc_feature 5, 9, 464, 467: n = A,T,C or G
tgagnccangtaaaacactaaagactaaagactgataagagaaaggcaaataatccaatacaaaaatagtcagagaatttgaaaaggtgattcgcagcaaatgagcaatttggtggaatttctaggtagaactgaaaatgaacaaatgatttagcaatttcacttctatgtatactctggaaaagaagtagtcaaaaatatatttaagtcctttgaaataattgacttcagtacccctttaatgagcatttattaagcttctgctatatgtcaagtactatctgctaggagctgggaatcaaagatgaataagacaggtttcttgccctccagtaattgatgatgtgctgtgagagacaagaacttcaatggtaagtacaatgcacttgattaaagtctatattagttaagggtcttaactaagaattttaaagggatgatgggcatctcttagatagaactgnctncatattactgggtttgctgatttagtctaattt

SEQ ID NO: 25146 - DNA, 194 bp, Homo sapiens
  misc_feature 13, 21, 39, 43, 48, 51, 61, 65, 134, 143, 154: n = A,T,C or G
taacaagcccggnacctggtnatttctccagatccaagnacanatacnttnagcctcaggngtgngcaggactcccttacaggatatcctggctgtgtgtgtgtgtgtgtgtgtgtgtgtgtgtgcgcgcattngacacacanagacagaaggncttgggaaggagggagagagaaaaagagagagaggagagt

SEQ ID NO: 25147 - DNA, 213 bp, Homo sapiens
  misc_feature 5, 10, 38, 109, 137, 209: n = A,T,C or G
aaagnatttnagatgcgactgaattgctgcaatctcangatcaaatttgaatggatgaggagttgctttttagggatgagcaaagtctgctccttgagggcaggacagntcttatggctttatccgttgcgtaagcncagagaggctgcgaggtcaaaactattgtcatgatagcaaagatgcctgctttttcatctattctcaccggngtgc

SEQ ID NO: 25148 - DNA, 387 bp, Homo sapiens
  misc_feature 7, 11: n = A,T,C or G
aaacaancctntggatgagcttttatatatggaacttactccaacaggactgaggttccaaggaaacatgatgggggaggcagagagggcaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactgggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtg

SEQ ID NO: 25149 - DNA, 496 bp, Homo sapiens
  misc_feature 1, 59, 89, 244, 369, 492: n = A,T,C or G
naaaaagcccccaaaaaacccacttctaccaaaaagccaaaaacaatgcctagagtgtnaaaaccaaagacgacaccaactccccgcangatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctnatatgcttctcaggccccatgtgttcatgcctgaagttactcccgcatggattacttaccgagagtcccaatcaaggcattatcatcaatccatgctttccgatgagacaatatttgcaatggtnagccagtagatggactgactcttgcgcaatgggacattagttgcattccgaggcattatttctgggatgctaagtccattcagtccaccatcttcagctcgcagaattactgaggttgggggnattc

SEQ ID NO: 25150 - DNA, 305 bp, Homo sapiens
  misc_feature 26, 97, 98: n = A,T,C or G
aaaggggataaatgtgctaattaggnagtaaacatctactctcatattcttcccatcctttattacctttttgtctatatcctaggagacattcttnnctattttttcagacctactgttaataatggggtaataagaggctgtagattaatagcagttcacattcatgtggtactatcgaggtgccaggtactggactaaatgttttcattacctcatttaaagcctggagagttaaagtattttctctgaagtcacataacttgtaaagaaagaagctgagattagttttacagccctcactt

SEQ ID NO: 25151 - DNA, 498 bp, Homo sapiens
  misc_feature 1, 57, 403, 450: n = A,T,C or G
naaaaaacccaaccatatatagccagggaaaattctagaaaaatacgggataatttnactcacaaagttataaagcctcaataattaaatagcgtgttcctggcacatggataaagagatcaatcaagggaagtatattagcgttctccagagaaacagaaccaataggatatatattgtattagtccattttcacactcctataaagaactacctgaaactgggtaatttatgaagaaaggaggtttaattgactcatagttccacaggcttaacaggaagcatgactgggaggcctcaggaaacttaaaatcatggcagaaggcaaaagggaagcaaggaccttcttcacatggtggcagaaagagagagagagagatgggggaagtgccacacacttttnaaccgtcagatctcatgagaactctttcactatcacgagacaggtanggaggaaatcacccctcatgatccccttccctgacacagggggattac

SEQ ID NO: 25152 - DNA, 329 bp, Homo sapiens
  misc_feature 6, 24, 32, 34, 41, 57, 58, 59, 60, 61, 62, 71, 83, 109, 228,272, 285, 287, 306: n = A,T,C or G
aaggangctgatcatgaattatanttgctttntnctagaanaagcattgaaatgagnnnnnnttgcttttncattttccctgngctttatatgctcttcgcaatacatnatgtccaacgggatacctattgttctcatgacacccaaaattgatgagagcaaaggggtcgcaccatatggaaatgttgaaaactattgtaaagtagtattatgaagtagcttttgtgncattcatgtcgatgacatgaaagtgaaggaaatttattctatgnaaattcacactananccaggacagtccataagtngaatcatgtaagaatcacctagt

SEQ ID NO: 25153 - DNA, 497 bp, Homo sapiens
  misc_feature 2, 12, 27, 28, 32, 36, 38, 40, 41, 44, 49, 50, 57, 62, 98,100, 102, 328, 372, 405, 417, 452, 479, 497: n = A,T,C or G
cngaaggacacntcacaccagcctganntttnttantncnngcnttttnncatcctnctggntagatcatatgttagatgaaaaaataagttccactnantncaaaacatcaaactgatatcaagtatcttttctcttcataacacagtaaatttagaaatcaataacaagaactttcaaaactgtacaaatacatggaatttgacaacatgctactgaatgaccaatagattaatgaggaaattaagaagggcattaaaatgtttctggaaacaaatgaaaatgaaccacaacataccaaaacctatgggatatagtaaaaggagtnttaagaggcatgtttatagcaataagctctacatccaaaaagtngaaagatttcaaagaaacaacctaatgatgcanctcaagaaactngaaaagcaagaacaaaccaaacccaaaattagaangaagggggtaaagataaacagaaattnacaggattggagactaan

SEQ ID NO: 25154 - DNA, 120 bp, Homo sapiens
  misc_feature 9, 31, 39: n = A,T,C or G
atataccantatggaaagagtgatcacgggnagaattgntgtttcagttgagaaattagtggcgcggtggagttcatctcgaatgattactaggtctaggacaggtttaaaggttaggga

SEQ ID NO: 25155 - DNA, 453 bp, Homo sapiens
  misc_feature 5, 25, 45, 76, 335, 378, 400, 418, 431: n = A,T,C or G
cgganacaattttgataccccagcngaagctggtggtctcaaggnttcgacgtcataatcagcatcaatggacagnccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggacgaggactctgggctgcttggaataggacactcaagacttttgactgccattttgtttgttcagtgggagactccctggncaacagaatccttcttgataggtttgcaggcaaaacaaatgtnatgttgcagatccccaggcagnagctctgccttctgtatnctatgtatgcagngggcctttttcttgccagcttg

SEQ ID NO: 25156 - DNA, 350 bp, Homo sapiens
  misc_feature 10, 11, 56, 324: n = A,T,C or G
aaatgacccnngtgtttaaaatttattgcattgcaaagggtagtttcactgaagtnatgcaccattaaataagatgaaatatttgtatttattgtcctacttcctaagccgtaacttcttttcctctgtgaatttgcattgagtcactcatgctacactacatcgctttagtatttgaggtggcatttatgtttcctctcgtttatcatgaaatggggcagattccatcagattccacctctgtcaggtggactcttgctgccttcatgatgagatttttttttctccttcccctttctttaagagaggctgacagatctaggngtcaatcaattggaaaccaggctctg

SEQ ID NO: 25157 - DNA, 354 bp, Homo sapiens
  misc_feature 11, 24, 38, 52, 59, 60, 68, 89, 90, 96, 346, 350: n = A,T,C or G
aaaaatcccanaagacatacactnatatgttgattgcngctacttttcacangagcttnngacatggnatcaacctagatgctcaacannagtggnctggataaagaaaatatggtacagatacaccatggacaaccattcagccataaaaaagaatgagattatgtcctttgcagcaacatggatggagttggcggccattatcctaagcaaactaacacaggaacaggaaatcaaataccacatgttctcacttacaagtgggaactaaatgctgagtacacagggacgcaaagaagggaacaatagacatcagggcctacttgagggcagagggtgggagaanggtnagga

SEQ ID NO: 25158 - DNA, 402 bp, Homo sapiens
  misc_feature 15, 24, 47, 48, 55, 65, 141, 178, 221, 232, 362: n = A,T,C or G
gactgctttacctcnttgggcatngttcctggccatcatcctcttcnnctttggnttcatttgcngtgtggccttgaggaagcgacgatgccccaactgtggagccaccttcgcttaaagggaacaccaggcccggctttnctacacccagctctctttttctaatgtaaatgttggngtacaatagttttatttgattaagcttcaaggactgttttgtnaagcgaggtgngacccgatgtggcacacgccagctgcggtttcccggagcgtggagaggcagtgctgctgctccccgcccgaggctcatgacaactcaataaagcactggtttattttttggagcttcaattgagaaaggngagaaataatggttttcaataaatgagattcataccattg

SEQ ID NO: 25159 - DNA, 311 bp, Homo sapiens
  misc_feature 13, 30, 36, 42, 45, 75, 78, 87, 89, 90, 94, 103, 112, 198,238, 266: n = A,T,C or G
ctacctcacattnaactggctgacacttgnaatacnatgcangantctttagacagaagactggcttggtggacntcntgcctgatncnnactnttactcatnacctgcagnggccagaattagggactcagaatcaaaccagtgtaaggcagtgcctggatgccattgcctggcacattgaaattggtggcttcatnctagatgtagcttgtgcagatgtagcaggaaaataggaanacctaccatctcagtgagcactagctgnctcccaaaggaggggcagccgcgcttatattttatggctacaatg

SEQ ID NO: 25160 - DNA, 101 bp, Homo sapiens
  misc_feature 3, 80: n = A,T,C or G
ccngaccaacatgggaaatcatcaaaggagctggagttagacctttccagagtggaagagaaaaggaccagagactggtnctgtatagctccaacattagt

SEQ ID NO: 25161 - DNA, 496 bp, Homo sapiens
  misc_feature 1, 8, 58, 350, 399, 401, 411: n = A,T,C or G
naaagtgnccctatcacaactcctggtgtgaggttttataatgacccagctggctatncaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgtcaagtggctgtttttttctgttttggaacaacacatttttgtaatgcttgcatgatgattttcaaagaatgactagcattcctaangaagaactaccacactgtcctgcaggtcccaaaggcaagcaggtagaangnactgaatgtncactccatgttgtcatcacccctggggaagagttgctctgggatgtggagtggcagaaatgccacacttttaaaacacgcagatc

SEQ ID NO: 25162 - DNA, 264 bp, Homo sapiens
  misc_feature 2, 10, 36, 38: n = A,T,C or G
tnacaccttnatcactatccttgatgcattcacctncnggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtcag

SEQ ID NO: 25163 - DNA, 183 bp, Homo sapiens
  misc_feature 28, 46: n = A,T,C or G
tggatttttttttaaagtcttcagcatnctaattcaccctttctancttaagaaaaacatgacttaagacactgcttctaagtttggttgttctttatagtgtggatacccagttatctgtgagcgtatgggggtgggctgagggtcaggtgaggaaggagagtgtgtgtgtgtgtgtgtgtg

SEQ ID NO: 25164 - DNA, 333 bp, Homo sapiens
  misc_feature 18, 55, 212, 254, 297, 327: n = A,T,C or G
aaaaatcccgtgtgggancagacgcgtgggcgcattgcgggcagctatgtttccngtgtcctctgggtgtttccaagagcaacaagaaacgaataaatctctgccataggagttttagccaattcagaggccttgctgcccacaatttggaaaattcctttggatttgaccaagtcaggaagagacgggagaaaagtgaaacaacaacaatnaagccccaagcataaacagacaaaaagagttaagcaaaacancaaatgcacaattcatatgattactgagtgttctaatggtaanggagaaactaaaaagcagaaattaaaagcngctgac

SEQ ID NO: 25165 - DNA, 500 bp, Homo sapiens
  misc_feature 4, 12, 432, 455, 483, 489: n = A,T,C or G
tganaaacaccntttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttggcaaggttgggacaaagccatctgggcagcagggcaaggactgttggaggagaagttagcccaagtatangctctgccagatgccatcacatncctgatctgtgatgctttgaacaccttncctganaagggaaaaag

SEQ ID NO: 25166 - DNA, 201 bp, Homo sapiens
  misc_feature 9, 57, 199: n = A,T,C or G
atgatgccntaatactttatatttttgcttataatgacaaccaccagttctttttcncttaagttaggttgagaaattttatttaatggccactgaagggccattttcaattgggaaaatttatttacatctgtggtaaactttattttgatgaaaagttgcactagtattttaccaccagatgagaaaaagatgagcntt

SEQ ID NO: 25167 - DNA, 497 bp, Homo sapiens
  misc_feature 3, 8, 30, 463: n = A,T,C or G
gcnggcgngcctagaggattctcgcagatnagtttttttctctttgaaagatagagattaatacaactacttaaaaaatatagtcaataggttactaagatattgcttagcggttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaggtgattaaaagaccttgaaatccatgacgcaggnggaattgcgtcatttaaagcctagttaacgcatt

SEQ ID NO: 25168 - DNA, 366 bp, Homo sapiens
  misc_feature 28, 358: n = A,T,C or G
aggccttctccttgagcaaggctgagantccagactgcatggaacgcttgcggctgcaaaggagactgggttgtcggacattccactggtttctggccaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcaagcccacagcacctgtgctttgctgtcaggcaggagcaggtgattcttcagaactgcacgngggaaagg

SEQ ID NO: 25169 - DNA, 437 bp, Homo sapiens
  misc_feature 5, 7, 54, 363, 426: n = A,T,C or G
tctancngcaattcacctactcactaaaatgtatatgtaaccccaaaatctgtntttgcaggagcttttacggtcatttgctgacttgcacagagcagtgctagacatgcatgtttcagctgaggttgaacaaggcagagctctgccttcttgtttcggctgtcacactgtcaacaagtgtcctttttgtggtccatttaagtgccattgtttctgcattgatgtgtttttgtggtaatggcactgtttaaaatggccgtaagtgtagggctgaagtgctgctcgtgtcctaagtacaacaatgttgtactgtgctgtactgtgctgtgtgcagaaacatgtgtgtagataagctttggtcangcacgaagtatagtgctgtgactgagtcaagtgggaatgaattatcagacagagccttatttngatatcatctt

SEQ ID NO: 25170 - DNA, 467 bp, Homo sapiens
  misc_feature 2, 12: n = A,T,C or G
gnatgaaggacngaggtcccagaagacgcctagtacaccacgaagggtcacacaaggggcttcctcacctgggcatggcatccaagagaagctccaagtggtggataaggtgactcaaaggaaagacgactcaacctggaactcagaggtcatgatgagggtccaaaaggcaagaactaaatgtgcccgaaagtccagatcgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggacgcaaagactgg

SEQ ID NO: 25171 - DNA, 343 bp, Homo sapiens
  misc_feature 9, 16, 29, 36, 51, 52, 82: n = A,T,C or G
ccgctagcnaataaantttatattagatnaaccatncttgatccatttatnngtgtattcctatttgtgagttatttatggnaagctcactttccactccctgatctgaagttcaaaaaactggtataaatgcttggaagaaactcaatgaaaacggttgttctagttcaataggatcataaccatatctgtgtttatataggccctgagaataacataatggtattcaagtatcttcagagaataatgctgggccaacaaggagtttgagattgccctacaaatgatatggcttgccaaccaacctaatgttggatgatgctatttaaacagaagtttacga

SEQ ID NO: 25172 - DNA, 411 bp, Homo sapiens
  misc_feature 2, 11, 47, 366: n = A,T,C or G
anatacgtttntttaagctatacctgccatagtgattcctctggtgngatctggacaaagtgagttgaaaaccttctggaaaggatacatcatttgagataccattaagaacattcatgattcatgggaggatgtcaaaacatcaacattagcagaagtttggaagaagttgattccagctctcatggatgacttggaaggcttcaagactttagtggaggaagtaaagtgcagatgtggtagaaatagcaagagaactagaattagaagtggagcctgaagatatgactgaattgctgcaatctcctgataaaactggaatggatgaggtgttgcttttccttaaagataagcaaagaaagtggntcttgagatggaagctatcctggtggaaatgctgtgaacattgcc

SEQ ID NO: 25173 - DNA, 443 bp, Homo sapiens
  misc_feature 5, 6, 442: n = A,T,C or G
tgccnnatggtgaaaccctgttgctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaagtacagacttaaatagctcagatagctaattaaggaaatttcaagttgccaataatagcattctctctgcatttaaaaataatttctatcaaaatacatgcataattgattttacacctcattactggng

SEQ ID NO: 25174 - DNA, 427 bp, Homo sapiens
  misc_feature 19, 23, 29, 36, 42, 43, 405: n = A,T,C or G
aaaaattccctgcctcatnagtncgcccnactgatnctgaannggagagagtctgtttagaattgattcagaaaagtgtctgtgaaagaaaaacaattattttgtcctgtttctcaaacagtgttaagcagttttgttaataggacatttttgcatcaacacttcaacattaacactttcaaagtcatggctggtgccagatttaagaaactcgaaccacctaatatttcataaccttcttcattaggtacttgtcagattaatttctaacattgcagcagtttcatatgtgtgcaatatgtgcattctttcattttagttttgcacttggttttctataaagtacgtttttactcagtcatgcgtgaacaattaaaaaacgacagaataaggacaaatgtgggnatttaataaactgtcaccaaag

SEQ ID NO: 25175 - DNA, 300 bp, Homo sapiens
  misc_feature 5, 10, 36, 37, 297, 299: n = A,T,C or G
tagcngctgnggctgcatgggttccgttcattctcnncatttctcaaatctggctctccagacttcattggcaattgtgttacgtaatacgttcagtttctgtttaattagccagtcattgttggttgtttctatctaagaaccaggtctgattcatttactcatttccctaataattttttgagtacctactatataccagacactcttttggatgggaaagaaagagcaatgattaagacagacaacgtattttctcttataaagactgtattttgtagggcaaatgaataaatnant

SEQ ID NO: 25176 - DNA, 351 bp, Homo sapiens
  misc_feature 4, 24, 31, 39, 56, 236: n = A,T,C or G
gaanggccctgtagacattcttangacagcngggatgtnacttaacattttttttnagctaaagtcagggaatcaagccatgcttaatatttaacaatcacttatatgtgtgtcggaagagtttgttttgtttgtcatgtattggtacaagcagatacagtataaactcacaaacacagatttgaaaataatgcacatatggtgttcaaatttgaacctttctcatggatttttgntggggtgggccaatatggtgtttacattatataattcctgctgggcaagtaaagcacactttttttttctcctaaaatgtttttccctgtgtatcctattatggatctggttttg

SEQ ID NO: 25177 - DNA, 487 bp, Homo sapiens
  misc_feature 10, 31, 57, 423, 444, 473: n = A,T,C or G
aaacttgccnactagtgaagaacatcaaagntgggtatttcaatgtgccaagtttgnttgaactaggttcggtttgcctctttcataacaatgtaaacacaatggtgtagttaattaaattctgggtggataggagcaggactgattactatgtcttgcccttcgccctttgtttttttcagaaccaaataacagaaatgtgtatgtgtgtactgtatctgcctttccaccacatttttatgacactgtattccactgcctgcttttttaccttctttccctaggatttgcctacagcttagtattgtggttgcagcgatctaggctgacagcacagaagcacaagagaagagtgaaggcaagaattcaaagcatttgtcatacaatgtgcacctctttgcatagttgcgtaggacctgttgnaatgctatcataaatattcgnaggttttttttttctctccaactggggcntgaccctttttttg

SEQ ID NO: 25178 - DNA, 299 bp, Homo sapiens
  misc_feature 22, 57, 59: n = A,T,C or G
acattgccgcagccagcgcagnggcttctgctgagggggcaggcaggagcttgaggntnaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggttctaaaacatgacggaggttgagatgaagcttcttcatggagtaaaaaatgtattt

SEQ ID NO: 25179 - DNA, 228 bp, Homo sapiens
  misc_feature 3, 14: n = A,T,C or G
ccntcaaaccccanaccccaactctggatgagcttggcaagtgatttatttagattctccgtgcctcagtttcaaggtttcctcttctgtaaaataaaaatattcccaactggccaggcatggtggctcacacctataatcccagcattttgggaggccaaggcggcagatcacttgaggtcaggagttcaaaaccagcctggtcaacatggtgaaacctcatctctc

SEQ ID NO: 25180 - DNA, 315 bp, Homo sapiens
  misc_feature 5, 6, 273: n = A,T,C or G
gaccnngtggactagcccccaactaggaaccccccaagagttgcctctttagagcaaaaaacacttatattatgcaggaaattccaagtaggagctctgtgccaggaaccaggggcagagatcaaatatatgtttcttatcatatcacaatatcacagtgaccaagtaattttctggatggatcaaagtcttaagacctgaagtggtaatcttgaatcagtagtaactcaggcaaacctgtgactgagtggcataaagtgtaaatatttttgnaagggaaatttaaataagattctaattattataatagccaag

SEQ ID NO: 25181 - DNA, 119 bp, Homo sapiens
  misc_feature 23: n = A,T,C or G
accacaccttaccacgagccatngataatgcaaaggaaaagaggactgtagtggtttgtctgtgatggctggaagttcctctgtaccagttgctgtggttggctgataaatatttgtcg

SEQ ID NO: 25182 - DNA, 189 bp, Homo sapiens
  misc_feature 46: n = A,T,C or G
gtggaggcccatgcatcccgcgcagatgacaccatcaaccgccagngtcccagacaccggttttcctagaagcccctcacccccactggcccactggtggctaggtctccccttatccttctggtccagcgcaaggaggggctgcttctgaggtcggtggctgtctttccattaaagaaacaccgtgca

SEQ ID NO: 25183 - DNA, 498 bp, Homo sapiens
  misc_feature 27: n = A,T,C or G
aaataagccgatgagagtttagttatntgtatgagtgtaaaagaggccacatctgttaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcaagtttcctctacggatgagagactgctcaagaatatcctcatgcagctttatgaagccaactctgaacacgctggttatctaaatgagaagcagagaaataaagcaagaaaattacctggatgaaaagaggcttttggctggggccatcccattgccttctcttaagggactttaagaaaaactaccacatgtatgtgtatcctgtgca

SEQ ID NO: 25184 - DNA, 491 bp, Homo sapiens
  misc_feature 9, 10: n = A,T,C or G
cttgagganncccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagactaaaatgaaggtgacttaaacagcttaaagtttagtttaaaagttgtaggtgattaaaataatttgaaggcgatcttttaaaaagagattaaaccgaaggggattaaaaagccttgaaatccatgacgcagggagaattgcgtcatttaaagcctagttaacgcatttact

SEQ ID NO: 25185 - DNA, 307 bp, Homo sapiens
gatgaaccctctaaagaaaatttatgaagatggagacgatgatatgaagcgaacctttaataaagcctgggtggaatcaagagagaagcaagccaaaggagacacggaattttgagactttaaagtcgttttgggaactgtgatgtgatgtggaaatactgatgtttccagtaagggaatattgggtgagctgcatatataaatttgacagatagctatttacatagccttctaagtaaaggcaatgaattctccatttcctactggaggatttatttaaataaaatatgcttattaaacactcctg

SEQ ID NO: 25186 - DNA, 463 bp, Homo sapiens
  misc_feature 6, 11, 31, 47, 48, 49, 429: n = A,T,C or G
aagaancatgnaaaagagcagtagaatgtgngtagtgctcattaagnnngtataaaacattcatttcaattgccaaaccagcagataaaccatccttttatgtttttctccatattctgcaacacgcgttagagtgttatgtatttggagacaagggagtgtattttttcatctttgtatatccagttcctcatatggttctttgttaactgtcaaatgaaatattgtatatatttatggtagtatacaacatgatgttttaatatatgtagatattatggaaggattgaatcaagctaattaacatacccatcacttcacatacttaaccaatttttgtgataagaaaatttaaaatctgcctcttagcagttttcaagtatagttggcccccacatttgcagattctgcatcaagcagattcagttnaccacggataaaaaatactcaagaaaaacccagc

SEQ ID NO: 25187 - DNA, 499 bp, Homo sapiens
  misc_feature 18, 35, 70, 412: n = A,T,C or G
gcttctgctgagggggcnggctggagcttgaggtntccgcagataagtttttttctctttgaaagatagnagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgatggaggttgagatgaagcttcttcatggagtaaaaaatgtatttaaaagaaaattgagagaaaggactacagagccccgaattaataccaatagaagggcaatgcttttagattaaaatggaggtgacttaaacagcttaaagttagtttaaaagtgtaggtgattaaaataatttgangcgatcttttaaaaagagattaaaccgaggtgattaaaagaccttgaaatccatgacgcagggagaattgcgcattaaagcctagtt

SEQ ID NO: 25188 - DNA, 340 bp, Homo sapiens
  misc_feature 4, 5, 74, 105, 114: n = A,T,C or G
gtanngagaccctgtctctatttattaaaacatattaataaacaaaacaaaaaaaaaagatggctgggcacagnggcccacgactgtaatcctaacattttgggnggcccaggngggtggatcccttgaggtcaggagttcgagaccagcctggccaacaaggtgaaacctcatctctactaaaaatacaaaattagctgggtgtggtggcatatgcctgtaaccgcagctactcaggaggctgaggcaggagaattgcttgaacccagaggcagaggttgcagtgagctgagatcacaccactgcactccagcccgggcaacagagcgagactgtctca

SEQ ID NO: 25189 - DNA, 392 bp, Homo sapiens
  misc_feature 2: n = A,T,C or G
gnataaaaaaccctctaaaccatggcacttgatgtgatgtggcaaggagggcacgtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgtttgtttgtttgcagtctctctctgccatgccttgcaaggctgctggaaggcagcttgtggagccgttggttccgccactcattccttctcgtgcactgctttctccttcacagctaagatgccatgtgcaggtggattccatgccgcagacatgaaataaaagctttgcaaaggcac

SEQ ID NO: 25190 - DNA, 498 bp, Homo sapiens
  misc_feature 2, 56, 57, 325, 417, 448, 468: n = A,T,C or G
tnatatgcctataacattctttccttgaagtgtcaggaagttcttttaatttcccnnatttaatttctaaaagtttgaatggtcatcttatggttgtcatgacttatttatatagttctgttcgtggtatcttgtattgactttttttgtggttagggccagaaatgtttttgcagcttattaaatagagttataaaagcagaatctcaagctagaccttttaatcttatactttataggatctttccccaggttgtgctgattcttttaagataataatgtctgtcttattgtgaaaatggacatctcattaaggtaaattggnaaggcccagaaaacatatagaagaaaatgaaaataagttttctattataaaaagaaaaataaatattttggcatatacctgtttttctgggnatatataaaaatctaaaataacacatatgcncttaaaaaggcttactgtgngctggtatggaacctatcctggaaaaaaag

SEQ ID NO: 25191 - DNA, 164 bp, Homo sapiens
  misc_feature 43: n = A,T,C or G
gctgtttagaaacctcaacacacccaatgcgtatcctaaattntggaaactacttagaaaagtaaggcactctcaaaaatgtgttgaacttgcagtacccattacaacagtccttttattgataagaaacgcatgtttaaggatttgaaaatgaagaaggaaga

SEQ ID NO: 25192 - DNA, 498 bp, Homo sapiens
  misc_feature 3, 57: n = A,T,C or G
atnataacccggattacttcttaaggttttgattaagttgatctagcctcaacttanattgtaatacatctgcctaattattgtctggaataacttttcaaccatccaatgcccactgctctcacaatgattattgtagagaagaaaaatggtaattattcaagtaaagtcacataatttctggagtcagtttttcataacaagtttatggaatacatcatcattggcttcttcataatatatttattatgagtgaccaaattttgcctggaggagcagaatgctcaaaacttgttattataggttaatttccagctcactgttgacactgaaagattctgtgttactttaaacccaggataaaaggctggaaaaaaaattaaatgtaagtcataaactagtagtcagcttttcctagttctaaggcttattaacatttgcaaattactcaataaatgctttcataatggaataacataaaagcttttgatttggcag

SEQ ID NO: 25193 - DNA, 322 bp, Homo sapiens
  misc_feature 2, 152, 201, 210, 225, 299: n = A,T,C or G
gncacaaaaccccttatttctgcagtggcatagaatctgttaaaatttaattagaatcacaaatttatctcaagaagctttttaacagttggtgaaatgtgcttgccaacaaagcatcctaacagggtcgttcccatacacatttgacctgntcagccttttccaggtgaatagccccagttctgacataaagaaagtttnatttgtatnttactactgtttggncaattttgatatataactggttacaaacagagccttactatttattagtggggaaatgattttaagaccgactnttcagtatttaattctgcagatc

SEQ ID NO: 25194 - DNA, 500 bp, Homo sapiens
  misc_feature 3, 8, 58, 59: n = A,T,C or G
ganattgnccagccagcgcaggggcttctgctagagggggcaggcggagcttgaggannccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaatccaatagaagggcaatgcttttagattaaaatgaaggtgacttaaacagcttaaagtttaagtttaaaagttgtagggtgattaaaataattgaaggcgatcttttaaaaagagattaaaccgaaggtgattaaaagccttgaaatccatgacgcaggg

SEQ ID NO: 25195 - DNA, 399 bp, Homo sapiens
  misc_feature 2, 59: n = A,T,C or G
gnttgtacacccatcagaggagagatggtgttgggagccctttggagaacgccagtctnccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggagaatagtttaggagaaaccagcttttactgtttttgaaaaattacagcttcaccctgtcaagttaacaaggaatgcctgtccaataaaaggttctccaacttg

SEQ ID NO: 25196 - DNA, 461 bp, Homo sapiens
  misc_feature 4, 16, 27, 37, 39: n = A,T,C or G
cctngcgctatagatntagtaccgcangggaaagatntnaaattataaccaagcataatatagcaaggactaacccctataccttctgcataatgaattaactagaaataactttgcaaggagagccaaagctaagacccccgaaaccagacgaactacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactac

SEQ ID NO: 25197 - DNA, 500 bp, Homo sapiens
  misc_feature 4, 13, 454: n = A,T,C or G
aaancccgtaganggactgactactttgcgcaatgggacattaagttgcattccgtggtcattatttctggatgctaagtccattcagtccaccatctccagctcgcagaattactgaagtttggggtattccttcccccattgatactgtttttactaggtgcaactgtgaaggaaaaactttcttctttaaggattctcaagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaacgacacaggntaggagacgtcgctttgaacgtgctataggaccttctcaaacacac

SEQ ID NO: 25198 - DNA, 122 bp, Homo sapiens
ttgctccaaaagctcagatgggtcaaaaagctccagcccagaaagcacctgctccaaaggcatctggcaagaaagcataagtggcaatcataaaaagtaataaaggttctttttgacctgtt

SEQ ID NO: 25199 - DNA, 466 bp, Homo sapiens
  misc_feature 8, 24, 48, 49, 59, 61, 79, 330, 436, 455: n = A,T,C or G
agaggtgnagaaaatgctgagctngcgcagagggaaaccgtgcctttnnataagagaantnactacatccgtccttggnggaggaaaagaaaaacataaaaagaaacgcctagtacaaagtccaaattcttactttatggatgtaaaatgtcaggttgctacaaagatcaccacggttttcagccatgctcagacagtggtctttgtgtaggttgtcaacagtgttgtgccagcctacaggaggaagggccagactcacagaagggtgttcatttagaagaaagcaacactaatgattcaaacagcttctgaattttaattttgtggtgnctcacagaaagccttatcataaattccataattctaattaatttaccaagataatgtaattacatttgggtttgtaaaggtatcagcagtaatctcctattttggnggcagtttttcaataaagntttgattatgg

SEQ ID NO: 25200 - DNA, 499 bp, Homo sapiens
  misc_feature 14, 46, 61, 62, 109, 154, 250, 254, 405: n = A,T,C or G
tgtcagcgtagggncttctgctgagggggcaggcggagcttgaggnttccgcagataagtnnttttctctttgaaagatagagattaatacaactacttaaaaaatctngtcaataggttactaagatattgcttagcgttaagtttttaacgnaattttaatagcttaagattttaagagaaaatatgaagacttagaagaagtagcatgaggaaggaaaagataaaaggtttctaaaacatgacggangttngagatgaagctcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgnaggtgattaaaataatttggaaggcgatcttttaaaaagagattaacccgaggtgattaaaagaccttgaaatccatgacgcaggggagaattg

SEQ ID NO: 25201 - DNA, 192 bp, Homo sapiens
acaaagcttggtgaacatgatgaagcctcgtttatactacaaatactaaaaattagctaggcatggtggcagggtgccttggattcccagcaacttaaggccagagaatcacttgaacccgggaggtgaaggttgcagtgagccaagatcacaccattgcaccccagcctggcaacaagagcaaaaccccat

SEQ ID NO: 25202 - DNA, 498 bp, Homo sapiens
  misc_feature 2, 60: n = A,T,C or G
gntagagattccacaactacttaaaaaatatagtcaataggttactaagatattgctttncgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaaggcaatgcttttagattaaaatgaaggtgacttaaacagcttaaagtttagtttaaaagttgtaggtgattaaaataatttgaaggccgatcttttaaaaagagattaaaccgaaggtgattaaaagccttgaaatccatgacgcagggagaattgcgtcatttaaagcctagttacgcatttactaaacgcagacgaaaatggaaaggattaattgggagtggtaggatgaaac

SEQ ID NO: 25203 - DNA, 500 bp, Homo sapiens
  misc_feature 8, 22, 27, 44: n = A,T,C or G
gaatactnaggtgtgcttaggngtgcnaaagggaaggagacctnaattcaccaagttaaatcttgctaaaccttatcataagcattttttgagcgcttagcatacaccaagccttgtggaaggtgctttcctgccatatctcatttaatcctcacagcaaacctatagaatatggcattatcatctgagtctcacagaagtttagtcgtgtactcaaggtcttaccagctagtgaacagcagaccaagactggaaacccaggatagtctgatacctgagccatctcttcttgtgctacgcctagttattctgtccccaaatcaaaaggcatgacctttataagaggcgctttactgacaatagctgcaattttaactttgaaaatgattcagaattatcaaagatagtaagattcgaatgacatgattgctataatctcgctagccttgacctgtgtgtgcatagcaattacagggaagtaatctagctcctgactatta

SEQ ID NO: 25204 - DNA, 125 bp, Homo sapiens
  misc_feature 20, 94: n = A,T,C or G
tctggaattagacctacatnctaacctggctctgatatgcttaagccctgctaccttggggaggtgtgcacttcaccgattttagctacagctntcctctccttatatactgggcatttaatgac

SEQ ID NO: 25205 - DNA, 436 bp, Homo sapiens
  misc_feature 2, 14, 60: n = A,T,C or G
gnttacaagtcccnaagtaaaataagtgttggagtaacacttgcataaaagaatttaagnagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgctgagaaagtgaaagattgtgtatttctattaaaacatttacaatct

SEQ ID NO: 25206 - DNA, 463 bp, Homo sapiens
  misc_feature 58: n = A,T,C or G
gcaaaaaatccctaaagtctatgagatacttaggtagtgagtacagtatgagaagtgnttccctgtggatacaatagcaaaagttttctataagtgttgaagtctgtcctggattttgaaagattagtagttttggaaggtggaatggccctggaaggtagatacactttcggagttctttattaaacacaaaggaaacaccaacagtgatgtccacttagagaggaaaactgcctgttccttaacaaattaaacaaatttgttaattcaacaaataacctttgtaacagtagggatttttaaacttgtaaagttttaaaagttttaaattttgaaaacttcaaaaataattttattcagggctgttttatttgtacttcataagttgcatttctgctcaaactttttttactactgtggttactaccctcttactggtctgagtttctttgctgcattcatc

SEQ ID NO: 25207 - DNA, 282 bp, Homo sapiens
  misc_feature 1, 4, 45, 57: n = A,T,C or G
naanagttccacagttgtgttcttttctggagcagtactcagcancctgcatgtagnaatgtagaaggtaagtggttggattgatcctagttctgctattatatagagaaaaccaaggctgaggtcattttagtgacttcacaaatgtagagaagtcagctgggcagggtaactcaccctgtaatccaagcactttgggaggctgaggcggaaggattgcttgagcccagcagttcgagaccagtctgagcaacatagtgagactctgtctctactgaaaat

SEQ ID NO: 25208 - DNA, 443 bp, Homo sapiens
  misc_feature 4, 13, 29, 328, 361, 364, 374, 396: n = A,T,C or G
cccngaagaggcncatataatgaataaantgggaaatttaactacaggttgaggaataattaaaaagttaagaaaatactttgaacagctttataccagtgcatttgaaagctttaacgaatttaaattcctagaaaaatataactcaccagactaactcaagaagaaatagaaagcctgaataattttttaaccattaaataaattatttaaaatctacctattaaaaaaaaaagcccaggcctaaataatgctatggccaacttccagcaaacgttccagggacaagatcatttcaatgttaaattatgccagggagataaaatgngtgatttcttcacaggtcatttttttaagaccnctnttaccttggnaaccaaaccaggcaagggtggngccagaaaaaaaattaccagccagtctctctcatggacccaggatgc

SEQ ID NO: 25209 - DNA, 498 bp, Homo sapiens
  misc_feature 1, 7, 29, 50, 418, 461: n = A,T,C or G
nccgagnattttcagcaccataatatttntgtaccagggagattatagtnttctaatttttttagggaaaaattgcttagctctagggatttctaaactttgaacaataaaagttaattttagaaatactttcagggtcatcattaagctttagcgtggctttgttactgccctgttaagtagttttgttggttagtatggacagtacagcaaacccattatgattcctttacagtgagaaaaatatgaaatagtccagaaagaataagatattaagtaacctttgcctgaaggtctgtgaactccttaagcgtttgaatgtaaatacttctccccaccccgaataagccgtattcttctgggaaaaggcaatgaaaaaagaaatgaactttcttctcagaccttggaaagttttagngcatagtataatttttttcatatgatagactgagctttatgcnccccaggtggactgggtgggtatggatcaggagacag

SEQ ID NO: 25210 - DNA, 299 bp, Homo sapiens
  misc_feature 2, 5: n = A,T,C or G
gngancaacctggagttatgcagccacaagccatggaatgcctagagcaaacagaatctggaagagtcgagaaagaattctcccctacgtacttggagagagtctggtcctgccaacaacttgatttggggcttctggtcaccaaaagtatgtgagaataaatttttgttgttttgaactaccaaatctgtggtcatctgtgacagcatccacaggaaactaacacctcccctccaaaggattgttactaattgcaagaaaacagtttacatcagcctgggctgacccaggcctgctgg

SEQ ID NO: 25211 - DNA, 303 bp, Homo sapiens
taattacaggtctttgtatttaaatcgatcagccataatgattactgcttttatgaagatttatgccaaaggtagctcccttactgtgggacataaaagttgcttgttttcagctttgaccagtgatgaactgataaccctggtaggaaaatgaaacattggggctgggcttgtaatacgctttcttaaaagaatgccccattgaaattagagtggcacggtgccaccagaccaagggttctcatcccgatgccacagagggccacaggtgttatgaaagtggtttgcaaaattgaatgtatg

SEQ ID NO: 25212 - DNA, 252 bp, Homo sapiens
  misc_feature 4, 8: n = A,T,C or G
taanagtnccgactaggagtcctaagaaatgttctgttcttgtacattatactgatttagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagc

SEQ ID NO: 25213 - DNA, 345 bp, Homo sapiens
  misc_feature 1, 53, 55, 335: n = A,T,C or G
naaactcccgcaaagggaacgtcatcgttggaaagcgtcgaataagacgcacncnttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggnttttaaaaat

SEQ ID NO: 25214 - DNA, 317 bp, Homo sapiens
  misc_feature 4: n = A,T,C or G
cagnagtgatgttgcaatatctggaactagcaaaggatactgatgagaaaacgtggaatcatgtgggatgtgacctcctaggactcaccttgcacagctgggtgcagcagggataggtaaggatttggggtttagaggtacaattgcctttttatggttagagaaaggtcctggggctggagggagcctgacgatctgctctgtgtgcaaggggagagttaactctgcacgcaagagcctgcttaaagggctgtgtcagttctattgtaaacaccaacttaaagtggtggatgctggcagacattgttattgccatt

SEQ ID NO: 25215 - DNA, 361 bp, Homo sapiens
  misc_feature 1, 12, 58: n = A,T,C or G
nataaggccccnacaccagtaaagcttctcttctctggaaaaagtttaggtctctgangttttctcagtgcatcataactgacagcagcaggaatgtggttttgctaaaggcaacagaaaagcaaaactgtctcaagatttaaatattaatccaaaggttgaactttttaccttaatgttgctgctttctgtatgcacatcccacaggatgtaggaaggtggaaaggatgaaggaatgtggaaaatgtagaaaattagaaaataaggtaaatttaaaaggtaatacgactaacattcattcattcacattaagctcctaccttgtccacattgtattgtagacactgcggatatagcagtg

SEQ ID NO: 25216 - DNA, 161 bp, Homo sapiens
  misc_feature 7: n = A,T,C or G
taatgangcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcaga

SEQ ID NO: 25217 - DNA, 497 bp, Homo sapiens
  misc_feature 44, 45, 46, 460: n = A,T,C or G
ccagcgcaggggcttctgctgagggggcaggcggagcttgaggnnnccgcagataagtttttttctctttgaaagatagagattaatacaactacttaaaaaatatagtcaataggctactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaccgaaggtgattnaaaagccttgaaatccatgacgcagggagaattgcgt

SEQ ID NO: 25218 - DNA, 476 bp, Homo sapiens
  misc_feature 8, 14, 29, 30, 334, 470: n = A,T,C or G
tatggcangaacangccgccttacgaatnncggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgctaacttccatggcatggatcttacccgtgcaaaatgtgttccatggncaaaaaatggcaaacaatgattgaagctcacgttgatgtcaagactaccgatgggtacttgcttcgctgtctgggttggtttactaaaaacgcacaatcagatacggaagactttatctcagcaccacagtccgcnaatccg

SEQ ID NO: 25219 - DNA, 495 bp, Homo sapiens
  misc_feature 1, 10, 57, 419, 436, 459, 473, 495: n = A,T,C or G
naaagaaccngttcctccaagacctattctgaaacagaaatgttctagcctagagantctaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccacgcttctcaaagaattgctttcttggaaagttttgagcccagaagactattcaacctgtttttctagcagaaattttctaaatgaagcagtggactatgttattcgccacttgattcaagaaaataacngagtaaaggccagaatntttctgcatgttttgagtgagcntaaagaagtggagnccaaattagccgcctggatccn

SEQ ID NO: 25220 - DNA, 427 bp, Homo sapiens
  misc_feature 3, 13, 43: n = A,T,C or G
ganactgcttatncagctttggaggaaaccagctcaacaattnaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgatgatgaatcaagtagtgatgaaaccagtaatcagcccagtcctgcctttagacgacgccgtgctaggaagaagaccggttctgcttcagaatctgaagaccggctagttggtgacaagaaactgaacctctaaggagttgagtaaaccgcagtcagta

SEQ ID NO: 25221 - DNA, 497 bp, Homo sapiens
  misc_feature 2, 56, 462: n = A,T,C or G
antgtcccataagatattcgctctggagaagttacatgtaaatagaattctatatnttgttttccagttgaccgagtatctgttgtgtttttgtttaaaaagaggattccatgacataataaaaattattttaaaaaagtgctgggattgcaggcttgagccaccacactcagccttattcttatattttaatttggtcattcttagatctacagattgaacatccctaattgaaaactttttgagtactaacatagtgttcaaaggaaatgcttattggagcatttagaatttcagattttcagattaggggatgctgactggtgtaatgcccagtattccaaaatccaaaataatttgaaatctgaaacacttaatggtcccagcatgttgggataagggatactcaacctgtattgatttttctccactataattcaggtctataagttcttccctatnaaaaatgaatgaattaggaaattgataataaacat

SEQ ID NO: 25222 - DNA, 149 bp, Homo sapiens
  misc_feature 41: n = A,T,C or G
attgtattcaaacggtgttgcaactcacaagtaaaggaatngtctgagcaagaaggtgctaagaatgatgtgaaagattctgacacgtgtgtatcagagagcaatgataattcaagaacaacagctacagtttcacaaaaggaagttga

SEQ ID NO: 25223 - DNA, 189 bp, Homo sapiens
  misc_feature 18, 47, 57, 60: n = A,T,C or G
tatattagatgacagtanagaatgtattaatcttgttagatgtgatnttaacagggnggntatgttaaaaaacaaaaaacaaaaaacaagatgaccttatcagttagagacatctaattgaagaatttatagaagaaatgacattatgtataagatttgactttaaatactccagcaaaagaaatatgg

SEQ ID NO: 25224 - DNA, 213 bp, Homo sapiens
  misc_feature 20: n = A,T,C or G
acaccccgacttaagcctgngtgacagagtgaaaccttgtctcaaaaataaattcataaataaaaaaagttagctaggtgtggtgggcacatgcctgtagtcccagctgctcaggaggcaggaggctgtgcaggagtgttgcttgagcccaggagtttgaggtgcagtgcctgtgattgtgccatgcactccagcctggtagacctggctcgc

SEQ ID NO: 25225 - DNA, 497 bp, Homo sapiens
  misc_feature 10, 57, 58, 478, 479: n = A,T,C or G
aacaaagccnggaggtcttgtaccaatttctgccctatggtagatagtgaggcttcnnacctataatctaagcatagtatatcagttagttagaatacaattaactaaagacatcgctagctaatagtgaggcttcccacctataatctaagcataatatgttaatttagctaatgcaattaactaaagacatcgctagctaataaacatgtaaaagcaataacattacgtgtatttagcattttagagtttggaagtaatttctcacaagtcttagtaccccaactttggaagggaggcactattaccttcattttataaataaggatgaagatgcctggggaggcaagaattacttggctataaagtcaaagctgggaatggactcaagtcttttgtgagttgtaagcagggctgtgtggtcaaacacagctacaggttagttatgatttcaacacttactggttgagtaccttgnnaggcaagtcacttttctg

SEQ ID NO: 25226 - DNA, 430 bp, Homo sapiens
  misc_feature 1, 57, 59, 367: n = A,T,C or G
ntattccgccgacgttgtctgcaggcactcagaatggtccagcgtttgacataccgncntaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttccgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcncagagtcagaaagctaaataaaaaaatgaaacttttttgagtaataaaaatgaaaagacgctg

SEQ ID NO: 25227 - DNA, 275 bp, Homo sapiens
  misc_feature 2, 6: n = A,T,C or G
gntagngtgccccttttggagggggaagtttatttttatatttaaagaaacaaagactttcagttcaagggggagaagaaatgaaacaaagtttgcagtgggctttgaaaacttggactgcattatgcaaaaagcacagctgtaataccagggccaggaaaaaagaccaaactcctgaaatatttgtgctgctcgccttcactgtgctaatgattctagcagtttaaaaatggacttcttgtttatcagcagccactgccaaattaatagtttac

SEQ ID NO: 25228 - DNA, 233 bp, Homo sapiens
  misc_feature 1, 10, 58: n = A,T,C or G
nataagaccnaatacgaactgaaagttaaaatgctggcaagatgaagttaaaaggtanagtttttatcagtttttctctttgtttgtttgtttttgcaatcatagttaagttgtcatcagtttaaaatagtggattatatgatgttacttgcaagcctcatgagaaccacaaatcaaaaagcctaccacagatagacaaaaaataaaaagcaagaaattaaaacatatcacca

SEQ ID NO: 25229 - DNA, 380 bp, Homo sapiens
  misc_feature 1, 56, 355, 373, 380: n = A,T,C or G
naaaagcccacattcttaagttattcttaagttattcctttacattcttaatgttntcctttacattcttaagttattaagttattgaggatcccaaagagtttttgtttatgtgaattatagctatcgatatttagtcagaaattaaaactgagtaattgctaaaatattgttgtaaaataagacacaaatacaaatgtatttcagtagaagcacaaggaaaacgtttaaggatttaaaatgactgtattggacaataatgaggttatagatacacagacatcaccgcaaatagaaccaacgatagcacagtcaaggaactgagagctaattgagttaatctcaaaactcttgngtttatttaaactcttgnatttatn

SEQ ID NO: 25230 - DNA, 202 bp, Homo sapiens
  misc_feature 6, 28, 117, 162: n = A,T,C or G
gcgttncctgcacaaaatgcccggctgnagctgcagaaaccgtccctgtttcagagcaggagttgccagcagccccaggctgagacagggtctggaacagaatctgacagtgatgantcagtaccagagcttgaagaacaggattccacccaggcaaccacncaacaagcccagctggcggcagcagctgaaattgatgaag

SEQ ID NO: 25231 - DNA, 497 bp, Homo sapiens
  misc_feature 8, 58: n = A,T,C or G
acaaaggnccatttgtaaagaagctccttccagcacctcctctcttctccttttgccntaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaaccgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgccaaaagacgttttctttggccaaagatctctttcgtgattccttgcaacaatcaatgagaatcttcatgtattctggagaacaccattcctgatttccacaaactgcactacatcagta

SEQ ID NO: 25232 - DNA, 390 bp, Homo sapiens
  misc_feature 3: n = A,T,C or G
cangaagacccgtgacatctccctgcaattcttcttgcctttctcacttggcaaggattatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactgccctgccgactgaccattgctccaatttgtctataaggattgcagcctataaatcgattctacaggagagagttaaaaagacttggcagttgtggatgcaaaaacccc

SEQ ID NO: 25233 - DNA, 470 bp, Homo sapiens
  misc_feature 4, 59, 408: n = A,T,C or G
aaangtggcccctcagctatatcactgcccaacatcagaaaacctgacggctatgattnctatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttggtattgtttacagaccatttaattaatatttcctctggttattcctcctctcctccattnatggctcacacctgttaaaggaaaaaagaatcaaattgaatatatcttttaagaattcaaac

SEQ ID NO: 25234 - DNA, 496 bp, Homo sapiens
  misc_feature 394, 405, 448, 474, 487: n = A,T,C or G
aattcacccaaaaccttaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttaagagaatgatttccacctttatgttttaatatcctangcatctgctgnaataatattttaagaaaatggttggaatttaagaaatacttgngtactaatttgtatacccatatctgngccatggaatatnaatatcaca

SEQ ID NO: 25235 - DNA, 498 bp, Homo sapiens
  misc_feature 5, 25, 60, 418, 456: n = A,T,C or G
aaaancttcctgataaaaacccgantaacccaaatgcacatggcgattttttaaaaattnatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgtcacattgccatgatttagctcccacatggagagactttgctaaagaagtggatgggttacttcgaattggagctgttactgtggtgatgatagaatgctttgccgaatgaaaggagcaacagctntccagtctcttcatttttcggctggaatggcccagtgnaatatcatggagacagatcaaaggagagttagtgagtttgca

SEQ ID NO: 25236 - DNA, 270 bp, Homo sapiens
  misc_feature 55: n = A,T,C or G
aaagtgcccacgcctgtaatcccagcactttgggaggccggggtgggtggattgntaggtcaggagttcgagaacagcctggccaacgtggtgaaaccccttctctgttaaaaatacaaaaattacctgggtatgctggcatatgcctgtaattctagctactcagggaggctgaggcaggagaatcgcttgaacccaggaaacggaggttgcaagtgagccgagatcacaccactgcactccagcctgggtgacagagggagactctgt

SEQ ID NO: 25237 - DNA, 498 bp, Homo sapiens
  misc_feature 6, 11, 26, 61: n = A,T,C or G
ctcccnaactncaaactccaaactanttgaagtaaatccaaagagtgaagttgcaggtggngctagaaggagaaacacctcatatgcttctcaggccccatgtgttcatgcctgaagttactcccgacatggattacttaccgagagtacccagtcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccggctcgcagaattactgaagtttggggtattccttcccccattgatactgttttactaggtgcaactgtgaaggaaaaactttcttctttaaaggatctcaagtactggcggtttaccaatgatataaaagatgcagggtccccaaaccaatttcaaaggattgggaggactaactggacaaataggtgca

SEQ ID NO: 25238 - DNA, 498 bp, Homo sapiens
  misc_feature 5, 13, 30, 44, 73, 91, 104, 110, 119, 142, 167, 173, 222,230, 264, 441, 461, 469, 491: n = A,T,C or G
aacgngcactgtntattgagtgataaaatntgctactatggatnaatgcatagaacagtgcctgctacatagnacgatctgtgatttatantattattagtaanactgcntgccatgcnctatgcttgaattctcaaaatanccctatgaggtagattattgttatnatcccngttctaccttcgaagacattaagacataatgagggtaaatagttcttgngtcatgtngtaagtgaaatctgcgatttgggacccttttggnacttgctactgctaactacatatccccagcttcaagggggcagagatggagaaagccttggtattgggtaaacattagtaatgtccacatatactcctaccacaaggggatgaaattggcctgtgcactgtacctttctagtcctgggtatcacagatgctacaattttaaattggngaaaaataggatttcaatgnaaattggnaattattaataataagggtatncatgtat

SEQ ID NO: 25239 - DNA, 498 bp, Homo sapiens
  misc_feature 2, 3, 58, 329, 401, 423, 456, 471: n = A,T,C or G
gnnaagaacccctgcaatgaaaaggaaggggctcagttcagcagtcatcttatcaatnttctgaaccctaaaggaaagccagcaaaccagctgcttgctctcaggactttttgcaattgttttgttggccaggcaggacaaaaactcatgatgtcccagagggaatcactgatgtcccatgcaatagaactgaaatcagggagcaataagaacattcacattgctctggctacattggccctgaactattctgtttgttttcataaagaccataacattgaagggaaagcccaatgtttgtcactaattagcacaatcttggaagtagnacaagacctagaagccacttttagacttcttgtggctcttggaacacttatcagtgatgattcaaatgctgnacaattagccaagtctttaggnggttgattctcaaataaaaaagtattcctcagnatcaagaaccagctnaagtaagtgaatgccggtagatttatc

SEQ ID NO: 25240 - DNA, 427 bp, Homo sapiens
  misc_feature 8, 11, 58: n = A,T,C or G
gaactttnccnaatctgagaaaaacaagcaatggggaaaggattccctatttaataantggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaagacttcatgtccaaaacaccaaaagcaatggcaacaaaagacaaaattgacaaatggaatctaattaaactaaagagcttctgcacagcaaaagaaactaccatcagagtcaacaggcacctacaaaattggagaaaatttttgcacctactcatctgacaaagggctaatcccagaatctacaatgactcaaac

SEQ ID NO: 25241 - DNA, 499 bp, Homo sapiens
  misc_feature 4, 28, 33, 46, 384, 454, 477, 488: n = A,T,C or G
tatngcaggtctttatttcttatgtaanacagnaggtaacttttcntaggtttcactctttttagtgtactagatccagaaacttagtgtaatgccctgctttatatttctttgacttaacattggtttcagaaagaatcttagctacctagaatttacagtctctgtttcatggcaacactggataatggctttgtgaaatttaaaaaatttttgtagcgactgtaaacagaaatgccaaattgatggttaattgttgctgcttcaaaaataagtataaaattaatatgtaaggaagcccattctttcatgttaaatacttggggtgggaggggagaaagggaccctttcttaaaatgaaaataattactgctattttaaaanttcttgacattgaatgtgagaccctctacatgatttgagaagctgaccaagtataggcagaggtattttnccggttacatttttttttggttnggggaaaaatnggagggggcta

SEQ ID NO: 25242 - DNA, 418 bp, Homo sapiens
  misc_feature 3, 5, 355: n = A,T,C or G
ctntntgattcttcagaggctcttcaggttctcctctgtcattcggtcagccgtctcagtccatttgcggaggaacattggtgttacagcagtggcatttaataaggaacttgatcctatacagaaactctttgtggcaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggnaatttgcacggattagttgtcaactagttagaagtttcagaataaacatgcatttcataactg

SEQ ID NO: 25243 - DNA, 497 bp, Homo sapiens
  misc_feature 58: n = A,T,C or G
atatgccaccatctacaaatcattgattataaaaatcaaagatctacataaatggtanttcatggagtgctcatggattggaagataccgatgatttctaagtaagaataaagtctttgaaaatagtttcaatgcaattcaaatcaaaaccccagcagacttttttcttctttttcttttttgagacagagtctggctctattgcccaggctggagtgcatgacccaaacataattcactgcagacccgacttccagggttcgggtgatcctcctgccttaagccttaatttttttcttatagatgtcagtaagcttattctaaagtttatgtgcaaagatgaaagaactagagtttcaaaattaattttgaagaaaaacaaagtttgactactcactacccaatatcaaaatttaatataaaactacagtaatcaaggcaatccagtgtaaggtaatgattacatacacattaattgaacaaaatagagagctcag

SEQ ID NO: 25244 - DNA, 471 bp, Homo sapiens
  misc_feature 60, 460: n = A,T,C or G
taaagaaacccttttgtgtttctctatatttttacgttgtctgcaataaataggaaagancctaatttatttatttacttatttatatttttcgagatggagtctcactctgtaacccatgctggagtgcaaagacacaatctcaattcactgcaacctctgcctcctgggttcaagcgattctcctgcctctgctttctaagtagctggaattacaggggcgcaccaccaggcccggctaattttttttgtatttttagtagagacggagtatcaccatgttggcccagctggtctcgaactccttacgagtgatctgcctgctcagccttccaaagtgctgggattacaggcgtgagccactgcgcccagcccatgaattcaatctaaacaaataaaaaccttaaatccctcaaaatctacttccttacattgaattgtctgagaagaaaatgcaggntcttgttactg

SEQ ID NO: 25245 - DNA, 456 bp, Homo sapiens
  misc_feature 11, 12, 431: n = A,T,C or G
aaggagctccnntatgaggacgcaaaggcatgagaatgatacaatggactttggggactctggggaaaggacgggaggcgggtgagggataaaaaactacacactgggtccgagcacggtggctcatgcctataatcccagcactttgggaggccaaggcaggtagattatgaggtcgggagttcgaaaccagcctggccaacaaggtgagaccccccccatctctactaaaataattagccgggcccggtggcgcatccctgtaatcccagctactttacttgggaggctgaggcaggagaattgcttgaactcgggaggcggatgttgcagtgagccaatatcgcaccactgcactccagcctgggcaacagagcaagactccgtctcgaaaaaaaaaataaattttaaaaactacacattgggtacantgtacactcctcgggtgatgggggc

SEQ ID NO: 25246 - DNA, 411 bp, Homo sapiens
  misc_feature 2, 5, 59: n = A,T,C or G
gntantgaccggaaagtttacccatgaagattggtgggattttttgtttgtttgttttnttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatcaaatgtctatcaactttaatcaagttgtaacttatattgaagacaatttgatacataataaaaaattat

SEQ ID NO: 25247 - DNA, 500 bp, Homo sapiens
  misc_feature 2, 3, 56: n = A,T,C or G
annagcccatgcttccagtcaatgaaggcaagaagctgaaagaaaagctcaagccnctgatcaaggtcatagaaagtgaagattatggccaacagttagaaatcgtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacactaaagtgtttccgtttccgacggcactgtttcatgtctatggctgcaaatacttgcttaaactatttgacattttctatctttgtgttaacagtggcacagcaaggctttcctacataagtataataatgtgagaatgatttggttttaattataaactggggctaaatcctaaagcaaaattgaaactccaagatgcaaagccagagtggcattttgctactctgtctcatgcctt

SEQ ID NO: 25248 - DNA, 360 bp, Homo sapiens
gataaagtccaatggaacacagccatccatgcttatgtaagtgtgcatattctctggctgttttcactgcaatagcagagttgagtagttgtgacaaagagtttatggcccacaaaacctaaaatatttactttctgatgctttacagaaaaagtttcctgaaccttattctagctatatgttgttcataaatgaatctttcgtggttctgaaggcatttaagaatctcttaggttataaattggctgggcgcagtggctcacgcctgtaatcccagcactttgggaggccgaggctggtggatcacgagggcaggagttcaggatcagcctgccaagatggtgaaaccctgtctccatt

SEQ ID NO: 25249 - DNA, 362 bp, Homo sapiens
  misc_feature 2: n = A,T,C or G
gncatgaagaccaaagtatgataggtcatcttcaagaggagcttgaagaaaaaaacaagatttattccttgatagtagcccagcatgtgggaaaaagaaggagggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacataggagttgaaatggaaggagttgccctcaaaatatgaaaaattacagggctttacaacagatggatggaagaaataaacccacagaacttttggaagaaaacactgaag

SEQ ID NO: 25250 - DNA, 500 bp, Homo sapiens
  misc_feature 2: n = A,T,C or G
gnctacgttccctgctaacgtcacaaagtatcttcacaagtttaacggagtctatcagtgctgctcatgtgaaatcaagtaggaactgctaaggaacattcaaataaggttaaagacacagagtaaattaagtgcctaaaaacaaatgtgatacaaattagagtttgtgtctttgcccttatccatttacagaatttaccccattaacagctggaaatttattttcactttcttcacctctctaagaggaaagcaaacatataacacagccccaaaggagtaattaattagatcatttactgacatggatttgaatagtttatttaaatcaattctgttatttatttattttacaacattatgcaagaggttgaaactcctgttccaatttgcacttagcaagaatctctgaaaaaatatcacagtgaaggaaataaacaaagaccaggatcaaagggccacattcagaaacgcataaaagaatttcaccaggacgtgtg

SEQ ID NO: 25251 - DNA, 370 bp, Homo sapiens
  misc_feature 7, 8, 326: n = A,T,C or G
ctagtcnntatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttgccaagtggttgtcatttgttaaaccctggtttacctgtcttgctattatgacatttcatttggaaggntgtttgtgttgtagctaactggtcaagtctggtgctgactgctg

SEQ ID NO: 25252 - DNA, 382 bp, Homo sapiens
  misc_feature 6, 9, 56, 58: n = A,T,C or G
gataanccntaactagaaataactttgcaaggagagccaaagctaagacccccgantncagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatc

SEQ ID NO: 25253 - DNA, 279 bp, Homo sapiens
  misc_feature 175, 215, 269: n = A,T,C or G
taatcccagctactgtaatctcagctactcgggaggctgaggcaggagaattgcctcaaccgggaggcggaggttgcagtgagccaagatcgcaccactgcactccagcctggcaacagagcgagactctgtctcagaaaaaaaaaaacaaaaaccagtttaggctgggtatggnggctcaccagcactttgggaggctgaggcaggtggatctnttgaggtcgggagtttgagaccagcctggccaacatggggaaaccctgtctttnctaaaatttt

SEQ ID NO: 25254 - DNA, 498 bp, Homo sapiens
  misc_feature 13, 57: n = A,T,C or G
taaaaaccccctngcacaacatcagagagttcatactggagagaaaccttacaagtntaatgaatgtggcaaggtttttaatcaaaaagcaagccttgcaaaacatcagagagttcatactgcagagaaaccttacaagtgtaatgagtgtggcaaagcctttactggacagtcaacacttattcaccatcaagcaatccatgggtgtagggaaactttacaaatgtaatgattgtcacaaagtcttcagtaatgctacaaccattgcaaatcattacagaatccatattgaagagagatctacaagtgtaataaatgtggcaaatttttcagacatcattcataacttgtagttcctcagtgaactcatactggagagaaaccttacaaatatcatgactgtgacaaggtcttcagtcaagcttcatcctatgcaaaacatagaattcatacaggagagaaacctcacaagtgtgatgattgtggcaaagcctttac

SEQ ID NO: 25255 - DNA, 345 bp, Homo sapiens
  misc_feature 11, 20, 46, 151, 152, 339: n = A,T,C or G
cgattcggtcngacgagctncgctttcgctacagcatggtggcctnttggagacaggctggactcagctacatccgatactcccagatctgtgcaaaagcagtgagagatgcactgaagacagaattcaaagcaaatgctgagaagacttnnggcagcaacggtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgctggtcataaatggcaatgcaataaattgaaatatggntcactg

SEQ ID NO: 25256 - DNA, 497 bp, Homo sapiens
ataagattatcttaaagctgaagccaaaatatgcttcaaaagaagattctttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgctttatgcagacacaaggaatt

SEQ ID NO: 25257 - DNA, 125 bp, Homo sapiens
ctctgaacaaggggttaggaaatctagagagacataagcagcagaagtcgaaagaaaactcattagtttaaataatcaatgttctttctattacattaagtaaaaatagaaactggtcagtgaat

SEQ ID NO: 25258 - DNA, 410 bp, Homo sapiens
  misc_feature 2, 19, 30, 34: n = A,T,C or G
tnagaaatgaagggagggncaacaatctgntttngtgtctcctcagaaacaatcggcccagaaggttatatttaaaaagaaagtttctcttttgaatattgccacaagaataatgggcggtggggaatctggaacagtgtcttctcagaaacaaccagcctcaaagactgcaagtgacaagacaagattctgctttgaatacagctacagaaataaaggatggactacaatgtgggacagtgtcttctcagaaacaacaagccttgaaggctacaactgacgaggaaggtctgtttctaatatagccacagaaataaaggatggagaaaaatctgggacagtgcttctcagaaaaaaccagccttgaaggccacaagtgatgagaaagattctttttcgaatataaccag

SEQ ID NO: 25259 - DNA, 247 bp, Homo sapiens
  misc_feature 7, 11: n = A,T,C or G
caatganaccnaaattgaggagatccaactgaaagaggcaaagcacattgctgaagatttcgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagcaaatgtgccgagcttgaaga

SEQ ID NO: 25260 - DNA, 236 bp, Homo sapiens
  misc_feature 7, 10, 45: n = A,T,C or G
caggagncgngtgaccaccctcaacacggatatcagcatcctgtntttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttt

SEQ ID NO: 25261 - DNA, 421 bp, Homo sapiens
  misc_feature 51, 418: n = A,T,C or G
cgaactcagtctcttactgttcaaagaaagaatcttaacagttgaattttngagggaaattcccttttgccccaagcgtttctatatttaaagcaatatcccaggagaatatgttagacttaggatgataccttcagccacttgaagaagaaatagaaggcgctcattccaatatagtctttatttcccattcagatacaggttgagcatccctaatctgaacagttaaaacccccaaatgccccaaaatccaaaccttcctgaacgctatgacaccatgagtggaaaattccacacctaacaaacacatttgctttcttatggttcaatgtacacaaactgttttatatagaaaatgatttcaaatatcataaaattaccttcaggctatgtgcataaagtatatatgagccatagntgc

SEQ ID NO: 25262 - DNA, 437 bp, Homo sapiens
  misc_feature 55: n = A,T,C or G
aatgacccataattggaactcttcagccaagccatatctaacagaactatcttcntcttttcaggtatgtgagaatacattcccttctcactttacaccaatttgggttggattttatgtcacttgtaaccaatggatccttactgaatcaaatactaaattatttgaggatagatccataaacaaatacatataggaatgagtgaatataaatgtacttctggggcaaacctaactaaaatggaagtggtagactgaggagtggttcacagagtagaagagaactaggctggggcaaggagcttgaaattcaagtcagggctaggcacagtggctcacgcatgtaatcccagcactctgagaagccggggcaggtggatcacttgagcccaggagttcaagaccagcctggcaacatggcaaaaacctgtctctac

SEQ ID NO: 25263 - DNA, 498 bp, Homo sapiens
  misc_feature 6, 13, 39, 40, 490: n = A,T,C or G
aagctnacaatgnactgtatgaattaagtgacgctttanntttgattttacattttaaagttaaaatgtgggcattatgtcagcaaacttaagggcattatgtcagcaagctaaaacattttttttcctgtgcttttaatgtatctctttacatgatctgagagaggatcaagttgatagaaatagctgaggggaaaagggggaacatcttgggatgaagcttgccttatggtgatggtttaattacagattaaaaaattagaaggaaatttcagtgaattaagtgtatagctttcatatctacatttcaagaaattaccattgtaacttgataagagatgatttattttatgtaaacatctttgcaaagcaaggtgtagcagctcagctagatttattactgtgcacgaaagtaaatacctatctcaattattctttttcttttccaatataaagtttgctgaatgtccaagaagagtttatcacttanggatatag

SEQ ID NO: 25264 - DNA, 437 bp, Homo sapiens
  misc_feature 10, 12, 45, 265, 275, 371, 403: n = A,T,C or G
caagcggaanangaccaccaggaagcacaggtccaaggctggccnacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgncattcgtggntgatttcaatacactcaagtgccattcatcctttaagaaaaacatctggatatcaaggtggaaatggccatttaatgattgaatatatcattttgnggatataggtattaactttttgaattctatgngggattaacaataaaagcattttgcaaacactgg

SEQ ID NO: 25265 - DNA, 500 bp, Homo sapiens
  misc_feature 10, 11, 47, 50: n = A,T,C or G
cttaagcggnngtgagtcttttcaagcaacccggccagtactggganttncagccatccaccttcagatgtgtctacgtgcgctctgcattcaactcggaaactataagtaattctcaagggaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagctttctttttaatttccaggaaaaaataaaaagagtatgagtcttctgtaatcattgagcaggtagctcatttgagataaagtca

SEQ ID NO: 25266 - DNA, 495 bp, Homo sapiens
  misc_feature 11, 57, 59, 60: n = A,T,C or G
aaaaaaacccntctggcttccttaataagatagttgagcctatgacattaaggagcntnnctgctggcggaagattctagattcactggtggtttaagaggcccagggatttagttcttactggtgcgtaagtgttttcccatcctaaccggaaaaccactcacccaggcttcccccacttcccctcaaattttctcagctctgccgctggtctccatgaacggcaaggggaaccaccactcattcactgtcagtgtaggtaagacagaggatgcccttgcaaaaattgggactgaggacagtagcacacggaatggtggatcgtacatttgcacccagagctactaaacgctcagtgaccccagagaccattaatttcccggagtgaaggggatgggggtagagctaattggaatttttattatccaggactcatcctaagaagaatgttggcctctcttcatcccttggcttagccgcaggtaagaacgctta

SEQ ID NO: 25267 - DNA, 489 bp, Homo sapiens
  misc_feature 1, 61: n = A,T,C or G
nagatggatccatagatagatacataggacatctatagagatatatgtttctatataaatntatatctatattatcctaaagaaatatatatttgaacaaaatctatttatgaaaatgttcactaatgcaaaacttataatggcaaatagaaagggaatccgctgaacaaaatattatcaatcccaaataatgagatattgccaaaacactatatttaaagaacttaagtgatttgggaaaatattatcttgtgagggcaaatacattaaatttgtatattcagtattgccaaatttatataaaaaaatgggtagaatttctttttaaaaaacaccttaaaatataaacggagtaattcccaataatcagattacatgtgattttattttcccccctaattttaattttcaagttccgtacaatgaacatgtgttattttcataagtataaaagacttttttataaaaagaaatatatagactaattag

SEQ ID NO: 25268 - DNA, 500 bp, Homo sapiens
  misc_feature 15, 30, 45, 54, 61, 67, 69, 76, 80, 328, 361, 443, 483: n = A,T,C or G
ctatgaccaacatanataaaaacacgagcntagcattatccattnccaaagttncattacnccgacncntccaaanaggngctaagcaaaaacccccaatgtattattgaaccatggacttgcacctcatgtttaatgtgaatatttatttccatgtccctcttaactggttttttcttgcttccccctagctgtattgttatttcagatatgtgatatctgttttcatactcttgcctttccatcatgaatgcttaagttatgaacagagatcctttgtagagctcataggcagtacagagaggtaagcttgcctcagagggcttgnatcttggtgtagtttttaaatagtgcatagtgnatagtggacattttggtttgcacatagtttggtgccccgaatgggtttttaccaagccttttttctttcatgtatttacagnccggagcacaagatctcttcttcaaatacaatgtaatcgntttactttacaacacta

SEQ ID NO: 25269 - DNA, 498 bp, Homo sapiens
  misc_feature 13, 48: n = A,T,C or G
cacacaggagaanaaccttatcagtgccacaactgtgggaaatccttnttttccaagtcacagcttgatatacatcatcgaattcatacaggggagaaaccttatgaatgcagtgactgtggaaaaaccttcacccaaaagtcacacctgaatatacaccagaaaattcatactggagaaagacaccatgtatgcagtgaatgcgggaaagccttcaaccagaagtcaatactcagcatgcatcagagaattcacaccggagagaagccttacaaatgcagtgaatgtgggaaagccttcacttctaagtctcaattcaaagagcatcagcgaattcacacgggtgagaaaccctatgtgtgcactgaatgtgggaaggccttcaacggcaggcaaatttccataaacatcaaataactcacactagagagaggcttttgtctgttacaaatgtgggaaggcttttgtcagaaatcagagtggattacccatcaaaga

SEQ ID NO: 25270 - DNA, 498 bp, Homo sapiens
  misc_feature 19, 32, 46, 77, 79, 84, 134, 172, 342, 492: n = A,T,C or G
aactacagacatttctgangagtgctggtgangacgaacttcagancttttgagtatacttcagtatactagtgcancngaggnacacaaagaaattctgtcttaataaagaaagctacttctcaagggtattntgtggctcagtccaagctctcctgtcccattgtgcatngtctgtgacatgcaacttacaaaactagcagttgtaacaataaatcacagccacttgcatgaaaggatattcattattctcaaatggcttttggactatcaaaaacagtaaggcttttgtcagaaatcacctttagtcaaaaggtttaagaagcaaattatttagtagcnagaacttatctcaggaaaggaaaatatgcatggttggtgagaatctaataacattaaaatgcctggggcaagatgcagtcaaagttgaagagactttattctcaataggtgattactggatgatatgcatatgatgcaaaaaaggtttgnggcatt

SEQ ID NO: 25271 - DNA, 237 bp, Homo sapiens
  misc_feature 47: n = A,T,C or G
caagtcattccatctgttccatctaagcgattcatgacctgcattcnttctaaatgacaggaaccacaagcaactcagtcagcaggcttcagaatcggtcatcctaaaagatattgcaggtcaatggctaatacactaacaaagaaagagcttatgcaaataagtaaggaaaatactgtttcaatgttaaatcattaaagacaaattcagactactcacaaagaagatctataaatg

SEQ ID NO: 25272 - DNA, 493 bp, Homo sapiens
  misc_feature 2, 426: n = A,T,C or G
gnaacggcccctttctttgcttagcacctcgacttcgcgcagttttcatcgaagactgttcattacgcattggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggntttgtaaggtatacagcagtaatctcctatttggggcaggttttcaataaagttttgattatgggta

SEQ ID NO: 25273 - DNA, 259 bp, Homo sapiens
  misc_feature 19, 20, 32, 37, 40, 42, 45, 51: n = A,T,C or G
tgagacccacattcatagnnttaaagatacanaggangananganagatanacaagttttcagggcataacaacagtgattctgaagagaaggacaagtctaagaagagaaagcttcatgaagaactttctagcagtcaccataaccgggaaaaagccaaggaaaagcccaggttcttaaaacacgagagttctagggaggcagcaaatggagccattctgattctgacaaaaagtccagaacccataaacatagccta

SEQ ID NO: 25274 - DNA, 500 bp, Homo sapiens
  misc_feature 9, 10, 29, 64, 99, 110, 465: n = A,T,C or G
tgcatgacnngcttgacaaactgtgcttnttcttttaaaaatgtgctatccagttttttgtacncacatacacaaaaacatacacaatggccatatcantcagccttttncatcttttcaccccttttctgcatattgggatatctgcaacccatattaatatcctagatttttgtttatacacgtataatccagttactagttgtaacacgtggcacattgccagattacttagaataaagctgcacatttgaccttttcaccagcaatgtggaatgataacaatttcttcacatcttctccagcagtaggtattttaattaattcaatttttgccagctagattgggcatgaaatgatgccttattattattttaacttggcttcctcctctacgtttaaaaactattgtctgatcattatgataattaaggaacaaactaatgaaaatgtaagcatcattgntttcttaaaggaacactttggaaactcaatttcag

SEQ ID NO: 25275 - DNA, 500 bp, Homo sapiens
  misc_feature 2, 7, 47: n = A,T,C or G
gngtcgntgaggtctccgcgccgctccctgtacaaactggtggtttnccgacttggaaagaggctttccggcagagatgccttggagagaatgagaaacagccgggacaggctcctaaacaggtaccgccagctggaagcagtgggccagggaattctcagaacagctttctagttcaagaggtgatggaagaagagtggaatgctttgcagtcaagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctgctgagtgggaggcaaacccactcatctgtcctgtatgtacaaagcctgtgatcttgggctgtgatcctctagagccagcttggactcacatcattctatggggttgaagacaactcattcctctg

SEQ ID NO: 25276 - DNA, 237 bp, Homo sapiens
ccttgtgacacaaggaggcaaagttatttggggaaaatatgcccaggttaccaacaatcctgaaaatgatggatgtataaatgcagtcttactggtttgacagcaatttcatatataattattgaggactacacaccaattgaaggaaactgccattactgtgatgtttctgaatactaccaaacagccatacatgtctgcaatgaagagatttattaaattgtaaacattaaagtg

SEQ ID NO: 25277 - DNA, 370 bp, Homo sapiens
taggctgtgagactacctattgtagatattgcaccctatgacattggtgggcctgatcaagaatttggtgtggacgttgccctgtttgctttttataaaccaaactctatctgaaatcccaacaaaaaaaatttaactccatatgtgttcctcttgttctaatcttgcaaccagtgcaagtgaccgacaaaattccagttatttatttccaaaatgtttggaaacagtatgatttgacaaagaaaaatgatcttctctttttttgctggtccaccaaatcaattcaaatgctttttgtttatttttttaccaattccaatttcaaaatgtctcaatgggctataataaataaacttcaacactctttttg

SEQ ID NO: 25278 - DNA, 496 bp, Homo sapiens
  misc_feature 5, 58, 485, 496: n = A,T,C or G
aaaancctccctccctactgctgctacacaagaccctgagactgacctgcaggacgantccatgaagagcctgatccttcttgccatcctggccgccttagcggtaagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgctataatcgctacttcaggaagcgccgagggaccaaatgagactgagggaagaaaaaaaatctctttttttctggaggctgcacctgattttgtatccccctgtagcagcattactgaaatacataggcttatatacaatgctctttcctgnatatctcttgn

SEQ ID NO: 25279 - DNA, 100 bp, Homo sapiens
  misc_feature 2, 29, 39, 57, 99: n = A,T,C or G
cngcacacctcatatgaatgggacgcttnacttaatatngtgaagacgccaagactnatgcaaattggttcacacgactgagtgcaatcactatcaaant

SEQ ID NO: 25280 - DNA, 354 bp, Homo sapiens
  misc_feature 1, 19, 129, 140, 195: n = A,T,C or G
ntcccatttacctgtgcgntgctgctgtctgctgcgtgattcagcaagtttcatctcaagagctttcctgtaaaggccgctgctttgagtccttcgagagagggagggagtgtgacccgcgacgcccantgtaaagaagnatgacaagtgctgcccgattatgagaagttctgtgcagaagtgcataatcccacntcaccaccatcttcaaagaaagcccttcaccttcaggagcatctcaaaccatcaaatcaacaaccaaacgttcacccaaaccaccaaacaagaagaagctaagaaaggtatagaatcagaggaaataacagaagacattctggttctgaaaatcaagag

SEQ ID NO: 25281 - DNA, 130 bp, Homo sapiens
  misc_feature 101, 126: n = A,T,C or G
gtaaacacgtgaaatttcaggaattatttctgtcctaaatagtatttaatctgagttttggaaatttaaatgtcggaatcgaatttagtttatattaattntcctggattcactgcttgctccggncaca

SEQ ID NO: 25282 - DNA, 497 bp, Homo sapiens
  misc_feature 25, 31, 38, 88, 144, 150, 168, 187, 323, 366, 404, 416, 431: n = A,T,C or G
gcgacaaacctaccgagcctggcgntggcgnaaagggnacagtttttaccctaaagtgcaaaagtgaaacatacaaaataagactaanttttaagagtaactcagtaatttcaaaatacagatttgaatagcagcattagtggnttgagngtctagcaaaggaaaaantgatgaataaaatgaaggnctggtgtatatgttttaaaatactctcatatagcacactttaaattaagccttatattaggcccctctattttcagggatataattcttaactatcattatttacctgattttaatcatcagattcgaaattctgngccatggcgtatatgttcaaaattcaaaccatttttaaaatgngaaagatggacttcatgcaagttggcagggggtctggnactaaaaattgngggtggtttttctgnttacgtaaccctgcttagtattgaactctctaccaagagggtcttcctaagaggagtgctgcatta

SEQ ID NO: 25283 - DNA, 500 bp, Homo sapiens
  misc_feature 5, 60, 61, 493: n = A,T,C or G
taaantatccccacgaagcagctggcaacctcaagaaggccctgctcatccagggctccnntgacgtggagatccgggcagagggcaatagcaggttcacgtacactgccctgaaggatggctgcaccgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatccaccctctacaggtcggacttttctcccctctctttctaagagacctgaactgggcagactgcaaaataaaatctcggggtctatttatttattggcntcctgta

SEQ ID NO: 25284 - DNA, 500 bp, Homo sapiens
  misc_feature 7, 492: n = A,T,C or G
aagcatnctctgccaagaccaaaaggaaagaagaaaaagggccaaaagcttaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgccaaaagacgttttctttggaccaaagatctctttcgtgattccttgcaacaatcaatgagaatcttcatgtattctggagacaccattcctgatttcccacaaactgcctacatcagtataactgcatttctagtttctatatagtgcaatagagcatagatctataaattcttacttgtctaagacaagtaaatctgtgtnaacaagta

SEQ ID NO: 25285 - DNA, 435 bp, Homo sapiens
  misc_feature 56, 59, 161: n = A,T,C or G
aaaattgcccatggaatccgtctcaataggagtgaaagatgggatgcctattgctnttncccacacgcaaaggagtgtggtggcgcctttacagatccaaagcgaatttttaaatctccaggcttccaaatgagtacgaagataaccaaatctgctactgncacattagactcaagtatggcagcgtattcacctgagttttttagattttgccttgaagatgacccaggttgcttgctgattatgttgaaatatatgacagtacgatgatgtccatggctttgtgggaagatctgtggagatgagcttccagatgacatcatcagtacaggaaatgtcatgccttgaagtttctaagtgatgcttcaggtgacagctgggagggttccaaatcaaatatgttgcaatggatcctgtatccaaatccagtcaagg

SEQ ID NO: 25286 - DNA, 252 bp, Homo sapiens
ctatatcactgcccaacatcagaaaacctgacggctatgattactattccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagc

SEQ ID NO: 25287 - DNA, 420 bp, Homo sapiens
  misc_feature 10, 58: n = A,T,C or G
aacaaaaccnataagccatcgcgcctgcccttccttgatattgcacctttggacatcngtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccattaacatttg

SEQ ID NO: 25288 - DNA, 246 bp, Homo sapiens
  misc_feature 241, 245: n = A,T,C or G
attatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaatttttttaacattcctcatgaatgtaaatttgtactatttaactgactattcttgatgtaaaatcttgtcatgtgtatnaaant

SEQ ID NO: 25289 - DNA, 257 bp, Homo sapiens
  misc_feature 2, 7, 57: n = A,T,C or G
anggaancccgtaggcagaaatgagcagttcgctcctccctgataagagttgtcccntagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagtt

SEQ ID NO: 25290 - DNA, 223 bp, Homo sapiens
  misc_feature 3, 45, 46, 221: n = A,T,C or G
aanccttgttctatttttcaatcaccaaaaagtaattataaatanntattacaaacaagtggatgtttttaatgaccaattgagtaagaacatccctgtcttaactggcctaaatttcttctggtagtgtcagttcaactttcagaagtgccacttaaggaagtttgatttttgtttttgtaatgcactgtttttaatctctctctctttttttttttttngg

SEQ ID NO: 25291 - DNA, 367 bp, Homo sapiens
  misc_feature 6, 14, 53, 54, 351: n = A,T,C or G
gatccntgcacatntcatggtagctggctgggaccaacgtgaaggaggtcatnntatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgcatctacctggtcactattacagctgccagtgtggaccatcgagtcatcttgggcaatgaactgcaaaattctatgatgagtgaaccttcccagacttctctttcttattttgnaataaactctctagga

SEQ ID NO: 25292 - DNA, 125 bp, Homo sapiens
catggccaacaatattgtccaaattgcatttgtaccccataaataaataatttttaaaattctgtctatataaaactaacttcaaatacagcataggtaagataaaagtaaaaagagagaaccag

SEQ ID NO: 25293 - DNA, 265 bp, Homo sapiens
  misc_feature 16: n = A,T,C or G
aaaaacacccacttgngcttttgtgaattaggaatgtcagtatataataacagaatgttttcaacttttaactatagactgtttacctgtgcttttaaattgggagatggttgtctgtgtttggagaaagtcattttgacaatcttggggctatatgggttttaattattcttagtagaaccattgcaggtatttcccattgactttaattgcagttctctgtagaaaaattttctgagaacccaatgtaatgtgttcactgagc

SEQ ID NO: 25294 - DNA, 498 bp, Homo sapiens
  misc_feature 1, 6, 398, 435, 446, 468, 490: n = A,T,C or G
naaaangagaccctcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgnaaacacttaagtatgcagttgataagaggaatttggnataattatggngggtgattattttttatactgnatgtgccaaagcttactactgnggaaagac

SEQ ID NO: 25295 - DNA, 497 bp, Homo sapiens
  misc_feature 5, 7, 59, 415, 473: n = A,T,C or G
aaatngncccagccagcgcaggggcttctgctgagggggcaggccggagcttgaggatnccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaagagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaaggtgnaggtgattaaaataatttgaaggcgatctttttaaaaagagattaaccgaaggggttnaaagaccttgaatccatgaccagg

SEQ ID NO: 25296 - DNA, 406 bp, Homo sapiens
  misc_feature 1, 9, 61: n = A,T,C or G
naaaaaatncccaacaattctgtgaaaggtcacaggacccaattggagaaatcatatgatnagcatagttggtcttggtggtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagatg

SEQ ID NO: 25297 - DNA, 500 bp, Homo sapiens
  misc_feature 4, 11, 44, 462: n = A,T,C or G
cagngcagggncttctgctgagggggcaggcaggagcttgaggnttccgcagataagtttttttctctttgaaagatagagattaatacaactacttaaaaaatatagtcaataggttactaagatattgcttagcggttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttaagtttaaaagttgtaggtgattaaaataatttgaaggcgatcttttaaaaagagattaaaccgaggtgattnaaagaccttgaaatccatgacgcaggggggaattgcgt

SEQ ID NO: 25298 - DNA, 416 bp, Homo sapiens
  misc_feature 48, 341, 407: n = A,T,C or G
caaaggggatgtgcctttttatttttgtttttaatgctttgatatttnaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcaagtgccttggcaggctgatttctaggtaggaaatgtggtagcctcacttttaatgaacaaatggcctttattaaaaactgagtgactctatatagctgacagttttttcacctggaagcatttggttctccttgatatgactggttncgggacagttatttgtgagagtgtgcccaaaggtacatgtttgccccttctagtggaaataaaggnatatttttc

SEQ ID NO: 25299 - DNA, 499 bp, Homo sapiens
  misc_feature 2, 42, 63, 123, 138, 177, 250, 307, 309, 439, 471, 496: n = A,T,C or G
gnccccttcaagcatgaagccatggaccctcgtggtgagtgntacagttcttttagatggtgngtctggagtttgttccttctgatgttctgatgttcagatgtgtccagagtttcttccttncagtgggttcatggnctcgctgacttcaggagtgaagcttcagaccttcgcagngagtgttacagcttatcaaggtagtgtggatccaaagagtgagcagcagcaagatttattgtgaagagggaangaacaaaacttccacaacgtggaagaggactccagcaggttgccactgctggcttgngngccagcttttattccattatttggccccacccacatcctgctgactgggccattttatagagcgctgattggtccattttacagagcgctgattggtccattttacagaagtgctggttggtgcgttacnatctttagctaagacatagaatgctgattggngcgcttttacagagggctgattggnggg

SEQ ID NO: 25300 - DNA, 338 bp, Homo sapiens
  misc_feature 26, 49, 51, 256: n = A,T,C or G
cttttagcttagggcctggtggctanggtcggttctctcctttccagtntnagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaatacccagagccctggaacaaactgggcccaatgatcaatacaagnctactcagtgaatgtggattacagcaaagctgaagaagggacgtccagatttctaaatgaaatgtttcactatacgctgctt

SEQ ID NO: 25301 - DNA, 244 bp, Homo sapiens
taacagaacccgatgcaaacaaatgttctctcaacttacatccaggataagctaaaatattactttaacacatgttgaaagtagagtgctctatttggctagatataattccaggctgtctaagttgagtaatttcctcagacattccaactttgatcaactgcagcaagaacttttagcatgtctgtaaagcagccagtgcatctgtaaatatgtcctgagatagggagaaaagagaatgccg

SEQ ID NO: 25302 - DNA, 133 bp, Homo sapiens
  misc_feature 20: n = A,T,C or G
taaccaaaggcaaagaagtngaaaactttgaaaaaatttagaagaatgtataactagaataaccaatacagagaagtgcttaaagtagctgatggagctgaaaaacaaggctcgagaactacgtgaagaatgc

SEQ ID NO: 25303 - DNA, 295 bp, Homo sapiens
  misc_feature 28, 29, 35, 54, 85, 122, 151, 167, 206: n = A,T,C or G
cctgagcaggagacgcgaaccaacatgnngctggngctcgcaaggtcacttttnaataggatggactttgaagacttggggttgngagtagattgggacaccacctgcctacaccagctgcnaagactgtgggtgagaacctccccagganagtcatcagaggctcncaggctgagctcaagtgccccgtgtgtcttttggaattngaggaggaggagactgccattgagatgccttgcatcaccttttcattccagctgcattctgccctggctaagcaagacaaattcctgtc

SEQ ID NO: 25304 - DNA, 467 bp, Homo sapiens
  misc_feature 5, 10, 58, 164, 214, 230, 275, 279, 297, 328, 369, 417, 423,432, 462: n = A,T,C or G
aaaangtccnaagtataaatctggggaagaggttttatttacattttagggtgggtangaaagccaccttgttacaaattttttaatttccaaaataatctatattaaatgagggtttctgatctgtactttgtgtttagctacctttttatatttaaaaaaanaaaaatgaaaattacgttcttacaagcttaaagcttgatttgatctttgnttaaatgccaaaatgnacttaaatgagttacttagaatgccataaaattgcaggttcatgnatgnatataatcatgcccatgnatatttaggtacggataatgccttctgaggngaggtttacccttaaatcatttgggtaaaacattggcttgntggttacccccctctggaggttttaaataaaaaccttaaaggataagnctacantaaacaaangatcacatctaaagccttatccttgggggnatcca

SEQ ID NO: 25305 - DNA, 497 bp, Homo sapiens
  misc_feature 2, 272, 400, 435, 469: n = A,T,C or G
anagagaaccccattaaatacttgaatctgcatgacagtttgacttgaatgcaacagcttgaaaattttgcaagttacataattgtatatacagtaggttttcttaagtctcttcggttcatcctttgtaatttgtgtgtgtatctgtagtattgcaggcttttggagactattcttacaggcagtatgtcaagtcatcaaagaaaatgctgcacctgccattgttgtatttgtgggtatttataggtgtatgtatgtaaatgcatcagtgngtagattgcatatcagtgtatggtacatgtcatcaaaattatttttgccttaatcagtgtgatatgaaaagcaagtccacctcataggactgattatataatgaaggtgttgagagatatatagtggnattgtttattaacttaactcaaataatatttgatnaaattttaataagacttatgctagaaaatcttgngctttgaatcaccagggcaaaatgactt

SEQ ID NO: 25306 - DNA, 129 bp, Homo sapiens
  misc_feature 5: n = A,T,C or G
ctggnacaactgtccttagactgatgagcaaaggaggagtcaactaatgaagaaatgaataataaattttgacactgaaaaacattttattaataaagaatattgacatgagtataccagtttatatat

SEQ ID NO: 25307 - DNA, 494 bp, Homo sapiens
  misc_feature 58, 60, 405, 425: n = A,T,C or G
aaaactaacccctataccttctgcataatgaattaactagaaataactttgcaaggantnccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggctaaaagcagcaccaattaaagaaagcgttcaaagctcaacacccactcctaaaaaatnccaaacatatactgactctnacacccaattggccaatctatcaccctatagaagaactaatgttagtataagtacatgaaaacattctc

SEQ ID NO: 25308 - DNA, 254 bp, Homo sapiens
  misc_feature 231, 238: n = A,T,C or G
gaggccaaggcgggaggattgcttgagctcaggagttcaaaaccagcttggacaccatagtgagacccccatctcttaaaaaaatatataaaaattaataggacaagcgcagtgtctcatgcctgtaatcctggcactttggaaggccgaggcaggaagattacttgagctcaggagttcaagaccagccagtacaacatagtcaaaccccatctctaaaaaaaaataatnaataatnaaaacataaaacttgc

SEQ ID NO: 25309 - DNA, 500 bp, Homo sapiens
  misc_feature 320, 365, 417, 428, 459, 468, 497: n = A,T,C or G
atattcctactcggtcatactggactggcttcgttctcttaatatactcagtaatgactcaagcctctggctattaacataccttagtcgccgttttttaattgccatgagccaaatacttcttggtatacaattgatccatttattttaatggccgccttttcattttcatcttttcttgctgctacccatctatgtatgtagtcattggggggaaaatgtagcccattttttatgggaagacttgtgtaaaagtgaacattttgaagggttttaactggtgaaactagcctggaataatgccccagagactgagtggnaatcgcccttttggaaggtgccattcttatgagccaaaaggttgncatttaaaaggtcattttgagggaatacatgtaatataattggaataaaggnatagtaccctnaaaagacatatactgatggtgggaatggggngaattggtnaaatgagtactttgataagttttcatgcncag

SEQ ID NO: 25310 - DNA, 500 bp, Homo sapiens
  misc_feature 10, 49, 449, 490: n = A,T,C or G
gctattgacncataaaagtgttatcttgaaaagctgctgaaagatgttncttgttctcatctcctcagttgctttgcccccacaaatgctggtgtactgctgtattcaatgtgtataactttaaatacagtttctgttgtctaaaaagcattgaatcatcttttattttgaaatggtattgattgcatgtttaaatgataatactttggaggtattggattaaataaactgtgtgtgtgtatatgtgtgttttctgcagtgaaaacacttattttacaacagtaatctttattttaggcaacattcaaacatacaagaaatgtgttgttacaattaaaatttttttaaaaagtagtggagcatcatcttcatcccatccctcttaagccctgacttgacaccctaagaaacttcttgaattattctgggctggccgacacctgtaattncagcactttggggaggccaaggcagggggatcacttgaggncaagaattcg

SEQ ID NO: 25311 - DNA, 282 bp, Homo sapiens
  misc_feature 58, 209, 272: n = A,T,C or G
gacaccccccaaagggaaccgcagggactacggaaccactcagaggatggggaccctngatgtcccctggcagggcacctgtaaaacccaattttgataaataattatatctaacacatttttaaggaaaaaaaaaagaaaggtttttcttaattgccaatgagcaattctctcaaggtttaaacctgaagactgtcttgcatgctttngtattattaactataattcttatcttcagagtatttcatctgcaattttcaagtttacttttntcacagacct

SEQ ID NO: 25312 - DNA, 260 bp, Homo sapiens
  misc_feature 47: n = A,T,C or G
catagctcgacatatttaggtttcattatatgcacataaacattggnttaacacaaatgatctgcatttctggtttaaactgatatttgtgcttattaatttttttgcatattaagagattgtcatgacttagtttttctattgatttaatttatgctgtcagaatttattgtaacactatatcaactgtagaagtaaacatttaaaaagtttaatgcagtaggattgcattgaatgattgttatagatcagaataaagg

SEQ ID NO: 25313 - DNA, 497 bp, Homo sapiens
  misc_feature 57, 58, 282: n = A,T,C or G
aatcaaaccactcaaccttttggaatttgatcctctactgtaatactcatatgctannttactgaattttccgagtgaaaaaaaattgacagggtaatatataggccatattatagtgaagatcataagtataaatgtcctcgtttaatctttccatattgaggacagcctctgcatataaaaatgttcattgggagaaaaattatttttaaaactaaatttttatagtagtcctccattactggcaattaaggagcaacccacaaaatgtcattatgtggntctttgattaggcataaaaagtattgcgaacagcttttctattcctttggaatatgaatctttttaatgtctaaaggtaacctgcaacattttctagtaggacaagtcaatgtaaattaaggtaattttgcctgtttatccttctggtgcattttgtcaaatgaaaacatttttaaaacatgattgaatttttacttctcagataattgggttga

SEQ ID NO: 25314 - DNA, 237 bp, Homo sapiens
  misc_feature 7, 12, 34: n = A,T,C or G
cccgagnctggngatagctggttgtccaagatanttatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatc

SEQ ID NO: 25315 - DNA, 500 bp, Homo sapiens
  misc_feature 2, 47, 318, 324: n = A,T,C or G
gncaaggaggacaacaggctatttttctgagttactaggaggatggnttgattgtacattgagaggaagaataggaaaggaaggggagattaggtgctggcttttttgttgtttgagatacttgttggacattcaagtaaatatgctttatacattctggacatgtgaatcgagtttagaggaagagtgtgggctacaaatacaaattactaagccatcagcttggtatataaagccaatacatctcattgtaatttctttctcaaattctgacttagtgtctaattcttctcattcctgtaaatttctttagggtgnttttgnggtttacctatcatttcattctctgccctagaacaataacgcaataaatgtttgtcaataaaggaaagaatggataaaagaatgatggaggaaggcttataaaatgtgtcaattagtgtcttaattaataggcaatagagtaaaccatttaagattctgacagaactttacttgat

SEQ ID NO: 25316 - DNA, 497 bp, Homo sapiens
  misc_feature 454: n = A,T,C or G
cttgaaaagttagagaagtccaaaaagacttttcttgataaggacgcacaaagattgagtccaataccagaagaagttccaaagagtactctggagtcagaaaagcctggctctcctgaggcagctgaaacttctccaccatctaatatcattgaccactgtgagaaactagcctcagaaaaagaagtggtagaatgccagagtacaagtactgttggtggcagtctgtgaaaaaagtagacctagaaaccctaaaagaggattctgagttcacaaaggtagaaatggataatctggacaatgcccagacctctggcatagaggagccttctgagacaaaggggtctatgcaaaaaagccaattcaaatataagttgggtcctgaagaaagaaaccactgcctcagaaaatacagagataacctctgaaaggcagaaagagggcatcaaaattnacaatcaggatatcaagtcggaaaaagaagcccgatctccccc

SEQ ID NO: 25317 - DNA, 500 bp, Homo sapiens
cttaaccagctcccatagttatataaggtcaaattcctgtaataaattccatgttctatacaattcctaatggtttgtattgttattattttttattaaatcttgatatacaatttgctgctactaagccatgtagtaggagctttgggactgagcttgagtgtaagttagaagggccttgaagagactgttaacaggagcctaatgtcacttcaggaagctattggtgaaggtttaaacaaggtgagagatattattggaagctggaagaaaggtgactcttgtgacatagtaagcagaaattttagcaatgctggaaatttattttccatgaaacagtggaaaataagtatagctcaactggatgatctcactaaagagatttctaggcaatgtcaaaggtgctatctggattcttctagcccctatagcaaaagacaaaaggagaaaggcaagcaagataaaaaattggtccgatataaaggagccacaactttttg

SEQ ID NO: 25318 - DNA, 497 bp, Homo sapiens
  misc_feature 22, 37, 404, 446: n = A,T,C or G
aaaaagacccaaggaaaagggncattgaaagatgacntttaggctaagcttagaatgattggtgggattttgagaaccagaaaggggaggggagagcattcagcaaagcagatggctaaaaatacggaagtaagaacaaacctggtagaggagggagctaagaagaaaccagcctgattggaggaaatggaatatggagggagtagtatcaaagaaggttaaatataggccaagtgcagtggctcatgcttgtaaacccagcattttgggaggccgagataggtggatcacttgaggtcaggagttcgagaccagcctgcgaatatggtgaaacctcatctccaacaaaactacaaaaaattagccaggcatggtggcacgtgcctataatcccagctactcangtggcttgaagcaggagaatcactttgacctgggaggtggangttgcagtgaaccgagagctgagatggcccacttctcttcagcctggtgac

SEQ ID NO: 25319 - DNA, 498 bp, Homo sapiens
  misc_feature 2, 8, 379, 437: n = A,T,C or G
anaaattncccctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagatttttttccatgactgcattttactgtacagattgctgcttctgctatatttgtgatataggaattaagaggatcacacgttggttcttcgtgcctgttttatgtgcacacattaggcattgagacttcaagcttttctttttttgncacgtatctttgggtctttgataaagaaaagaatcctgtcattgtaagcacttttacngggccgggtggggaggggtgctctgtggtcttcaattaccaagaattctccaaacaatttc

SEQ ID NO: 25320 - DNA, 500 bp, Homo sapiens
  misc_feature 4, 23, 31, 389, 419, 445, 465: n = A,T,C or G
cttntgctgagggggcaggcggncttgaggnttccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttaggattaaaatgaaggtgacttaaacagcttaaagttagttaaaaggttgnaggtgattaaaataattggaaggcggatcnttttaaaaagaggatttaaccgaggngattaaaagaccttgaaatncatgacgcagggaggaattgcgcatttaaagccta

SEQ ID NO: 25321 - DNA, 485 bp, Homo sapiens
  misc_feature 2, 24, 322, 378: n = A,T,C or G
tncagtccgttgctttactttttncttcaccgacatagtcattatgccgaagagaaagtctccagagaatacagagggcaaagatggatccaaagtaactaaacaggagcccacaagacgatctgccagattgtcagcgaaacctgctccaccaaaacctgaacccaaaccaagaaaaacatctgctaagaaagacctggagcaaagattagcagaggtgctaaagggaagaaggaggaaaagcaggaagctggaaaggaaggcacagaaaactgaatctgtagataccgagggagaatgaattgtcatgaaaaattggggntgaatttatgtatctcttgggacaacttttaaaagctattttaccaagtattttgnaaatgctaattttttaggactctactaggtgggcatatgaaaatatataaggatggacattttatcgctcatagtcatgctttttggaaatttacatcatcctcagt

SEQ ID NO: 25322 - DNA, 482 bp, Homo sapiens
  misc_feature 5, 13, 422, 449, 480: n = A,T,C or G
tggangtgagganccatagataggcttgatattttacttttctttctttcctgcaggctctcaaagatattttttctccttaagtttgagcatatttcatgtaaataaaagggatcccaaagagcatcttgtgcgaacccttggctcaagacaacccaacctaaaattcatctagatcacctggacttttacgttgaaaggatttttcccccagaataggacatttgtttcccatctattctggcttacaatactgaagagtcccagtccatatttatgaaggaagcagccttaaagtgttaccatgaacactttataaacaggcattgtgggcctttgaaaagaaagctgctgatgtctgagttttatgggagcctagccagctgtttaagtgttcttcttaacacttaagtatattttgnaacagaagaaaaatgaaaattagtatntctgcgcttcataattatcatattaaagagntg

SEQ ID NO: 25323 - DNA, 280 bp, Homo sapiens
  misc_feature 11, 13, 236, 239, 251, 273: n = A,T,C or G
gaataaaaccnanatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcangtntccaaccaactnggttctgcttcaataaatcttnggaaaac

SEQ ID NO: 25324 - DNA, 271 bp, Homo sapiens
  misc_feature 47, 48: n = A,T,C or G
gacctcaagataacatttttcattaaagcatctgagatctaagaacnnaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaat

SEQ ID NO: 25325 - DNA, 500 bp, Homo sapiens
  misc_feature 4, 31, 49, 474: n = A,T,C or G
cggnatctgctttgcaatcccatctgataanattaaaaagttcctcacnttagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggccgcaggggtaatgaagatatcatgatcacagtgattcccgaagaaattgacccatagcagaggcacgagctggacttcatgtttcccttcaaagactctccgtggatgacggatgaagactctgggctgctggnataggacactcaagacttttgactgc

SEQ ID NO: 25326 - DNA, 396 bp, Homo sapiens
  misc_feature 4, 20, 58, 60: n = A,T,C or G
aaanttaacccattaatgcnaacagtacctaacaaacccacaggtcctaaactaccantnctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaaccgattaaagtcctacgtgatctgagttcagaccggagtaatccaggtcggtttctatctacttcaaattcctccctgtaccga

SEQ ID NO: 25327 - DNA, 250 bp, Homo sapiens
  misc_feature 27: n = A,T,C or G
cactttgggaggccaaggtgggtggancacctgaggtcaggaatttgagaccagcctggccaacacagtgaaaccatgtctctactaaaagtctaaaaattagctgggcgtggtggcatgcgcctgtaatcccagctactcaggaggctgaggcaggagaatcgcttgaacccggggaggcagaggttgcagtgagccgagatcgcgccactgtactccagcctgggtaacaagagcgagactccatctc

SEQ ID NO: 25328 - DNA, 250 bp, Homo sapiens
  misc_feature 5, 16, 224: n = A,T,C or G
gttgncagtatctatngaaactggactaggtactgtgggttaatacatggtgactacttttcagaaaaagctaggtctagttgaggggagaaaatatacataaataaaaattaaatatttgagttctcaatttttcaaaaatggataccactagaaatcgtactttaaagaaaataatcttgaaaaaatgtgtattttcctgctagaacatgatgagtgattgnacatgagagtaaatgcagcaagaaat

SEQ ID NO: 25329 - DNA, 167 bp, Homo sapiens
tgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctg

SEQ ID NO: 25330 - DNA, 468 bp, Homo sapiens
  misc_feature 5, 162: n = A,T,C or G
tattntcccgaggaagacgcggtcgtaagggctgaggatttttggtccgcacgcttttgctcctgactcaccgctgttcggctctcgccgaggaacaagtcggtcaggaagcccgcgcgcaacagccatggcttttaaggataccggaaaaacacccgtggngccggaggtggcaattcaccgaattcgaatcaccctaacaagccgcaacggtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaag

SEQ ID NO: 25331 - DNA, 429 bp, Homo sapiens
  misc_feature 4, 24, 54, 55, 57, 60, 85, 100, 110, 128: n = A,T,C or G
atcngggtatatattcaagatttntggcagcattcagcatgtatatttataagnngngancctgtacagaagtgccctggaaganggcctgctctaaatnatccagtgtntggagaaacgacacaggngaggagacgcgctttgaacgtgctataggaccttctcaaacacacaccatcagaattcaatattcacctgccagactgcttatcaagacaaaggtgtccttcataatgaagttaaagtgagtatactgtggaagaggacttccaaatgtggtacctcaagctatatcactgcccaacatcaagaaaacctgacggctatgattactatgccttttctaaagatcaatactataacattgatgtcctaggagaacaagcaagagcaattactactcgttctgggcagaccttatccaaagtc

SEQ ID NO: 25332 - DNA, 289 bp, Homo sapiens
  misc_feature 19, 26, 37, 53, 57, 76: n = A,T,C or G
cttttttattttatgtagngtgtgangcttttcaagngacccggtccattttntggnagatacagccatccacctncagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgccaac

SEQ ID NO: 25333 - DNA, 101 bp, Homo sapiens
tagcaataaacgaaagtttaactaagctatactaacctcagggatgggcaatttcgtgccagccacggcggtgacacgattaacccaagtcgatagaagcg

SEQ ID NO: 25334 - DNA, 166 bp, Homo sapiens
taaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagc

SEQ ID NO: 25335 - DNA, 409 bp, Homo sapiens
aagtgccgaatgttattagaatcaacattgcatccttcttgcttatacgttaagttacataaaaggaaaacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtaggattaagtctcagaatggacactacaaatgccagctctcaccagatggcctacgtgtttgaactgccatagtcagtgtgtgtgtgtgcatttatgtatgctctgtggctacatatacacacacgtatttccttgagataaacaagataaacactaggtgcttttgaatttttttcacttccctttatagttttgggaaaggagtg

SEQ ID NO: 25336 - DNA, 446 bp, Homo sapiens
  misc_feature 2, 44, 390, 426: n = A,T,C or G
gngtggatcaatagtagttgtttttccttttttgtttttttctnttatgactgagtgatactctgttgtatggagtatgccacagttagtttatcccttcactagtagaagatcctgtacactgtttctaatttgggggattataaataaagctgctgtaaacatttatgtcatttatgtacagattttcatgtggccgtacattttcagttcattttggtaaatacttagaagtgggattgctaggacatgtagtaggtgtatctttaacttttttagaaacctgcagacttttctgaagtggttgaccgttggaaatggctatgccattgctctgcaccagacttgggtgttgcagggttttacttatttgcacaattctaatagggngctagggggaccacactgtggttttaatttgaactnctctaatgactggatgatgt

SEQ ID NO: 25337 - DNA, 335 bp, Homo sapiens
  misc_feature 4, 11, 54, 334: n = A,T,C or G
ccanacttaanagtagaattcaagatccagcaaaactatccttcaaaactattngaaaggatgagcatggtggctcacacctgtaatcccagtactttaggaggctgaggcaggaggattgcctgagcccgggaatttgagaccagcctgggcaacatggcaaaaagccatctctacaaaaaatacaacaaactgctgggtgtggtggcatgtgcctgtggtcccagctactcaggaggctgaggcgggaggatcacttgagtctggcaggttgaggccttgattgtgtcactgcactcctacttgggtgacacaagtgagacaccctcaaaant

SEQ ID NO: 25338 - DNA, 468 bp, Homo sapiens
  misc_feature 1, 2, 59, 61: n = A,T,C or G
nnaaagtcccgctgacctctctgaggctgccaacccggaacaatgacgccctgcgccantnaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgctgcaggatgagattcagaatatgaaggaggaaatggctcgtcgccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttcttgattaagacggttg

SEQ ID NO: 25339 - DNA, 452 bp, Homo sapiens
  misc_feature 3, 16, 46: n = A,T,C or G
ganggaagctgccgcngtagttggagtctaaggactcgtgacattnttcgggtgcccttcgagagaaaaggggaggatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgtcagaaaaattacaaccactgctggatagtctggagcagcttagtgtgtctggggcagaccgaccaccttctatctttgagtgccagctacatctttgggatcagtggtttcgaggctggctgagcaggagcgcaatgaatttgtcagacaagctggagttcaagtgagccagacttc

SEQ ID NO: 25340 - DNA, 466 bp, Homo sapiens
  misc_feature 55, 57: n = A,T,C or G
aaacatccggagccaaagacaatgaacttagacagaagaagaaggagcttcttgntngaaaaaccaagaaaagacaactggaacaaaaaatcagttccaaactaggaagtttaaagctgatggaacaggatacttgcaatcttgaagaggaagagcgaaaagcaagtaccaaaatcaaagaaataaatgttcaaaaagcgaaacttgttaccgaattaacaaacctaataaagatttgtacttctttgcatatacaaaaagtagatttaattctccaaaatactacagtgatctctgagaagaacaaattagaatcagattatatggccgcatcttcacaactccgtcttacagagcaacatttcattgaattggatgaaaatagacagagattattgcagaaatgcaaggaacttatgaaaagagctaggcaagtatgtaacctgggtgcagagcaagactcttc

SEQ ID NO: 25341 - DNA, 150 bp, Homo sapiens
ataaatccaagaagcgttcaactctttgcctgtcctggcctttactggatcccaaaagcatttaaggtacatgttccaaaaactttgaaaagctaaatgttccccatgatcgctcattcttcttttatgattcatacgttattccttata

SEQ ID NO: 25342 - DNA, 327 bp, Homo sapiens
  misc_feature 58, 89, 286: n = A,T,C or G
aatcgtcccctccggttcctgggctcctaattcttggtccagcttcttccaggtcttngcgtctgttgttcccagcgctctgcgaagcntgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaggaagttagaaaacgaggnaaagacagaaaacaagggcaaaacaggagatgaggaaatgt

SEQ ID NO: 25343 - DNA, 438 bp, Homo sapiens
  misc_feature 3, 10, 27, 28, 41, 385, 388, 389: n = A,T,C or G
ganggggcangcggagcttgaggattnngcagataagtttntttctctttgaaagatagagattaatacaactacttaaaaaatatagtcaataggttactaagatattgcttagcgttaagtttttaaccgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagccgccngcnnccaaaataatttgaaggcgatcttttaaaaaagagattaaaccgaaggg

SEQ ID NO: 25344 - DNA, 451 bp, Homo sapiens
  misc_feature 7, 46, 49, 392: n = A,T,C or G
tgtaggngactgagtgaggaactaaatgagttaatactcagagtanttncttgcaccatagaatacgtacataatccatacaagatggatgtaatgtatgtattatgaaaagtagcacaaatgggcacaaggtggctacagtgtgtccaggctttgtttcagtgccttttttttagaggcaaagcagctttcccaggggccttctgtctactttccctgtcatctcattgaccaacgttgagtcacaagtccttttcgaaattagttatgtacaaagggaatggctgtctctggtggcttggctaattatttggggaggaatggttggtgaggaattaagcacttcagccactattattacttgtaacaataatatctataatatataatgnaatatcattatatttcaaatgtaatactaagttatacaaaattattaaaaagcaacaat

SEQ ID NO: 25345 - DNA, 423 bp, Homo sapiens
  misc_feature 3: n = A,T,C or G
canggggtagtgttttttgtccctgtcttgccgtagatattgacaaactgaagctttcctgcaccactggacttaaggaagagtgtactcgtaggcggacagctttagtggccggccgccgctctcatcccccgtaaggagcagagtcctttgtactgaccaagatgagcaacatctacatccaggagcctcccacgaatgggaaggttttattgaaaactacagctggagatattgacatagagttgtggccaaagaagctcctaaagcttgcagaaattttatccaactttgtttggaagcttattatgacaataccatttttcataagagttgtgcctggtttcatagtccaaggcggagatcctactggcacaagggagtggtggagagctatctatggagcgccattcaaagatgaat

SEQ ID NO: 25346 - DNA, 464 bp, Homo sapiens
  misc_feature 59: n = A,T,C or G
taaaaaaacctttatcatgaccaagcgggatttattccagttacgcaaggatggttctncatatgcaaatcaatcaatgatacatcatatgaacacaaggacaaaaacgatatgattatttcaatttttgctgaaaaagcatttcataaaattcaacatcctttcatgattaaaaacccacagaaactgtgtatacaaggaatataccttgacacaataaaagccatatatgacagacccacagctaatatagtgaaggggaaacacctgaaggttttctccctacaatctgaaatgagacaaacatgctcactttcaccactgttattcaacatagtactggaagtcatagctagagaaatcagacaagagaaagatataaagggtatccaagttggatgtcaaattatccttgtttgcagatgatcgatcttatatttggaaaaatctaaagactctccaat

SEQ ID NO: 25347 - DNA, 265 bp, Homo sapiens
  misc_feature 8, 16, 100, 102, 109, 201, 231, 240, 256: n = A,T,C or G
tggctatnccatatgncttctgcataaggaattaactagaaataactttgcaaggagagccaaagctaagacccccgaaaccagacgagctacctaagananagctaanagagcacgcccgtctatgtagcaaaatagtgggaagatttataggtagaggcgacaaacctaccgagcctggtgatagctggttgccaaganagaatcttagttcaactttaaatttgcccncagaacccnctaaatccccttgtanatgtaactg

SEQ ID NO: 25348 - DNA, 191 bp, Homo sapiens
  misc_feature 28, 61: n = A,T,C or G
tgctgagggggcaggcggagcttgaggnttcgcagataagtttttttctctttgaaagatngagattaatacaactacttaaaaaatatagtcaatagggttactaagatattgcttagcgttaaagtttttaacgtaattttaatagcctaaagattttaagagaaaatatgaagacttagaagagtagc

SEQ ID NO: 25349 - DNA, 230 bp, Homo sapiens
  misc_feature 48, 224: n = A,T,C or G
ctgctatgaaaaaacgacatttggaaattctggggtatcgtgtaattnatgatttcccagtttgaatggaactctatggcactgtcaacaaaggatgctcggatggactacctgagagaatgtatatttggagaagtcaagtcatgtttgtagtttttatttaaaatgaatgttatcgtgtgttacatttggacctattttaataaagtggcctgtctcaattnaaaaat

SEQ ID NO: 25350 - DNA, 434 bp, Homo sapiens
  misc_feature 8, 9, 37: n = A,T,C or G
accgattnncagagaagaaacaggggcttgaaatttnctatttgccacatcttctagctacgtgaccttggacaatcatgattttggctgaggcttcagattctaaacttttcccgtactttatggaaaaaaaggaacttgttttagatttggatatacaaaacatgagttgcctttgggcatttaggtagaagcaaaaggagatgattatttagaacattaaatttggaaaacgctagaactcaaacttggctgacactattaactatgggtcttagagatattattttcccaacactcaattttctcattttgaaaaaagaccaataactaagcagttactttgcttactgctgtgctgtctcgatgcattatctcatttaattctcaagaagaacttcattaaataaattctaacaagaagaatgcccggt

SEQ ID NO: 25351 - DNA, 467 bp, Homo sapiens
  misc_feature 8, 17, 42, 60, 65, 130, 376: n = A,T,C or G
taataggnccggttggntttgatgggtcgagcttgtttgtgnccctgtgggtggacgttnttggngattggcaggatcctggtatccgctaacaggtcaaaatgcagatcttcgtgaaaacccttaccgncaagaccatcacccttgaggtggagcccagtgacaccatcgaaaatgtgaaggccaagatccaggataaggaaggcattccccccgaccagcagaggctcatctttgcaggcaagcaagctggaagatggcgtactctttctgactacaacatccagaaggagtcggaccctgcacctggtcctgcgtctgagaggtggtatgcagatcttcgtgaagaccctgaccggcaagaccatcaccctgnaagtggagcccagtgacaccatcgaaaatgtgaaggccaagatccaagataaagaaggcatcccccccgaccagcagaggctcatctttgc

SEQ ID NO: 25352 - DNA, 428 bp, Homo sapiens
  misc_feature 1, 61: n = A,T,C or G
naaatagacccgaaacccaagtccaaacccaggacttcctgcttaaagccccttctttttnaaaaactacattacctattgattattttgctttacatgtgcttacatgttgatcttcctcagtggactgccttcattccttaataggaaataaattgtcttttttggaggtgttacatttttgcatataacattaataagattaaaattttcatttgttgttgacattctttgcttgactctacactccacgggataggatccttgggcatagaaaccacgaatgctttgctcatcactgaatccagcatctgtcagtgtctgccatataggaattgctcaatatacatttttgagtaaataactgaactaacaaatgagtgaacaaaataacaaatgaataaaaaacctcagatctagcccctaac

SEQ ID NO: 25353 - DNA, 311 bp, Homo sapiens
  misc_feature 9, 49, 99, 102: n = A,T,C or G
atgacatgngctgtcccgattatgagagtttctgtgcagaagtgcattntcccacatcaccaccatcttcaaagaaagcacctccaccttcaggagcanctnaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcggaaaatcaagtcttccaaaaattcagctgctaatagagaattacagaag

SEQ ID NO: 25354 - DNA, 278 bp, Homo sapiens
  misc_feature 63: n = A,T,C or G
gccaacgctatcaggccagcgttttaaaactagaaaaagagatgaaaaagagaggtttgaccntactcagtttcaagactgtattattcaaggcttaactgaaaccggtctgatttggaagcagtagctaagtttcttgatgcttctggagcaaaacttgattaccgtcgatatgcagaaacactctttgacattctggtggctggtggaatgctgccccaggtggtacactggcagatgacatgatgcgtacagatgtctgcgtgtttgcagcccaa

SEQ ID NO: 25355 - DNA, 453 bp, Homo sapiens
  misc_feature 30, 429: n = A,T,C or G
gcagaaaaggcctttgacaaaattcacgtngcccttcatgctaaaaactttcaataaactaggtattgatgggacgtatctcaaaataataagagctatttatgacaaacccacagccaatatcatactgaatgggcaaaaactgggagcattccctttgaaaactggcacaagacagggatgccctctctcaccactcctattcaacatagtgttggaagttctggccagggcaatgaggcaggagaagcaaataaagagtattcaattaggaaaagaggaagtcaaattgtctgtgtttgcggatgacatgattgtgtatctagaaaaccccattgtctcagcccaaaatctccttaagctgataagcaacttcagcaaagtctcaggatacaaaataaatgtgcaaaaatcacaagcattcctatncccaatgacagacaaacagaggcc

SEQ ID NO: 25356 - DNA, 129 bp, Homo sapiens
accatggtgaccacgggtgacggggaatcagggttcgattccggagagggagcctgagaaacggctaccacatccaaggaaggcagcaggcgcgcaattacccactcccgacccggggaggtagtgacg

SEQ ID NO: 25357 - DNA, 252 bp, Homo sapiens
aaacaatcctgcacattacaggcttatttataaagcttgttttatctaaactaagattttgtttatataattgaattttttgtgatttctgtagacattctatctagatgtttgaaaaataatctttggctttgcacaaacaaaatgatggctaaagttttcttgtggtgtcacatagtcacagtcttatacatgctttttttctgatttgtactaaatttttaagaaaaatatatttcccactaaattccg

SEQ ID NO: 25358 - DNA, 445 bp, Homo sapiens
  misc_feature 2, 3, 43, 265, 279, 432: n = A,T,C or G
gnnaagctggacaagccggataactggggtcatggccatgggnttggagaagactgtgctgggttgatttatgctgggcagtggaacgatttccaatgtgaagacgtcaataacttcatttgcgaaaaagacagggagacagtactgtcatctgcattataacggactgtgatgggatcacatgagcaaattttcagctctcaaaggcaaaggacactcctttctaattgcatcaccttctcatcagattgaaaaaaaaaaggcnctgaaaaccatttnctgaaaaaaaatggacggctggggttttttaccatccgcattcccaaagacttgggaactaaaatgttccccagggggatatgctgatttcattgggcacatggactgaatcacatagatctcctccgcagaaccgggcgattatacaaattntgttttccaaagt

SEQ ID NO: 25359 - DNA, 462 bp, Homo sapiens
  misc_feature 5, 23, 59: n = A,T,C or G
aaatnggccccggcactgcgcanaccagacttcgctcgtactcgtgcgcctcgcttttnttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgcttcttattttacttcttttagctgtttaactttgtaagatgcaaagaggttggatcaagtttaaatgactgtgctgccctttcacatcaaagaactactgacaacgaaggccgcgcctgctttcccatctgctatctatctggctggcagggaaggaaagaacttgcacgttggtgaaggaagaaagtggggtggaagaagtggggt

SEQ ID NO: 25360 - DNA, 210 bp, Homo sapiens
  misc_feature 15, 23, 28, 49: n = A,T,C or G
ataaagctgatgtcnaggacctntagangggtttaattcccaatctganttgagccctgactgcctttgttttggaaatcagcactaggttttaaatgacaaaattgtaggaaaattacatctaaattctggtaaactcttgctttaagatcttttttaaaaaaatgactaaattgattttttctttgcattgttttggttaagctctgt

SEQ ID NO: 25361 - DNA, 405 bp, Homo sapiens
  misc_feature 12, 28, 400: n = A,T,C or G
aagagagaaacngaggaccaagaagcanaggaaaaaacagaaagcaaataataaaatgtcaaacttaaaggctaacatcaataattactttaagtgtaaatagcctaaataagccaatcaaaagaaaaaatgcattaaaaaaaaacccaactatatgctgcttacaagaaactcacttcaaaatcaataagaggtatgttgaaagtaaaaggatggaaaagaatatatcatgcaaacagtaatttaaaaaataaaggcaggggtagctatattaatatctgatgaaggtagggagtaaagaaatttactagggacagagtaagacattatgtactgataagatattcaactcaccaggaagacctaatgatcctaaatgttcatgccccagacaacagancctca

SEQ ID NO: 25362 - DNA, 447 bp, Homo sapiens
  misc_feature 3, 7, 57, 377, 404, 440, 442: n = A,T,C or G
tanaatnccttccatgaaaactacaatgcaggcacttaccaaaatgacatcgctttnattgaaatgaaaaaagacggaaacaaaaaagattgtgagctgcctcgttccatccctgcctgtgtcccctggtctccttacctattccaacctaatgatacatgcatcgtttctggctggggcgagaaaaagataacgaaagagtcttttcacttcagtggggtgaagttaaactaataagcaactgctctaagttttacggaaatcgttctatgaaaaagaaatggaatgtgcagggacatatgatggttccatcgatcctgtaaaggggactctggaggccccttaagctgtatggatccaccaatgggcctatgctngggggttgggagtgggggggaaactgnggaaaccaaagtccaggtgttacaccaagtggccantntttgc

SEQ ID NO: 25363 - DNA, 126 bp, Homo sapiens
ctcagagctgttgcacagacagagattgtacttggtaagataccaaacaagacagatatggatctaaatttctaatgtgttctatgggtttcaattctgaaaaaagaaaatgaataaagattttaa

SEQ ID NO: 25364 - DNA, 232 bp, Homo sapiens
  misc_feature 16: n = A,T,C or G
aactataaacttatancttcagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttatt

SEQ ID NO: 25365 - DNA, 461 bp, Homo sapiens
  misc_feature 1, 3, 57, 429: n = A,T,C or G
nanttaacccattaatgcaaacagtacctaacaaacccacaggtcctaaactaccantcctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggtcgtttgttcaacgattaaagtcctacgtgatctgagtcagaccggagtaatccaggcggggttctatctacttcaaattcctcctgtacgaaaggacaagagaaataagggctacttacaaagcgccttnccccgtaaatgatatcatctcaacttagtatt

SEQ ID NO: 25366 - DNA, 389 bp, Homo sapiens
  misc_feature 57: n = A,T,C or G
aaaaagcccctgtgggcgacataaatacagaacggcccgggatgttggacttcacgntcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttggtacttt

SEQ ID NO: 25367 - DNA, 419 bp, Homo sapiens
  misc_feature 14, 35, 60, 62, 296: n = A,T,C or G
taaacagacccgcnaaggaagtttatgaatgtagnacctcgcaaagtgataagttatttntnagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggntttaaattatctttgtattatgtgcacatggttattttttaaatgaggattcactgacttgtttttatattgaaaaaagttccacgtattgtagaaaacgtaaataaactaatatagactatt

SEQ ID NO: 25368 - DNA, 462 bp, Homo sapiens
  misc_feature 10: n = A,T,C or G
aaaaaatccntttagttcatggtacaaaattcccaccccaagtgctttctgttttatttagcctcatacctctaaatgactgaccagtaaataaactattaagctgagaatattgagtgtcaagcagacattatctacagatttgctgagcactgaatgtttgaaaccagttgggccttgtgaaatatttctgcaatttagagcagctattcagtatccttgagttacaatataggaggctgttttattttattttgccttagttggtagcatgcatatcctactgaagaaggaggcaaaatgtatcaattattgctaagcataatagtagtttacttttactaaactaagtattaagtgatgtatttatatagagtactttaggaattcattaaaggttatattatcacattttatcatgaattctcaaagggtaggttttattatcccagtttataggat

SEQ ID NO: 25369 - DNA, 464 bp, Homo sapiens
  misc_feature 27, 55: n = A,T,C or G
aattgccccagccagcgctggggcttntgctgagggggcaggcggagcttgaggnttccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagctcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaagggcgatcttttaaaaagagattaaaccggt

SEQ ID NO: 25370 - DNA, 459 bp, Homo sapiens
  misc_feature 434, 446: n = A,T,C or G
ataatctcccataattttccacttaataactgtaaagtttttttctgttaatttaggcttatagaatattaaattctgatattgcacttcttattttatataaaataatcctttaatatccaaatgaatctgttaaaatgtttgattccttgggaatggccttaaaaataaatgtaataaagtcagagtggtggtatgaaaacattcctagtgatcatgtagtaaatgtagggttaagcatggcagccagagctttctatgtactgttaaaattgaggcacatattttcttttgtatcctgcaaatactcctgcaggccaggaagtataatagcaaaaagttgacaaagatgaactaatgtattacattaccattgccactgattttttttaaatggtaaatgaccttgtatataaatattgccatatcatggnacctataatggngatatatttggtt

SEQ ID NO: 25371 - DNA, 422 bp, Homo sapiens
  misc_feature 5, 7, 406: n = A,T,C or G
aattntncctatccagactaataaagctatcagttgagggatttgcagttgataaattggctggagaggttagggctttcttcgagagtcacccagctccttcagctgagcgtaccatccagcagtgttgtgaaaatattctgctgaatgctgcctggctaaagcgagatgctgagagcatccaccagtacctccttcagcggaaggctcaccacccacagtgtgaatcctgaggtgccgcattggcggttctgctgcttcgctgcagggataaggtggagctaccgaacagctgattcatatgccaagaatttggagtcttctttcaaaccagtgggggttggacaatgaatgtaggtaactgggtcctgctcacactccagaattaaattctattgaaaaaggnaaatcagcaattcaac

SEQ ID NO: 25372 - DNA, 462 bp, Homo sapiens
  misc_feature 1, 7, 35, 56, 59, 377, 444, 455: n = A,T,C or G
naattgncccggccagcgcaggggcttctgctganggggcaggcggagcttgaggnttncgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggttctaaaacatgacggaggttgagatgaagcttcttcatggagtaaaaaatgtatttaaaagaaaattgagagaaaggactgcagaccccgaattaataccaatagaagggcaatgcttttagattaaaatgaaggngacttaaacagcttaaaggttaagttaaaagtgtaggggattaaataatttggagggcgatcttttnaaaagagattnaaccgga

SEQ ID NO: 25373 - DNA, 339 bp, Homo sapiens
  misc_feature 5, 24, 25, 52, 57, 58, 331, 339: n = A,T,C or G
taatngacccagccagggcagggnnttctgctgagggggcaggctggagctngaggnntccgcagataagtttttttctctttgaaagatagagattaatacaactacttaaaaaatatagtcaataggttactaagatattgcttagcgttaagtttttaacgtaattttaatagcttaagattttaagagaaaatatgaagacagaagtacgggaaggcgaagaaaagaatagagaagatagggaaattaggaagataaaaacatacttttaggaagaaaaaagataaatttaaacctgaaaagtaggaagcaggaagaaaaaagacangctagggn

SEQ ID NO: 25374 - DNA, 461 bp, Homo sapiens
  misc_feature 10, 57, 59, 427, 457: n = A,T,C or G
aaagggcccnattgagtttaccaacttatttacatgacatttctctatattggtgantnatgcaatgccattttgttacataaagttgtttgatgttttttaatatgccttcatataaatattttattcaatatgttgtatttgtgaatttaacaaatgatattaaacacaaactacaatgcagacagacaaactctttgtatgcaaattagcaatacataccaacagttcttgatacacaggtacctactacatgcagctcatcattgctgcctcttcccatgctacaggtgagaccagcacaaagtaaatgacctaactcaattacaaataacaaggacccctctgcaatatgtctaaacatatattagaaggaaagtatttgacatccttcatagggataaatgcccttatagaaccccatatnttaaacacaacagggatccacatttacatnaatc

SEQ ID NO: 25375 - DNA, 457 bp, Homo sapiens
  misc_feature 7, 16, 56, 439, 447, 450: n = A,T,C or G
aaaattnccacctggngactttgtggtgcactcacctctgatagtgacttgaattntgtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgcttgatttgattgcaggtttttcctaattataacaaattttcctcattggcctgtttttaatcctgtgcctagaaggagtcaaaatgcacactttacaaaattgatatttaacacttacccactcccctttncccatctnttntaccgtc

SEQ ID NO: 25376 - DNA, 134 bp, Homo sapiens
aagtttgaagaagtaggctgggcacaagtggctcatgcctgtaatcttagcactttgggaggccgaggtgggcagatcacgaggtcaggagttcaagaccagcctggccaacatggtgaaacaccatttttact

SEQ ID NO: 25377 - DNA, 462 bp, Homo sapiens
  misc_feature 36, 58: n = A,T,C or G
aaaagaacccaagggggaattggtggtgttagacangcaacttttattgaagtgacanttgtatagcagcagcagaggtactgttctttgtggagcagggctaacctataggcagtgtgcctaaagcagtagctcaggaacagttctgcagtcatatttatacccacttttaattacatgcaaatgaagtggtgtattcagaaatttctagaaagggggtggtaacttctgggtattaccatggcaatggtaaactgtcatggtgctggtgggtgtatcttatggagtggtgctttcagcacctcttccctgtttcagccagtctttagtctggccagagttgagtcctgccccttacctcagagagacatagtacctgtaaattccatgggaaatttagcttcccagagaaattcacagaaattgaaattctactacacagtaaaaatggtagcctcttgt

SEQ ID NO: 25378 - DNA, 152 bp, Homo sapiens
ctgaagtacaagggaagaaatgtaaatctataaattgggttaaatgatttctaggaaagtgtataataataataacaattatttttttgagacagagtctctgtcacccaggctggagtgaaactgtgtctcaaaataaataaataaataat

SEQ ID NO: 25379 - DNA, 242 bp, Homo sapiens
taagtggccctataaaattctaactttacatgtattttgttattagaaattttcttttattgaatgagaaaaattagtctatcattttaagagccaatatggcaaacactttcaaatactgtatattaggaaactgttttggtattcttgatggaaaaaaatgcagcggaaatgtcattatgaacagatgttaaataggaaattgttacttgttaacttcttacagcagtagtaccttcttt

SEQ ID NO: 25380 - DNA, 152 bp, Homo sapiens
tcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagat

SEQ ID NO: 25381 - DNA, 461 bp, Homo sapiens
  misc_feature 10, 57, 385, 461: n = A,T,C or G
aaaggagccnacatggcagcgcgttggcggttttggtgtgtctctgtgaccatggtntttggcgctgctcatcgtttgcgacgttccctcagcctctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattaagagtttgcacttattccatttgacctaagagaaaaataggctcagttagaaaaggactccctggccaggcgcagtgacttacgcctgtnatctcagcactttgggaggccaaggcaggcagatcacgaggtcaggagttcgagaccatcctggccaacatggtgn

SEQ ID NO: 25382 - DNA, 460 bp, Homo sapiens
  misc_feature 6, 9, 35, 57, 86, 397, 440: n = A,T,C or G
gaaaanccnataaggttgaactctgtataagtacntacagtagttatcattcttgtnctatagctatctgaagtccaactggaatnaccagtcaaaactgacaccaaaaccagtaggtgagggaaataacacaaaaaccagtaggtgagggaaacctaagaagctgaactgaattctcgaattatatcttatgttagtctcataaagctttattttataaattattcttataaacaaactataattcaaattgaatcaagtcttaagttctcagttgatcactgcaaactccgctccacagctcaagcagtctttctacctcagcctcccaagtagctgagacgacaggtgcctgcctgtcactatgtctggctttttatttttatttttatttatnttttggatttttagtaagagatgggggttcaccctgttgccangctggtctcaaactccttag

SEQ ID NO: 25383 - DNA, 458 bp, Homo sapiens
  misc_feature 56, 159: n = A,T,C or G
taaaagccctggtgctttgtaaatttcactccgtgtttctgtctcagaaagggcanttttatacctgtggtcatggtcctggagggcgattaggacatggagatgaacagacatgcttggtccctcggcttgtggaaggactgaatggtcataattgtncccaagtggcagctgctaaggatcatactgttgtattaactgaagatggatgtgtttatacatttggtctaaacatttttcatcaattaggaattattccaccgccttccagttgtaatgtacccagacagatacaggcaaaatatctgaaaggaagggacaatcattggcgttgcagcaggcaggtttcatacagtcctatggactaagagaagctgtttacactatgggactaaatggtgacaactgggttggttgctagatcccaatggagaaaaatgtgtactgctcctcgcagg

SEQ ID NO: 25384 - DNA, 463 bp, Homo sapiens
  misc_feature 1, 7: n = A,T,C or G
naatggntcccttttttattttttgtaggagatggggtctttctatgttgcccaggctgttctcaaactcctggcctcaagcagtcctcccaccttggcctccaaaagctctgggattacaggcatgagctaccatgcctgacctattctcacttaggagcatagatgataaattctgaaaagtttagcagtatcagaaattttcagatatggagaaagaggagttctcaaactgctagtttgagtataaattggtataaccacttttgagagcagtttaccaatatctagtaaaattaaagatgcttagactttaaaacctagcaattctaaatatatagtctaaagacactctcatgtatccacaagaattcatgacaaatacacaacattgcaaaattataagaataaaggaaaaataaaaccttagtattcatcagcagaagggtggatatatgctcta

SEQ ID NO: 25385 - DNA, 324 bp, Homo sapiens
  misc_feature 1, 4, 59: n = A,T,C or G
nganaaaccccgccccaatttcacttatattttgctaagcagatacacatttgccatgncagcttaaagtgtcggtgcttttgaatggagactattttatctcgatgtatctgtaactggagagtcctcatgctcaggactggtaactcagattttgttttgaaggaactaatttttaaaaaaatctggtaactcagattttgtttgaaaggaactaatttaaaaaaactttaatatatgaattttctggttaatttggatgaccaccatttttttgagtactgttaactgactttaggacctgcatttctaatccagatggtc

SEQ ID NO: 25386 - DNA, 290 bp, Homo sapiens
  misc_feature 1: n = A,T,C or G
naaagaaaccgtgataatacccaatgagaaaagtcttcaattacaaaaagatgaggcattaacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacaggaaatttgatag

SEQ ID NO: 25387 - DNA, 343 bp, Homo sapiens
  misc_feature 4, 11: n = A,T,C or G
gaanaaacccncttggaggaaaatggtccatggggtatacaaaaagagtatctttgttttcactcatgtacttgtacctgtctggattattcattattacatgaagtatcatgtttctgaaaaaccatatggcatagttgaaaagaagtccagaatattccctggtgatacaattctggagactggagaagtaattccaccaatgaaagaatttcccgatcaacatcattaaagattatgtaaaaagttaaaaggcttatgagcataagtttgttcctatattaccatatttactgaattttctggaaaagtaactttaataaagtttaatctcagaaattgg

SEQ ID NO: 25388 - DNA, 246 bp, Homo sapiens
actaatttaaaagttccagtatcctcaatatttgatgtcttatatgttcagaatcctttccagctgtaagtcatcagcaagtaaaaaatttagtatggcaatagttttcataagaggttttttaaaacagaaaaatgttgacattgccagcctctgggttgcattttgggatatgctacatttcaaaggtatcttttaaatctgaaggcaaagactttttcaacatctgaatattctgatttacag

SEQ ID NO: 25389 - DNA, 458 bp, Homo sapiens
  misc_feature 54, 56, 57, 449: n = A,T,C or G
aaaagcccaaggaataaattatcctgatatagcctctgatacatgttaccaggntnntacttctaagctggactttttagaaggaagtgcttcctgttaggtagaaaatttcacctctgctttttactagacctacagaccactgcaattgaggaacataaaaatgaaggatatccttcaactggtgcatagataaaccgtagtatatccatgcaatggaatcctactcagcaataaactaatgaaatacacatgcaaccacttggatgaatcttaaatgcattttactaagtaaaagaagccaaactcaaaaggctgcttactgtttgattccattcatattattttctcaaaaagcaaaacaatagggatggagaaaaaacttcagtggatgcaggggttaaggttggaatgctccttgactacaaagtggtagcatgaggaattgncttaataat

SEQ ID NO: 25390 - DNA, 458 bp, Homo sapiens
  misc_feature 2, 5, 52, 55: n = A,T,C or G
anccntagtaccgcaagggaaagatgaaaaattatagccaagcataatatanttnggactaacccctataccttctgcataatgaattaactagaaataactttgcaaggagagccaaagctaagacccccgaaaccagacgagctacctaagaacagctaaaagagcacgcccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagcaccaattaagaaagcgttcaagctcaacacccactacctaaaaaat

SEQ ID NO: 25391 - DNA, 238 bp, Homo sapiens
  misc_feature 11, 17: n = A,T,C or G
gtataaacccncctgtnaaatttttctggacaatgccagcatttggatttttttaaatcaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactac

SEQ ID NO: 25392 - DNA, 256 bp, Homo sapiens
  misc_feature 12, 22, 52, 55: n = A,T,C or G
aaacccgcagcnatgcatgttngattgaatgaaacaggaacgtatgggaagnctntgtggacaaatacggttacatgtagacaaatacggttacatggggcactaacatgaacaccagtgccagcaagaaagcaagcagcagagcaagtaagaacgggattttgaaaattcttatggaaaaaagtctgcagcatttccagaaactttcttaattagaagaaaacatgaaagtaaccgttgcaaatcaattgttttt

SEQ ID NO: 25393 - DNA, 450 bp, Homo sapiens
  misc_feature 8, 57, 365, 369, 390, 398, 449: n = A,T,C or G
aaacaggncctagcttatctagcctggaaggaatttgaagaggaggatttttaagtntaattaattaccttctgccccagggaaagggaaccaataaatatgcagagatatcatcctttgagttttgtaggttaaaaggtgatagagcagcttgtgttttctgggggagctggaggaagggggtatagatgatggactgtgataggaagttatttgttactttgtttgaaatactatattataaattccatgaatactttaaatgtgcaagtgtgcttaatgtcactattgagaacaaaatgtaaatggttgggcattctatggtacttcactggtctggtacagtgaatcttgccaactgcttnctgnatattaaattaatatcctgtnaccaaaantatgacagggaatactcttatactctgcattcagccaaagacagaataatnt

SEQ ID NO: 25394 - DNA, 466 bp, Homo sapiens
  misc_feature 58, 60, 271, 401: n = A,T,C or G
taaacatacccggggactgcgagcagaagcaacatcgctcgccatctgcaaaccaatntnattctattttgtgtcggtgctgtgggcgcctgtactctctctgtcacacaaccgtggtacctagaagtggactacactcatgaggccgtcaccataaagtgtaccttctccgcaaccggatgcccttctgagcaaccaacatgcctgtggtttcgctacggtgctcaccagcctgagaacctgtgcttggacgggtgcaaaagtgaggcangacaagttcacagtgagggaggcctcaaagaaaaccaagtttccctcactgtaaacagagtgacttcaaatgacaagtgcaatttacatctgtggaatagcattccccagtgtgccggaagcgagagctnaacagacaggaggagggaccacactggtggtaagagaaattaagctgctcagcaaggaactgcgg

SEQ ID NO: 25395 - DNA, 289 bp, Homo sapiens
  misc_feature 8, 44: n = A,T,C or G
aagattanctgccagactggcttatcaagacaaaggtgtccttnttaatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatg

SEQ ID NO: 25396 - DNA, 455 bp, Homo sapiens
  misc_feature 4: n = A,T,C or G
cccnactgggttcagtggtttgtgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactcctcggcatttctttctttgcacttcctgccggcattcttggctcaggttttgcattaaaagtacaagaacaacaccgccagaaacactttgagaaaagaaggaacccagctgcaacctcattcaagtgggttggcgtaagttacgcagctgatgagaaatctgtttccattgcaacctggaagccacacttgaaggccttgcacacctgcagc

SEQ ID NO: 25397 - DNA, 453 bp, Homo sapiens
  misc_feature 40, 48: n = A,T,C or G
atatcatgatattgattcaaagagagggattaagctgtcntgctaacntgtatggtagaaagagcactggataatttaaagtctggcaaatggcaaatcacttaatgtttttcactgcttttttctattttgaagtggagagaatacctaatccatatagttattgagctagtaaagtacatttatatatgtgtatatgtgtattttgtaaactttgaaaggcttcaatgtttaagatctcataaaaattagagaaccattctctgttaggatggattcataaggttactcctgaatatcatattatctccataaaaagcttagaattccctatactctgtgttttctataggaaatgaaaaaagttaaaaaaattattatttgtggactaggcgtggtggctcatcgctgtgatcgcagcactttgggaggctgaggtgggcaggatcactt

SEQ ID NO: 25398 - DNA, 460 bp, Homo sapiens
  misc_feature 5, 9, 55, 412: n = A,T,C or G
gaatngccnagccagcgcaggggcttctgctgagggggcaggcggagcttgaggnttccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggttctaaaacatgacggaggttgggatgaagctcttcatggagtaaaaaatgtatttaaaagaaaattgagagaaagggactacagagccccgaattaataccaatagaagggcaatgcttttagattaaaatgaaggtgacttaaacagcttaaaggttagtttaaaaagtgnaggtgattaaaataatttgaaggcgatcttttaaaaagagattaaccg

SEQ ID NO: 25399 - DNA, 229 bp, Homo sapiens
  misc_feature 30: n = A,T,C or G
tattagaaaatatttaaaagtgaattaaancaaaaatgcaacataccaaaacttcatagcatgcaggaaaaagcagcactgatatcgctgtaagcatttaaaaaataattacatttttgaaaacctcaaaaacagcagtctcatgtataactataagttaagaaactagaaaaagaataacaacctaaacccaaagctagcagaaagaaggaaataataaaaattagag

SEQ ID NO: 25400 - DNA, 460 bp, Homo sapiens
  misc_feature 2, 15, 56, 58, 333, 376, 399, 401, 448, 450: n = A,T,C or G
tnaaaacccaggganggaggagggtgcacataacccttaccctacctctgccaaantntgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggccattttagaccaaaatgtactgntaatgggttttttttttaaaattaaaagattaaataaaaaatnttaaataaaacatggcaataagngncagactattaggaattgagaagggggtcaactaaataaacgaagagngnccttccaaat

SEQ ID NO: 25401 - DNA, 451 bp, Homo sapiens
  misc_feature 25, 56, 60: n = A,T,C or G
aaaaagcccattaccagtgacaganttggacattatataggtgataagagggtcangttngacatggcaattcaaaatatataagcactagacaacagaacagcaggatacaggaaatcagataaatgaaaacaaagagaacacacagaaacaaaaaaatggcatacataagccctaacatgtaattacattaaatgtaaatgtacatttgcaaatataacaattaaaaatgagattggcagagtggattaaaagccaggtgctgtggtgcatacctgtaatcccagctactcaggaggctgaggcaggaggatcacttcagcccaggagtttgagaccagcctgggcagcatagcaagacccttactcaaaagaaaaagaaaaatgtcccaactctatgatgtctgcaataagttcatttcaaacataatgatacagacaggttaaatgt

SEQ ID NO: 25402 - DNA, 441 bp, Homo sapiens
  misc_feature 58, 60: n = A,T,C or G
aaaaaagacccttagttgtttaatttacatctctggaggagccaaaaataacaggacntnaccagacttaaactctacacatcagttttgaaacctaggtctccctctcttctgcaacacgaagggattgttgtttatttcctttgggtttgtcttgtctaaccctgctaattataaatttgagagaaattaggaaactaactttgggatttgatatatacaccttttgggaataagacatgttggaagacagttgttaaagacttctatgtagattgaaagctggagaaaaatctgatctctaaaagcattccttaaaattcatgacattggctcacgcctgtaatcccagcactttgggaggcaaggcaggtggatcacaaggtcaggagatcgagaccatcctgctaacacggtgaaccccgtctctactaaaaacac

SEQ ID NO: 25403 - DNA, 465 bp, Homo sapiens
  misc_feature 7, 8: n = A,T,C or G
taaaaannccctctccctactgctgctacacaagaccctgagactgacctgcaggactgttaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctgcacctgattttgtatccccctgtagcagcattactgaaatacataggc

SEQ ID NO: 25404 - DNA, 331 bp, Homo sapiens
  misc_feature 2, 50, 151: n = A,T,C or G
gngacgacctacgcacacgagaacatgcctctcgcaaaggatctcctttntccctctccagaagaggagaagaggaaacacaagaagaaacgcctggtgcagagcccaattcctacttcatggatgtgaaatgcccaggatgctataaaancaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggc

SEQ ID NO: 25405 - DNA, 401 bp, Homo sapiens
  misc_feature 7, 21, 27, 31, 91, 167, 318, 351, 365, 390: n = A,T,C or G
aacaacnagcctattgttttncaggangggncatcaaagctcagcgtagaaaacaacaaaacttctattacaagtgacatcggcatgcagntttttgaagggaggactcaaaatatcttattcagcacagactatgaaactcatgagtttcatttgccaagtggagngaaaagtttgaatgtcaaaaggcatctactgaaaggattaccagcaatgctaccagtgatttaaatataaaagttgatgggcgtgctattgtgcgtggaaatgaaggtgtattcattatgggcaaaaccattgaatttcacatggggtggnaatatggagtaaaggcggaaaacagtatcactnttaaatggatctgngatgggcagcaccacccggctaccnagttccttcag

SEQ ID NO: 25406 - DNA, 446 bp, Homo sapiens
  misc_feature 8, 9: n = A,T,C or G
gtgaacanntgcggtccctcacctgtgaagtggatgcccttataggaaccaatgagtccctggaacgccagatgcgtgaaatggaagagaactttgccgttgaagctgctaactaccaagacactattggccgctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaat

SEQ ID NO: 25407 - DNA, 293 bp, Homo sapiens
  misc_feature 24, 51, 57, 70: n = A,T,C or G
acattgacgcagccagcgcagggncttctgctgagggggcaggcggagctngagganaccgcagataagnttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagctcttcatggagtaaaaaatgt

SEQ ID NO: 25408 - DNA, 232 bp, Homo sapiens
  misc_feature 2, 15: n = A,T,C or G
tntcaacccgacatntaactctaattcctttcttttcaaaaaatttaactcatttcaggactctcaacacttcctaaaagaggagcacaaaggagagcaaattgttgctaagcttttcagagacagacccccagcatcagtgatattcaaggacaccaagatatggatgtaagattttgtttggatgggtaggagaaccagctctaaaaagaaggaatgctaggagaacaac

SEQ ID NO: 25409 - DNA, 448 bp, Homo sapiens
  misc_feature 2, 4, 42: n = A,T,C or G
cnantgcttcactagcaacctcaaacagacaccatggtgcantttgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctgctcacctggacaacctcaagggcacctttgccacactgagtgagctgcactgtgacaagctgcacgtggatcctgagaacttcaggctcctggcaacgtgctggctgtgtgctgcccatcactttggcaaagaattcaccccccagtgcaggctgcctatcagaaagtggtgctggtgtggctaat

SEQ ID NO: 25410 - DNA, 282 bp, Homo sapiens
  misc_feature 6, 10, 30, 46: n = A,T,C or G
tctgtnaatnctctgatcaaatatctgagngccaccactggctttngaagaaattacattatgacccagaagatggacctagatgaagacactgctgaaaaattttatcaaaagttactggaactggaaaagcacattagggtcactattcaaaaaacagatgatcaggccaggctcagtggctcatgcctataattccagcactttgggaggccaaggcagaaggatcacttgagaccaggagttcgagaccagcctgagaaacatagtgagcccttgtct

SEQ ID NO: 25411 - DNA, 295 bp, Homo sapiens
  misc_feature 3, 9, 27, 43, 51: n = A,T,C or G
gantaccanagtacctggcgggctggnagagcataagtacatncaggttgnctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgcattcaactcggaaactataagtaattctcaagaaagccctcatttttataacctggcaaaatcttgttaatgtcattgc

SEQ ID NO: 25412 - DNA, 467 bp, Homo sapiens
  misc_feature 10: n = A,T,C or G
tgaagaccanccaataatttaagacacatagaacagatttttttaatttatattttcatcctgaccagcttagttctaataatttttagttgtgagtgattaaaaaactttggatcaattttggtcaaacatgccaactttgtagtctgagtgacagggcaaggatttttgggtttaagatgcacttttagcacacatttgtatttcccttggcatatcagattgagctaatggtgatgttatttcaatctaacagccaccaatctgaaattgtatttcaaatgttgattctgtagttctttaaataataatgaagctcatcttatacattttgctttcaccaattgattccttcttcttttagcccactattaaaacatttcttactgaatggtcatgtaggctgctgaacagcacgcattacttgctcctgaagagtcccccattcatccatttggtccattagt

SEQ ID NO: 25413 - DNA, 473 bp, Homo sapiens
  misc_feature 1, 11, 60: n = A,T,C or G
ngaaccagccncaggagaggacgggacgcactgcacccactgtcatcacctaagaagacnggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatg

SEQ ID NO: 25414 - DNA, 211 bp, Homo sapiens
  misc_feature 3, 24, 29, 32, 82, 143, 164: n = A,T,C or G
gcnggagaaattttaagctaatgntagcnctnagagactctgcaactcatgagagcgaaagaattgtatttaaatcgcaaangagctgaaattcagggaaagatggaagatcttccagaacaagaaaaaaatataaatgttgnaggatgaattaggaaatgcanttttatgaaattcagttagaactatatgaagttaaatttgagatatt

SEQ ID NO: 25415 - DNA, 471 bp, Homo sapiens
  misc_feature 17, 19, 33, 49, 58, 59: n = A,T,C or G
gaacatgacctgtaaangngaactcgaatcctntttaaaaacaccctgnaaatgtatnnttgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacctctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagg

SEQ ID NO: 25416 - DNA, 462 bp, Homo sapiens
  misc_feature 4: n = A,T,C or G
ccantaattgtgaatatgaaaagctttgtccagcactggaaaccttctcttggaagaaaagtcatggatattttaaaaagagagtgcaagtagcattaagatggatagcacataatggcacttgtctatgtacaaaacacaaactttagagcaagaagacctcagacaggaaactggaattttttaaagtgccaaaacatatagaaatgtttgaatgcatgggtcttatctaacttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtcctctaacaaggacgccttccagcttcagcgatgttacttacgtttggatgctacttaaagtaat

SEQ ID NO: 25417 - DNA, 100 bp, Homo sapiens
  misc_feature 6, 16: n = A,T,C or G
caccangatctcgggntcggaacgagacttcacggattgttttaagaaaatggcagacaaaccagacatgggggaaatcgccagcttcgataaggccaag

SEQ ID NO: 25418 - DNA, 428 bp, Homo sapiens
  misc_feature 3, 23, 28, 29, 35, 46, 135, 286: n = A,T,C or G
ganagacggacatatacaccgantttcnnctatgncgccattctantactgcttccctaaagcagaaccgttattcatttaagaagtctaatgtgatatacattcatcctagtataaataaataatctctaagtnttctgaaatgggaatatttaacgccatagacagtggatatttactttaaatataatgttattaatcctctgcatttcttttatcttgataactcctagtgagggaatctaattaagatttcatgctgtctttgtaatgataaatgtttccnggactaaacactctataatacaaatcaaaaaatcttccttcttatactgagaaatgttcacccaaatttcctttggtattatatattattacacatgtgaattattattggttatttccaaggctgtattatcaattctaat

SEQ ID NO: 25419 - DNA, 344 bp, Homo sapiens
  misc_feature 3, 4, 35: n = A,T,C or G
tannctgatcagcgcatgggacatcttccaaggtngatcacatgttaggccataaaacatgactcagtaaatttttaaaaataaaaattatatcaaatatcgtctcaaaaaacaaaacaaaaaaacaaaccttttgaaatgaatgtaattggagacacaacatatcaaaacctgtagataccataaaggcagtgctaagagggaagtttataacattaaatgttaacttcaaaaaagagaaatactataaattaacaacctaatgtcacacctaaaggaactagaaaaataagaacaaactaaacccaaatctagcagaagaaaataaataacatatattcgag

SEQ ID NO: 25420 - DNA, 462 bp, Homo sapiens
  misc_feature 20, 27, 29, 138, 153, 216: n = A,T,C or G
gaaaaaaccggagtactttnaaaaacntngctggtgacagcaaaaatgacccatttatggaagcagctggcttcactgctcaggtgattatcctgaaccatccaggccaaataagcgccggctatgcccctgtattgnattgccacacggctnacattgcatgcaagtttgctgagctgaaggaaaagattgatcgccgttctggtaaaaagctgnaagatggccctaaattcttgaagtctggtgatgctgccattgttgatatggtcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtctccaagtctgcccagaaagctcagaaaggctaaatgaatattatccctaatacctg

SEQ ID NO: 25421 - DNA, 304 bp, Homo sapiens
  misc_feature 42, 56, 67: n = A,T,C or G
taaataacctagggctgttttttatattttggaaaaggcatngtttttaaagtaantataaaatggnaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctga

SEQ ID NO: 25422 - DNA, 123 bp, Homo sapiens
  misc_feature 98: n = A,T,C or G
ccctttcacattttccccattttgtgagcatttccttacttcctaacatgacaaaatatttcaaactaatcttgtattttccctgcccaatcctgatntcaaatatgtccccaaggagccttg

SEQ ID NO: 25423 - DNA, 468 bp, Homo sapiens
  misc_feature 16, 20, 30, 53, 185: n = A,T,C or G
gccctggccactgctnagancagacttcgntcgtactcgtgcgcctcgctttncttttcctccgcaaccatgtctgacaaacccgatatggctgagatcgagaaattcgataagtcgaaactgaagaagacagagacgcaagagaaaaatccactgccttccaaagaaacgattgaacaggagangcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatccatctggctggcagggaaaggaaagaacttgcatgttggtgaaggaaagaaagtggggtggaaagaagtggggtggga

SEQ ID NO: 25424 - DNA, 475 bp, Homo sapiens
  misc_feature 15, 43, 51, 165, 207, 223, 334, 335, 429: n = A,T,C or G
cagccagcgcagggncttctgctgagggggcaggctggagctngaggtttncgcagataagtttttttctctttgaaagatagagattaatacaactacttaaaaaatgtaggtcaatagggttactaagatattgcctcagcgttaggttctttaacgtaatcncaatagcttaagattttaaggagaaaatatgaagacttagangctagcatggaggaancccaagataaaaggtttctaaaacatggaagggagggttgagatgaagctcttcaatggggtaaaaaatgtatttaaaagaaaattgagagaaaggactacagagccccgnnttaataccaatagaagggcattgctttagattaaaatgaaggtgacttaaacagcttaaagtttagtttaaaaggttgtagggtgattaaaacnatttgaaggcggatctttttaaaaaggagattaaacccgagggggt

SEQ ID NO: 25425 - DNA, 443 bp, Homo sapiens
  misc_feature 2, 19, 37, 41, 49, 416: n = A,T,C or G
cnagagatgtctgcgctcngtggcctcagctggtggntttncgctactntctctttctggcctggaggctatccagcgtactccaaagattcaggtttactcacgtcatccagcagagaatggaaagtcaaatttcctgaattgctatgtgtctgggtttcatccatccgacattgaaagttgacttactgaagaatggagagagaattgaaaaagtggagcattcagacttgtctttcagcaaggactggctttctatctcttgtactacactgaattcacccccactgaaaaagatgagtatgcctgccgtgtgaaccatgtgactttgcacagcccaagatagttaagtgggatcgagacatgtaagcagcatcatggaggtttgaagatgccgcatttggattggatgaatncaaatctgcttgctgctttttaatatt

SEQ ID NO: 25426 - DNA, 388 bp, Homo sapiens
  misc_feature 3, 5, 136: n = A,T,C or G
atntnagattcaaagctaacttctgaagcataaacaaatctttactaggaataaggcttttcgggctcttttattaaagaagaggcgtacagaatctcgccccctgcctaataagttaaatgcaaatcagggtggntttgaaaatggtgagattggtgaatctgaggagaataatccacttgatgtccactcaatttatattgtcccttttcaatgtccaaagtgtgaaaagtgttttgaatcaagagcagattctcaatgaacacagctgtttgctgctagaagtggcaaaattccaagcaggtcaaaagaagctacaactataaaaccattgttaaaaaaatcttgccaagcttaagcgtgctaggagtaaaaaattagataactt

SEQ ID NO: 25427 - DNA, 442 bp, Homo sapiens
  misc_feature 2, 15, 25, 38, 39, 40, 42, 44, 47, 57, 59, 63, 65, 66, 173,183: n = A,T,C or G
anctgtcccaggtgncgcgagaganaccgactgtttcnnnananggnctttgacgantngaangnngaagatgacatcacctattggcttaacatgagatcgaaatgggacatgaatactatggcgattactaccaacgtcactatgatgaagactctgcaattggtccccgnagcccctacngctttaggcatggagccagcgtcaactacgatgactactaaccatgacttgccacacgctgtacaagaagcaaatagcgattctcttcatgtatctcctaatgccttacactacttgggttctgatttgctctatttcagcagatcttttctacctactttgtgtgatcaaaaaagaagagttaaaacaacacatgtaaatgccttttgatatttcatgggaatgcctctcatttaaaaatagaaataaagcatttggc

SEQ ID NO: 25428 - DNA, 234 bp, Homo sapiens
  misc_feature 7, 21, 31, 35, 37, 39, 42, 47, 48, 56: n = A,T,C or G
aaaagtncctgctgaaatttncgttgtgtcntatngntnctntaggnntgtgttcntaagatgcttaaaatttttatcatgaaaaatcctattttctctatacccttcctgtactgttctattttggaaccagagaatcaataactggcttggtaatgagctcattgtccttaacttttgctttattgattcacaatacgcttactgaaatgtaataaactattcataaacttg

SEQ ID NO: 25429 - DNA, 466 bp, Homo sapiens
  misc_feature 6, 11, 139, 151, 197, 217, 276, 277, 323, 329, 346, 419: n = A,T,C or G
cagcgnagggncttctgctgagggggcaggcggagcttgaggtttccgcagataagtttttttctctttgaaagatggagattaatacaactacttaaaaaatatagtcaatagggttctaagatattgcttagccgtnaagtttttaacngtaattttaatagcttaaggatttaagagaaaatatgaagacttangaagagtagcatggaggaanggaaaagataaaaggttctaaaacatgacggaggttggagatgaagccttcttcatggnngtaaaaaatgtatttaaaagaaaattggagagaaaggactacaganccccgnattaataccaatagaangggcaatgcttttagattaaaatgaaggtgacttaaacagcttaaaggttagtttaaaagttgtaggtggttnaaaataatttgaaggcggatccttttaaaaaagaggattaaaccgga

SEQ ID NO: 25430 - DNA, 163 bp, Homo sapiens
  misc_feature 13, 18: n = A,T,C or G
tcaacaatagggnttacnacctcgatgttggatcaggacatcccaatggtgcagcccgctattaaaggttcgtttgttcaacgattaaagtcctacgtgatctgagttcagaccggagtaatccaggtcggtttctatctacttcaaattcctccctgtacga

SEQ ID NO: 25431 - DNA, 414 bp, Homo sapiens
  misc_feature 13, 24, 50, 106: n = A,T,C or G
gtctaaaatcttnggtctgaggcngaatttcatactgagtgagcctctgngttcagtagccatcacccaggtgcagctgcattgtaattatgatgcaacaactagnctaggggcatatgtgatggtttatctgctgcaccgtgacagccctggctgtgactcccacatccctcaggagcacctgagccaagtgcctttggggatttatggactagataaacttttagatccctttcatcttttagcttttcggtataacatggggaacatggggttcttttgggttttctttaagcaatatccagtgtttggtttctatgaatattcaagagcaaactaaccaaaacatcaaggaaaccattttcgagactttaatacctggcatatgaattatatatgaaggctcgagttgga

SEQ ID NO: 25432 - DNA, 216 bp, Homo sapiens
  misc_feature 17, 18, 32, 37, 57, 60, 199: n = A,T,C or G
aacaaggccctgggatnnctagaggataaacntcctncatagaggacatacctttgnttnaaggagctgccgtcaggtgggaatgagatctcgaaaccaaggtggtgaaagtgcatcttgatgggcatatctcctgtcccaagccctccatcatcggcaatgctggtgaaaaaagtctctcagaagatgcaaaaaagangaaagaaatcaaatagg

SEQ ID NO: 25433 - DNA, 284 bp, Homo sapiens
  misc_feature 9, 11, 58: n = A,T,C or G
aaacttacncnagaaaggactctgcctgagctaggattgagcctgggccaccattgtnaaatggcggaggctaaacaaagcattgccacatggttacaggtcacacttccaaggacgtaaaacaagatggaggcctgcagcaaagtttgctactgaccatacagaaagacatgcaaagcacaccagattggctaaagcttaagcccaacctcacaaatcctttttcataactaaaactttacagagaaagaagaagcagttttccttatcattcttggtctagc

SEQ ID NO: 25434 - DNA, 469 bp, Homo sapiens
  misc_feature 21, 50, 68, 414, 467: n = A,T,C or G
aaattgcccagccagcgcagngtcttctgctgagggggcaggcggagctngaggttccgcagataagnttttttctctttgaaagatagagattaatacaactacttaaaaaatatagtcaataggttactaaggatattgcttagcgttaagtttttaacgtaattttaatagcttaagattttaagagaaaatatgaagacttagaagagtagcatgaggaaggaaaagataaaaggtttctaaacatgacggaggttgagatgaagcttcttcatggagtaaaaaatgtatttaaaagaaaattggagagaaaggactacagagccccgaattaataccaatagaagggcaatgcttttaggattaaaatgaaggtgacttaaacagcttaaagtttagtttaaaagttgnaggtgattaaaataatttgaaggcgatctttttaaaaagagattaaacccgangg

SEQ ID NO: 25435 - DNA, 102 bp, Homo sapiens
  misc_feature 1, 17: n = A,T,C or G
ngtccaactgtggtgcnttggaatgaaacggaagtgaacatgagcccagctgagagaggagcagggaatgtgtgaaaaacagctgctctccttgtccagctt

SEQ ID NO: 25436 - DNA, 214 bp, Homo sapiens
  misc_feature 1, 6, 44, 133, 157: n = A,T,C or G
nacctngatttgtgctaaaatgaagactctgcagtctacacttntcctgttactgcttgtgcctcttgataaagccagcaccaccaacccagcgggactcacgcattatctatgattatggacagataatttngaagaatccatatttagccaagantatgaggataaatacctggatggaaaaaatattaaggaaaaagaaactgtgataata

SEQ ID NO: 25437 - DNA, 353 bp, Homo sapiens
  misc_feature 27, 38, 40, 49, 51, 145, 148, 151, 314, 316: n = A,T,C or G
accacgaaaaatacctaaatgctgtanacaatttcacngnaataagcantnggcccaaaagcctaggagtttttttgtacttaagtgaatctggtatgcaacagagatgctgcagctgatgcctctaaaaggtattcatcatggnacnctnaggcccgtgcttggtgttccagagcccagggttgagcatcctgaaggagccactgcagccgtcactgccccagagcctgtggagatagagcctgttcgctgctttttcttcccgctcttaagacatggctggagctcagtcttcattgaatgaagcccgctgngncattgcatagccttgctttcttgaactaaactgtttg

SEQ ID NO: 25438 - DNA, 305 bp, Homo sapiens
  misc_feature 8, 57, 75, 92, 274: n = A,T,C or G
aatctgcnggctcttcgtcagattgggcagaggacgataagcactgcttcccgcagncattttaaaaataaagtnccggagaagcaaaaacngttccaggaggatgatgaaattccactgtatctaaagggtggggtagctgatgccctcctgtatagagccaccatgattcttacagttggtggaacagcatatgccatatatgagctgcttgtggcttcatttcccaagaagcaggagtgacttcagtcatcccagcaatcgcttggtcagnttcattcagctctctatggaccagtaatctg

SEQ ID NO: 25439 - DNA, 467 bp, Homo sapiens
  misc_feature 6, 56: n = A,T,C or G
aaattncccagccagcgcaggggcttctgctgagggggcaggccggagcttgaggntccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagctcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtg

SEQ ID NO: 25440 - DNA, 458 bp, Homo sapiens
  misc_feature 10, 16, 58, 416, 420: n = A,T,C or G
aaagagaccnatcttnatggctcacaaaacctaaaatgtttactatatggtcctttgncaaaagtttgccaatcctgatctaaggtaaaatttgaggactttccaacctaagtaattgagggaagagttattaacccagtagcaaattcctaaggagctaagcattcccaagttaaacttggattgcacatattttcacatatgcaaacatatacaacttgaaggaggagcttcaccagtgtttcatccttggaaaagcctttatgttctgttacgagcccaggcttccactaggaattagcccaccaactccacttagttactatgtcaccttgggttatctaagactaaatgaaaattatgtttttggtaatgcttcaagtttgcccaccatcaccatttaagggaaaactatnaaangggcttctgaccaatcatacattttttagaatctaggc

SEQ ID NO: 25441 - DNA, 468 bp, Homo sapiens
  misc_feature 11, 23, 31, 36, 49, 56: n = A,T,C or G
aagttcccgtntagcggaagcantattttgnaaggnaatgatacctaanccatagnttctcgaagttgtgcacattgcaaggaagataaacaaaaagaaatctacacctaactacatcataataaaactgcaagaaaccaacgaaaataggaaagtctaaaagcagccacaagggaaaaaaaatacgttcagaaaagtaatgattagactaacagctgacttcaaaacagaaaacttagtggatgagtttagcatcagattagacatacttgaaaataagtgaactggaagatggcttagaaggagagatctggaatgaagcttcaagacacagtattacagaagaaaggaaaagatatagactatacatcgaaaagttttcgcaaaaattggaataatgaaaggagagggaaagttacatgtatagcagaagcagtattttaaaaggaaatgatccctaaaccatag

SEQ ID NO: 25442 - DNA, 409 bp, Homo sapiens
  misc_feature 2, 47: n = A,T,C or G
tnctctacagatggtaaaatgcaaggaattgccacaagcagtctgtnagatccttgggcttcaaggcagtgaagttacaacaccagatccagacgttggtgaagacgaaaatgttgtcatgactccttgtcctacatctgcatttcaaagtaatgccttgcctacactctctgccaggtggagccaggaaatgacagcccaacacagataccagtgtcctcagatgtctgcagattaacacctgcatgatcactgttcttgctttttttgggaagagacactttgttgcaaccctttttcaagtacttgaaagttgaaaatttgaaatcttggtattgatcatgctttaaggtttatgtaaagaaagtgacctgatgttcttacattaaagctttacaaagatttaaac

SEQ ID NO: 25443 - DNA, 392 bp, Homo sapiens
  misc_feature 6, 15, 74, 117: n = A,T,C or G
ggcagnctggagctngacctttcccgcagataaggttttttctctttgaaagatagagattaatacaactactnaaaaaatatagtcaatagggtactaagatattgcttagccgtnaaagtttttaacgtaattttaatagcttaagaattttaaagagaaaatatgaagacttagaagagtagcatgaggaaggaaaagataaaaggtttcctaaaacatgacggaggttgagatgaagctcttcatggaggtaaaaaatgtatttaaaagaaaattggagagaaaggactacagagccccgaattaataccaatagaagggcaatgcttttaggattaaaatgaagggtgacttaaaccagcttaaaggttagtttaaaaggttgtagg

SEQ ID NO: 25444 - DNA, 307 bp, Homo sapiens
  misc_feature 10, 283, 298: n = A,T,C or G
actctactgnacttccttgaagatgaaaaatatgaagaggttatggctgccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagangagtaaaggacccangaaaactgc

SEQ ID NO: 25445 - DNA, 384 bp, Homo sapiens
  misc_feature 1, 3, 41, 49, 55, 58, 151, 262, 278, 365: n = A,T,C or G
ngnacccaatgattaacaaaggcgtccgaagaaatcgttgntggaaggngaccanggnggaaagagacgttgctttggccctgcaagtaagaagagagagggaatagcctgaaggagtaacactaaatttaaaatgacacttttttaccanccagcgaaagcagatgttcaaaggggatattggccagagtctgcacactaagatgagaaatgtcccttcttcctgaaggtgtctgatgtgtaaaaatatgatatactttgntgctggttcctccttnccttttgcatattattctgaaacaacattaactagtacttgcgcattgaagggatgcacttccctctatgttaggagtgaataaaantaaaaataggatccttata

SEQ ID NO: 25446 - DNA, 250 bp, Homo sapiens
  misc_feature 10, 16, 40, 137: n = A,T,C or G
ccactgcacncaccanacttcgctcgtactcgtgcgcctngctttttttttcctccgcaaccatgtctgacaaacccgatatggctgagatcgagaaattcgataagtcgaaactgaagaagacagagacgcaaganaaaaatccactgccttccaaagaaacgattgaacaggagaagcaagcaggcgaatcgtaatgaggcgtgcgccgccaatatgcaccgtacattccacaagcattgccttctta

SEQ ID NO: 25447 - DNA, 163 bp, Homo sapiens
  misc_feature 9, 11: n = A,T,C or G
tactaaaantncaaaaattagctgggcgtggtggtgcatgcctgtaatcccagctacttgggaggctaaggtaggagaattacttgaacatgggagatggaggttgcagtgagccaagatcatgccactgcattccaacctgggcaagggagtgagacgctgt

SEQ ID NO: 25448 - DNA, 447 bp, Homo sapiens
  misc_feature 3, 15, 39, 40, 53, 75, 76, 88, 89, 91, 146, 198, 203, 208,242, 245, 327, 329, 337, 379, 407, 412: n = A,T,C or G
cantaggtcacgatntttagctcacatctggaagcagcnnctacttggctcangtacatataagagtaattagtnntattctctcttnntnataaaatcgggtttcagatgagatgtttatcttagactattttagggaaaaattntacatgtttgagatggtggagtaaaaaagactgttaaacatttcttttaaanaattnttttnacattacaacaatatatttatgatgtgctcagancanaaatttaactcctgtgcccagatctactttcaaagtgagattttcactcgcagcttaaatttctgactagactaacatttgngnatttttgngcctaggccgggatcaaatttcacagtggattttgaagttgnccctaaatttggataaaatcaagtgatnaagtnctaaagagataaaatggtaatttccattttaaaag

SEQ ID NO: 25449 - DNA, 445 bp, Homo sapiens
  misc_feature 1, 11, 25, 30, 32, 71, 341: n = A,T,C or G
naaaaaatccnatatggagtcagtnctgcntntaatgtcttgaacattttaaattacttctattaccacgntgttttttagtagaattgtttcctaaagaaaaccactctttgatcatggctctctctgccagaattgtgtgcactctgtaacatctttggttgtggtagtcctgttttcctaataactttgttactgtgctgtgaaagattacagatttgaacatgtagtgtcgtgctattgagttgtgaactggtgggccgtatgtaacagctgccaacgtgaagatctggtacttgatagcctcttaaggaaaatttgcttccaaattttaagctggnaagcactggaataactttaaaaaagaattacaatacatggctttttagaatttcgtacgtatgtaagatttgggtcaaattgaaatgctgtctgatcctcaacc

SEQ ID NO: 25450 - DNA, 272 bp, Homo sapiens
  misc_feature 2, 6, 271: n = A,T,C or G
gncgtncatatacatcatgttttattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttagaatatattctgaatgaaaactgtattgaggattcatttttgnt

SEQ ID NO: 25451 - DNA, 468 bp, Homo sapiens
  misc_feature 1, 8: n = A,T,C or G
naatgaanccacccccactgaaaaagatgaagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctgcaacttagaggtggggagcagagaattctcttatccaacatcaacatcttggcagatttgaactcttcaatctcttgcactcaaagcttggtaagatagttaagcgtcataaagttaacttccaatttacatactctg

SEQ ID NO: 25452 - DNA, 295 bp, Homo sapiens
  misc_feature 7, 12, 252, 265: n = A,T,C or G
tgttatnccagnactttgggaggctgaggcgcgtggatcacccgaggtcaggagttcgagaccatccagcctgactaacatgttgaaacctcgtctctactaaaagtacaaaaattagctgggtgtggtggtgcatgcctgtagtcccagctgcttgggaggctgaggcaggagaatcacttgaacctgggaggtggaggttgcaatgagccaagatcacaccattgcgctccagcctgggcaacaagagtnaaactccgctttnaaaaaaaagagagagaattcagcctaagtg

SEQ ID NO: 25453 - DNA, 464 bp, Homo sapiens
  misc_feature 8, 21, 59, 388, 422, 430: n = A,T,C or G
gaaaaaancccgcagggaggnatttaacagctgagcaaaaacattgagtcactctcatnggacacgaggcccttggcagggaatatttaaagcaacttcaagtttaaaatgcagctgttgattctaccaaacaacagtccaagattgccatttcccatgagccaactgggaaacatggtatatcatgaagtaatcttgtcaaggcatctggagagtccaggagagaaagactcacctctgtcgcttgggttaaacaagagacaggtttgtagaatattgattgggaatagtaaatcgttctccttacaatcaagtcttgccctattcggccttatacatctggcttacaaagaccaaagggatcctgcgcttgatcaactgaccagtntgccaaaaccaggcatccaatttgtaaccaattntgataaanggacaaaatagctggtttgccacctcaaaacttt

SEQ ID NO: 25454 - DNA, 464 bp, Homo sapiens
  misc_feature 21, 57, 408: n = A,T,C or G
taatgtgccagtcacagtggnaactgcagggaggaggtgtgttcctaagaaccaaantccagcacagcatcctgtgaagccacgtgtaatgatggtcccataaggaaagtatgtgaatatggctcttgtaaaggattaactattgtaattttagcttatgctctgtattctgttttctatggaattatttaagcccttttagtgacctttgtcctgcccatttaaaaactaaaatgtagtatatattgtataaaatggaaatatcattattgcttcattaggggaaactgtcataggcattgaaagaagggtaaaagcaagcagttttatcaggcaattgtaaaacaccaaaaatatagattcgctttgacgtgtaacacactaaatgtattttgtacagcatctggnttaaaaggtgccttaagagtttaccattacttgcttggtctatatacagattatgt

SEQ ID NO: 25455 - DNA, 461 bp, Homo sapiens
  misc_feature 13, 14, 33: n = A,T,C or G
acccgaaggcgcnnaaagcgaagaaggaagctnctgcccctcctaaagctgttccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggcaaggtcaacaccctgattcggcctgatggagagaagaaggcatatgttcgactggctcctgattacgatgctttggatgttgccaacaaaat

SEQ ID NO: 25456 - DNA, 366 bp, Homo sapiens
  misc_feature 12, 13, 52: n = A,T,C or G
atccctaaagtnnggattgggacttttcaggtccttttttggagggcaaagnaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtctataagcaaatgaattaaacagctatgc

SEQ ID NO: 25457 - DNA, 458 bp, Homo sapiens
  misc_feature 30, 36, 58, 322, 402: n = A,T,C or G
aaataaaccaactgaagattctgagagatnaactgntcaagtcttagcaatgatactncacttctctttgacaggttctgggcttaagttagaggccctactggttccaaaccatattccactgactttgcaagtaaaataaatttgattctgaaataggaaacaaaaaaaggagaaataaccgaatagtagaagaaaaactgtttgtaggaagacgatgcatggaatgatgtggacattgagtaaccatgtcaataaaatatataaaccaaacttaaatttgtgaaataaggaagttggtcctttggtggtacagtgtatnaaaacaatttcgggactgctgtgcaaaagacatatatagtttgcttcctctggggtaagccggttatattcaggttcagntttacttctaagttgccttgtaattgggactgggttcagcatcacaaaacccaatt

SEQ ID NO: 25458 - DNA, 350 bp, Homo sapiens
  misc_feature 4, 13, 326: n = A,T,C or G
ccgnaaatgctcnagaagagttaactattctaaatgtatgttgcaccctatacaggagcacccagattcataaagcaagttagagacccacaaagagacttagactccaacacgataatagtacaataatagtgggagactttagcaccccactgtcaatattagatcaacaagacagaaaattaacaagtatattcaggagttgaacttagctctggaccaagcagacctaatagacagctcagaactctccaccccaaatcaacagaatatacattcttctcagcacttcatagcagttattctaaaattgccacataattggnagtaaaacactcctcagcaaatgc

SEQ ID NO: 25459 - DNA, 459 bp, Homo sapiens
  misc_feature 10, 56, 263, 291, 427, 433: n = A,T,C or G
aaaaaagccncgggctgctaacgaagtcactcttaattaatatctgtatcctggancaatattttatgggtatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagacccacacatatacacgaatagacatcaaactcaatgcttaatttgnaaatttaggggttttttatttctactgncaaatgatgtgcaaaaccttttactgggtgcatggaaatcagccaagtttataatccttaaatcttaatggtcctcaaaagctgggattaaatcatatggatggtactctctgccccaaatatcttgatccattcnaattgnctggtaaaaataaggggggagatatt

SEQ ID NO: 25460 - DNA, 460 bp, Homo sapiens
  misc_feature 57: n = A,T,C or G
taaatgtcccacatcttgacgaggctgcggtgtctgctgctattctccgagcttcgntatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctcctggccagggcagcccttcaggagctccttagtaaaggacttatcaaactggttcaaagcacagagctcaagtaatttacaccagaaataccaagggtggagatgctccagctgctggtgaagatgcatgaataggtccacccagctgtacatttgg

SEQ ID NO: 25461 - DNA, 301 bp, Homo sapiens
  misc_feature 1, 11, 63: n = A,T,C or G
naaagctaacngagcacacccgtctatgtacgcaaaataagtgggaagatttatagggtacgnggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactac

SEQ ID NO: 25462 - DNA, 267 bp, Homo sapiens
  misc_feature 59, 60, 177: n = A,T,C or G
acaatgagccttcaagatctggtcactatggtaccgagaacgaaaatgcatattatgcnncatcgtgtacagctcaaaaaaggagatggacgaacacatgcggagcatgttgcatcacagggaacttgagaacctcaagggcagggacattagtcatgagtgccgagtgtgcggggncacagaagtgggtctttctgcatatgcaaagcacatttctggccagttgcacaaagataacgttgatgcccaggaaagagaagatgatgg

SEQ ID NO: 25463 - DNA, 467 bp, Homo sapiens
  misc_feature 1, 3, 57, 439, 440: n = A,T,C or G
nanaagtccctgttgattgagagagaaagacttctttaaaaaagcgtttttgttaanttagtctgggaatcatggaatcatagtgaccagtaactgttatggactggattgtatccccctccaattcagttatggtgctgcttcagaaagaaaagagatagtttcccttgcaaagttatcaaagtgctccccagaagacattaggtatttgctttctagtctacatacaatgaaaaggaaaaaacgtcagttcctgaagctctctcaaaacatcaacagatggaaagacgtgcccatgtcctcccctccctccactctgggggcttggaaatgctgcagcagggagcaggccccaggctggacctgccctgtcctcacgacgagtgtgtgcaaaagtgaacaataaatcatttcaaagatgcaaggaagaaaaaccaanncatcaacagaatcttctttcccataat

SEQ ID NO: 25464 - DNA, 454 bp, Homo sapiens
  misc_feature 4, 11, 27, 43, 45: n = A,T,C or G
cgtncggtccngagatgcctcgctccngtggccttagctgtgntngcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggatcgagacatgtaaagcagcatcatggaggtttgaagatgccgcatttggattggatgaattccaaattctgcttgcttgctttttaatatt

SEQ ID NO: 25465 - DNA, 334 bp, Homo sapiens
  misc_feature 30, 56, 58, 287: n = A,T,C or G
ataatgaaccaactagaaataaccttgccnggagagccaaagctaagacccccgantntagacgagctacctaagaacagctaaaagagcacacccgtctatgtagcaaaatagtgggaagatttataggtagaggcgacaaacctaccgagcttggtgatagctggttgtccaagatagaatcttagttcaactttaaatttgcccacagaaccctctaaatccccttgtaaatttaactgttagtccaaagaggaacagctctttggacactaggaaaaaacctngtagagagagtaaaaaaatttaacacccatagtaggcctaaaagcag

SEQ ID NO: 25466 - DNA, 401 bp, Homo sapiens
  misc_feature 10, 384: n = A,T,C or G
cctgagatanacaaaatatgggcatgcatgctaaagggaaaatgtgtgcttggtctactgcattaaatcctgtgtgctcctcttttggatttacagaaatgtgtcaaatgtaaatctttcaaagccatttaaaaatattcactttagttctctgtgaagaagaggagaaaagcaatcctcctgattgtattgttttaaactttaagaatttatcaaaatgccggtacttaggacctaaatttatctatgtctgtcatacgctaaaatgatattggtctttgaatttggtatacatttattctgtcactatcacaaaatcatctatatttatagaggaatagaagtttatatatatataataccatatttttaatttcacaaatnaaaaattcaaaggtttg

SEQ ID NO: 25467 - DNA, 459 bp, Homo sapiens
  misc_feature 5, 449: n = A,T,C or G
aaagngcccacatagatttaagtgaatacattaacggtgctaaaaatgaaaattcttacccaagacatgacattcttagctgtaacttaactattaaggccttttccacacgcattaatagtcccatttttctcttgccatttgtagctttgcccattgccttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtggcttccccaggtggcctggaggtggcaaagggaagtaacagacacacgatgttgcaaaggatgggtttgggactagaggctcaagtggtgggaagagatccctgcagaacccaccaaccagaacgtgggttgcctgangctgtactga

SEQ ID NO: 25468 - DNA, 438 bp, Homo sapiens
  misc_feature 2, 3, 35, 66, 366, 421, 429: n = A,T,C or G
gnnagtgtcataagaactgttttgggtgatttaantggtatataagccttggctgtgatatttggnacattctaagtctattacaatcttaccatggtgaagtatgatctaatacatgataatcctctatacaagcagtttccacgcacattaaatttttaaaatcccaccactggtaggatgtaattattttacataatgaatttttcgctattctctttcctgatacccttcagtgatcaagagaaagcatttccaagataagatttgagaaacagagtaaagttaaatagcctataataagataaaaaagtaacctcttaacactatcttttcatttgccaactttaacagcacctacatgtnatggatataaaataacaaatgtccattacctagtacgacaccaagagcatctggntaagatcncagaatatt

SEQ ID NO: 25469 - DNA, 415 bp, Homo sapiens
  misc_feature 2, 10, 55, 407: n = A,T,C or G
tnaatgaccnatgtaagacttgacagtggaactacattagtacacagcaccagantttatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcgggaatcctgtcgattagactggacagcttgtggcaagtgaatttgccttgtacaagccagattttttaaaatttatattgnaaatattg

SEQ ID NO: 25470 - DNA, 407 bp, Homo sapiens
  misc_feature 8, 57, 59, 377: n = A,T,C or G
aaaaacanccgccttgcctctatgagatcaaacagtttccggagtgtgcccagaacntnggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctggtatgttatgattttattctttgngagttaattagaataaagtcattttcttcg

SEQ ID NO: 25471 - DNA, 274 bp, Homo sapiens
  misc_feature 2, 12, 28, 42, 48: n = A,T,C or G
cntatgaggaancctagagcagccaggngaggctctccagtntaatanaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaaccctcca

SEQ ID NO: 25472 - DNA, 404 bp, Homo sapiens
  misc_feature 150, 358, 360, 370, 396: n = A,T,C or G
cagccagcgcaaggggcttctgctgagggggcaggcggagcttgaggttccgcagataagtttttttctctttgaaagatagagattaatacaactacttaaaaaatatagtcaataggttactaagatattgcttagcgttaagttttnaacgtaattttaatagcttaagattttaagagaaaatatgaagacttagaagagtagcatgaggaaggaaaagataaaaggttctaaaacatgacggaggttgagatgaagcttcttcatggagtaaaaaatgtatttaaaagaaaattgagagaaaggactacagagccccgaattaatccaataggaagggcaatgctttttagantnaaatgaaggngcctttaacaagctttaaggttttgnttaaaggt

SEQ ID NO: 25473 - DNA, 429 bp, Homo sapiens
  misc_feature 14, 18, 53, 397, 428: n = A,T,C or G
atgcctctaagatntggnttgggatcaataggaaagcatatgcagccaacctngatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataaagaggaatttggtataattatggtgggtgattattttttatactgtatgtgccaaagctttactactgtggnaagacactggtttaataaaaggattacattnc

SEQ ID NO: 25474 - DNA, 436 bp, Homo sapiens
  misc_feature 4, 6, 309, 409, 432, 435: n = A,T,C or G
tgtntntactaggtgcaacttgtgaagttttaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatgggagaaacgacacaggntaggagacgtcgctttgaacgtgctataggacccttctcaaacacacaccatcagaattcaatatttccctgccagactggcttatcaagacaaaaggtnccctcataatggaagtaaagcgngtnt

SEQ ID NO: 25475 - DNA, 352 bp, Homo sapiens
  misc_feature 11, 28, 56: n = A,T,C or G
taaataaccgnccaacaatttaaaaagntgaaaatctcttcacattagaaatttanttttatttggaatttagattgatagaccatgtatggatttttgaagtattttataaggactgatgttgtgacaagttgaataatttgatgcctttgagtcttaatgagaatcttgttaatactaataatcatctagagaagatagtcttttttggttaggatcagcaacagctaaagatgttaaagaggttctaaatcttggtggaagttattataaagttataacattgtttcctaagtaatggaaagaaagacccaaaatttaatgagagtaataaatgtaaaattaactaaag

SEQ ID NO: 25476 - DNA, 317 bp, Homo sapiens
  misc_feature 7, 26, 58, 278: n = A,T,C or G
taaagtntccctttaaaaggaaccgntgtccatttaaaggtttcatagttatcttcantgggttagtattgtttggggcaggacattaaactagaagggattctataggatgaggtgatacctagaaggtaatatattgtaaggcaaaagagattagaagaaatggggaaaggatagtaaaaggcaagtcagattaaaggttgaaacatgaagatattctcaattgtatttctgcctatgtttgcttttttggctcaagcatctgttggaagagacanaatgtgacttggttcataataaagcaagaattatttact

SEQ ID NO: 25477 - DNA, 181 bp, Homo sapiens
  misc_feature 19: n = A,T,C or G
caggcggagcttgaggttnccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatg

SEQ ID NO: 25478 - DNA, 226 bp, Homo sapiens
  misc_feature 35: n = A,T,C or G
cacacggacacagggatgagatcaacacacactgnggcctgatgcaggggccggtagcggggagagcatcaggataactagctaatgcatgtgggggcttaatacctaggtgataggttgataggtgcagcaaaccaccatgggacacgtttacctatgtaacaaacccgcacatcctgcacttgtatccagaacttaaaatattttaaaaatctttagagaatac

SEQ ID NO: 25479 - DNA, 448 bp, Homo sapiens
  misc_feature 3, 21, 27, 32, 33, 34, 36, 42, 147, 403: n = A,T,C or G
gancgagaagaatgctgctgncaaagnggacnnncnaacgantttaccacctgtccttcgagcaggagttaacaccgtcaccaccttggtggagaacaagaaagctcagctggtggtgattgcacacgacgtggatcccatcgagcnggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtcgtggctcgtatcgccnagctcgaaaaggcaaaggctaaagaacttgccactaaactgggtt

SEQ ID NO: 25480 - DNA, 442 bp, Homo sapiens
  misc_feature 4, 13, 38, 132, 390, 420, 441: n = A,T,C or G
tganaaaggggtnatgtcatcatttgatgcagagtccntttttctctataataaatccctttgccaaatgcatgagttgcagacttgctactggcaagagtgaagcaagtgggtgagtaaaactattttgangtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggatcttggtaaactgaagacttttatttgggaatgaaaaaccntaaaaaaaatctctttaatcgttgaactgngcatttccctggatttttccnt

SEQ ID NO: 25481 - DNA, 458 bp, Homo sapiens
  misc_feature 4, 393: n = A,T,C or G
aatnccaccagcattcctcaaggtcttcctccttcccttacggaattacatcttgatggcaacaaaatcagcagagttgatgcagctagcctgaaaggactgaatgatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgccacctggacacaacaccaaaaaggcttcttattcgggtgtgagcttttcaagcacccggtccaagtactgggagatcagccatncaccctcaagatgtgtctacgtgcgctctgccattcaactcggaaactataagtaattctcaaga

SEQ ID NO: 25482 - DNA, 359 bp, Homo sapiens
  misc_feature 6, 8, 37, 38: n = A,T,C or G
catgangnccaacatcgagcagatttttaggtctttnntggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaaacaaaaaggagg

SEQ ID NO: 25483 - DNA, 476 bp, Homo sapiens
  misc_feature 10, 452, 454: n = A,T,C or G
ccagcaaganggatgcttaagggagtgatggtgttgatatcaggagcttacattcactctaatcttgttttataattagctttataatgcacgaccacaaatttggcagattcatatagtccctaaattttccattttgaatcactatcatatcaattatattaaagagatattcctgattgtgtgcttgttttactgatactttatgcacattatattagtactgattaatagatttttttctggactagaactttcttgatcattctgtatgaaattattgcaaagatagaaaaggaaacacttgttttgcttttcaattataaagcatcagtggtaccttggtgacatcgacaaaacaatagctgtcacattcaatcatctgcaaaatctgacaaatattaattatattgattttctattggcttatggagggagggctctttatccangngcagaaaggtaattatatactt

SEQ ID NO: 25484 - DNA, 495 bp, Homo sapiens
  misc_feature 2, 6, 53, 434, 462, 492: n = A,T,C or G
gnaccngttattttcagtacatgggtaacacccaggccctttcccattatatncaggtatgctacaagttcttttaactcttatcagaagttattattactgtttccttagagaggctaccaggctaaaattcacttagtttggtttgtctaatgtcctcattattttatcctgaagatgatgtcatttctcaggacttgaaaatgacttggctgaactaaaggtaaaaaagccaagcctctgtcacttttcctagactcctaggcacagctatggagtctttgcacagtgcccataccctaaaaattaataatgaaaaccaaacctcaagaacctagagcagctctctacttgccaccatggactccagtggcaagcataagaaaagcagataggtgcattctatttaggttatagctgctttggtcctttgnggttcactaagcagaggctcaaaaattnccttgatacttcagctgccctggtcttttnctc

SEQ ID NO: 25485 - DNA, 495 bp, Homo sapiens
  misc_feature 6, 8, 194, 333, 355, 372, 418, 451: n = A,T,C or G
ctgtgngncaggtttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagngtttttttatttctactgcaaatgatgtgcaaaaccttttactggttgcatggaaatcagccaagttttataatccttaaatcttaatggtcctcaaagcctgggattaaatcatatggatgtactctcttgcccaaantatcttgatacattcaaattgnctgggtaaaaaataggnggagatattgaggccaagaatattgcaaaatcgtgaagctcatgcncttaagaagttttttagaataagaatttgcatnctacctagggaactttctagaatattttcaccctaagccagggt

SEQ ID NO: 25486 - DNA, 486 bp, Homo sapiens
  misc_feature 4, 11, 59, 60, 411: n = A,T,C or G
aaangaatccngaagaataatgggttgtttccttttaatgttgtgatgttgctgaggtnngatggaccaagagccaggacacagtctagaagctttgaggtttcttttttcattgtttcttgaaattagaatttaagactgacattttgttgggggagttgaggagtgaagaaacacacatccccctctgttccctccattctgtgggacagtctgcatttattttattttattttcaatatttcatggttaaggatttgccattattttttaaaaacaaagttagctttgtccagtaagtaccatttcctctcagaagcagtgcctagtgtccttgccagtctgtgcctaggaatgtcttgggaattttgccaggactaacaaaactcagtccttgggttcctctctcangattaaccatttctctgactccagtaagagagaatgacacgggagaaaaaaaaaagaaatgtttcagaggccgac

SEQ ID NO: 25487 - DNA, 314 bp, Homo sapiens
  misc_feature 3, 8: n = A,T,C or G
atngcccnggaagaaatagaaaccctgaacagatcaattataaataatgcaattttatccataataaaaaattgtccaacaaaaaataagcccagaatcacatgaattcacagccacattttaccaagtgcacaaagaagagctggtatcaatcttactgaaactattacaaaaaaatcaaagaggagacattcctccctaactcattctataaaaccggaatcatgctgataccaaaagcagacacaactaaaaaacaagactgcacgccaatagccatgatgaacatagatgtagaaattctcaatactagc

SEQ ID NO: 25488 - DNA, 445 bp, Homo sapiens
  misc_feature 10, 11, 27, 52, 55, 56, 61, 403: n = A,T,C or G
taaatccccnngctgcttaattcagantgttcgaaacagaagaaagagaaanggnnttgangatgatggaggtgattcacctgttcaagatattgataccccagaggttgatttataccaattacaagtaaatacacttaggagatacaaaagacacttcaagctaccaaccagaccaggacttaataaagcacaacttgttgagatagttggttgccactttaggtctattccagtgaatgaaaaagacaccttaacatatttcatctactcagtgaagaatgacaagaacaaatcagatctcaaggttgatagtggtttcactaggagacgtggaattgagactaataacttgaatgttaacactgtttactgttttttcacatgtagaaatggtctttgngtattttttctacagaggatttctctgattttattttctttg

SEQ ID NO: 25489 - DNA, 500 bp, Homo sapiens
  misc_feature 3, 20, 39, 42, 44, 47, 48, 56, 59, 60, 63, 446: n = A,T,C or G
gcnacttcccaacgtctgangtatcaataagctcctagnccngnccnnaagtgccnttnnaanaaggcctgctctaaattatctagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaggatcaatactataacattgatgtgcctagtagaacagcaagagcaattactactcgtctgggcagccttatccaaagtctggtacaactgtccttagactgatgagcaaaggaggagncaactaatgaagaaatgaataataaattttgacctgaaaaacattttattaata

SEQ ID NO: 25490 - DNA, 304 bp, Homo sapiens
  misc_feature 1, 3: n = A,T,C or G
ngntttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaattt

SEQ ID NO: 25491 - DNA, 369 bp, Homo sapiens
  misc_feature 9, 14, 34, 35, 120: n = A,T,C or G
cttcttccnattgntgggatgactgagccagtanngaccaattaaaaacgaaaacctgactaggttctgtagagccaattagacttgaaatacgtttgtgtttctagaatcacagctcangcattctgtttatcgctcactctcccttgtacagccttattttgttggtgctttgcattttgatattgctgtgagccttgcatgacatcatgaggccggatgaaacttctcagtccagcagtttccagtcctaacaaatgctcccacctgaatttgtatatgactgcatttgtgggtgtgtgtgtgttttcagcaaattccagatttgtttccttttggcctcctgcaaagtctccagaagaaaatttg

SEQ ID NO: 25492 - DNA, 456 bp, Homo sapiens
  misc_feature 9, 15, 29, 52, 63: n = A,T,C or G
attccactnaaactnagctactgcaaatntagtctttctgtaaatgttattntaatatccagntgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgcacctggtgcttttaagtagggataaagtcatcctctcactgcaagcacagcatacctgtcctccaaaagtgacgttttagtgaacaggccgttttcaacacttgtgccttggggtgtcattgaagctttgtgaaaactactgatgtttctcagtctccttaaagttacgtccatgcttt

SEQ ID NO: 25493 - DNA, 466 bp, Homo sapiens
  misc_feature 2: n = A,T,C or G
anaatccccttttattactgtttattacttccatgaattttaaaatctgagggaaatgttttgtaaacatttatttttttaaagaaaagatgaaaggcaggcctatttcatcacaagaacacacacatatacacgaatagacatcaaactcaatgctttatttgtaaatttagtgtttttttatttctactgcaaatgatgtgcaaaaccttttactggttgcatggaaatcagccaagttttataatccttaaatcttaatgtcctcaaagcttggattaaatacatatggatgttactctcttgcaccaaattatcttgatcattcaaatttgtctggttaaaaaataggtggtagatattgaaggccaaagaatatcgcaaaatcatgaagcttcatgcacttaaagaagtattttagaataagaatttgcatacttacctagtggaacttttctagaattat

SEQ ID NO: 25494 - DNA, 374 bp, Homo sapiens
  misc_feature 2, 5, 54, 373: n = A,T,C or G
cnccncagtttgcgaactgagctttggaacaaagcccataaacagaaccaaacncttaggtgaatttagtataaaataaggcagcctttcaaatctgtagggaaagagtgggttattcaaaaaatgatgttgagacaactggccacccttggaaaaacagttaagttcatttttaatctcacacctttcatccaaacaaattccagatgaaggaaaacttttaatgggacatgaagctgtaaaaatctagagggaacaaaaaaatgtatataatcttccaggtgggaaggatgtgttaaacatgaaggagcataccatgaaagaaaaattgaatgttgagtgcatatttttaaatctcttgttaaccctcctnc

SEQ ID NO: 25495 - DNA, 455 bp, Homo sapiens
  misc_feature 48: n = A,T,C or G
gcaacaactgtacatatacacaaacacatacccagaaataagggaagncaaatgtgactagagcctagaaattgcttaaacgagatgaaaagtaaatgttctgtgggaatactgttattggaacttttcttaggtttgaaatttttcaaagaatttatagttctcctagcctatataagaaattatgtgaatatgtgtttgtgtacgcacacatgcatttttgagaacatttagggtatttactaatatcctatttcccaaggaatctcctcagcatatgtacattttattaagtagttctgctctgcataaatatcctaaactaaaatgttctgtcttctctataaaattataccatttataaggttcttgaaatgttttcctaaaatggcctaacaaaccttgtaccaaatctttatcttgtgcaaaacgaacgtctttatgaatttttaaca

SEQ ID NO: 25496 - DNA, 461 bp, Homo sapiens
  misc_feature 3, 16, 30, 32, 46: n = A,T,C or G
cancgcaggggcttcngctgagtggtggcntncttcccttacgganttacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacaagccatccaccttcagatgtgtctacgtgcgctctgccattcaactcggaaactataaagtaattctcaag

SEQ ID NO: 25497 - DNA, 475 bp, Homo sapiens
  misc_feature 2, 17, 35, 64, 384, 406, 466, 472: n = A,T,C or G
gngaaacaagcccaatnagcctagtaggtacattntctcaggcaggaaactttataggccaggntagagtaggatgatatgttcaaaatgttgatggaaaaaaaaaattgctaacaatgaatagtgtagccggcaaaaccgttctttagaagtgaaggagagaatgatactttcccagataaagctgagaaagtttatcaccaccacacctgtttttacaagaaaggctagtggagtcttcaagtggaaagaaatggaaggttaataataacatggaaacgtacgaaagtataaaacttacatagtcaaatttggaatctccaatctgtaatggtgtatgtaaatcatttacatctttagtttgaaggttaaaagatgaagctnttaaaatggatttaacaacttntaaagtttttccaaaacaaaaagacttaaattgtgccatcaaaaactaaaatatgggggngatggnggg

SEQ ID NO: 25498 - DNA, 429 bp, Homo sapiens
  misc_feature 5, 314, 394: n = A,T,C or G
gtganctacattgtcaaagaggctatagaaagcgcaattggtggtaattcttatcaacacagcaaagtgaaccagtggaccacaaatgtagtagaacaaactttaagccaactcaccaagctgggaaaaccatttaaatacatcgtgacctatgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggnctttctcctttgctctagttcatcctctaaccaccagccatgaattcaagtgaactcttttctcattctctttgttttgnggcactttcacaatgtagaaaaaaaaaccaaatga

SEQ ID NO: 25499 - DNA, 302 bp, Homo sapiens
  misc_feature 9, 15: n = A,T,C or G
cccaatctnaaagtnatattggaaaacatggaaatattaaaattttacacttttactagctaaaacataatcacaaagctttatcgtgttgtataaaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgt

SEQ ID NO: 25500 - DNA, 428 bp, Homo sapiens
  misc_feature 4, 17, 28, 41, 84, 87, 93, 95, 98, 99, 117, 118, 123, 165,181, 320, 401: n = A,T,C or G
aacnatccaggagtacntgagaccttgnggatcaacagaanttgactgacatccttttctgtccttccccttcctggtccttcngcncatgtnancgnnacagacacctttgtatgnnccttngtatgttcctatcaggctgatttttggagaaatgaatgttgnctggagcagagggganaccatctagggcgactcctgtgtgactgaagtcccagcccttccattcagcctgtgccatcccttggcccaaggctaggatcaaaagtggctgcagcagaattagctgcctagcgcctagcaaggtgcctttgtacctnaagcgtttaagtgtgaaatgttcaagtgaaccaaagtctgatccttgttacatgttggttttatggatttctatctattgnggctttaccaaaaaataaaatgtccta

SEQ ID NO: 25501 - DNA, 286 bp, Homo sapiens
  misc_feature 4, 6, 28: n = A,T,C or G
ctgntnttagactttcttatcacttatngttagtaatgtacacctactctatcagagaaaaacaggaaaggctcgaaatacaagccattctaaggaaattagggagtcaggttgaaattctattctgatcttattctgtggtgcttttgcagcccagacaaatgtggttacacactttttaagaaatacaattctacattgcaagcttatgaaggttccaatcagatctttattggtattcaatttggatctttcagggatttttttttttaaattattatgggac

SEQ ID NO: 25502 - DNA, 354 bp, Homo sapiens
  misc_feature 2, 6, 27, 40, 61: n = A,T,C or G
ancacnaggcctgccttacaagagctnctgaaggaagctnttaacatggaaaggaacaacncggtaccagccactgcaaaaacataccaaattataaagaccatcgacactgtgaagaaactgcatcacctaacaggcaaaataaccagctggcatcataatgacaggatcaaattcacacataacaatattaaccttaaatgtaaatgggctaaatgccccaattaaaagacacagactggcaaattggataaagagtcaagacccatcagtgtgctgtattcaggagatccatctcatgtgcaaagacacacctaagctcaaaataaagggatggagaaatatttaccaagc

SEQ ID NO: 25503 - DNA, 330 bp, Homo sapiens
  misc_feature 2, 11, 60: n = A,T,C or G
gncaagacaancgtgtccttcataatgaagttaaagtgagtatactgtggagaggacttncaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagc

SEQ ID NO: 25504 - DNA, 378 bp, Homo sapiens
  misc_feature 10, 351: n = A,T,C or G
gaaagaatcnaactcctgcggctctttggcctgaaagttgggaatggttgggggagataagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgacccaaatgtgtagtgtggtctggcaggcagacctttaggttttgctgcttagtcctgaggaagtgccactcttgtggcaggtgtagtatctggggcgaagtgttgggggtaaaagcccaccctacagaaagtgnaacagcccggagcctgatgtgaaagga

SEQ ID NO: 25505 - DNA, 304 bp, Homo sapiens
  misc_feature 10, 23, 27, 28, 39, 41, 50: n = A,T,C or G
gtctatttgncacagagatagcnatgnnttgatacctantnaaacggttncccctttgaagggttgaatattgttcacatagcaccccagcctgtggtgtatatgtttaatctgtcaaatctcattaaatttttcttctataagaatgctaatgataccaatttctagaattgaatgatttctactctgcctgttggactgcaaatttgaaatcccctatgataattagacccctccttagagtatattataatgaccatcgaacctgtatctaaaaattctagtaacttaaccatccagtctt

SEQ ID NO: 25506 - DNA, 414 bp, Homo sapiens
  misc_feature 361, 396: n = A,T,C or G
ctattttccccggcgcctcggaggcgttcaagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgctgctactgagtaaggggcattcctgttacagaccaaggagaactggagaaagaaagagaaaatcagttcgtggttgcattgtggatgcaaatctgancgttctcaacttggttattgtaaaaaaaggagaanaaggatattcctggactg

SEQ ID NO: 25507 - DNA, 414 bp, Homo sapiens
  misc_feature 13, 18, 59, 61: n = A,T,C or G
atacattatccgnacttnttaaaagaaacattggaccctggtgatcctgagacaaacantncaataagaggaacttttgagcatgctgttctagctgcaggaacagatttccgttctgacagactgtgggaaatgtatataaactgggaaaatgagcagggaaacctgagagaagttacagctatatatgatcgtattcttggtattccaacacagctgtatagtcatcattttcagagatttaaagaacatgtacagaataatttgcctagagatcttttaactggtgaacagtttattcagttgcgaagggaattagcttctgtaaatggtcatagtggtgatgatggtcctcctggtgatgatctaccatcgggaattgaagacataacccgatcctgcaaagctaattac

SEQ ID NO: 25508 - DNA, 202 bp, Homo sapiens
  misc_feature 197: n = A,T,C or G
tggccattcacagcccagcagaggctggaacctgcagaaacagctctcaattgtcagaagaggatttggttaggtttaaggaaaatgtgctacaacatattaatggataatttggagagtatttgaacttttattcttagagaatattttaaattaaaattttttattattagaactatattgcagaaaactttatnaaaga

SEQ ID NO: 25509 - DNA, 275 bp, Homo sapiens
  misc_feature 3, 4, 30, 52: n = A,T,C or G
ganngagaaagcccgacacatgctgccctnccgcgaagacctgtaaatgttncggacttaccctttaaattattcagaaggatgtcccgtggaaaatgtggccctgaggatgccgtctcctgcagtggacagcggcggggagaggctgcctgctgtctaacggttgattctcatttgtcccttaaacagctgcatttcttggttgttcttaaacagacttgtatattttgatcagttctttgtaataaaattgaccattgtaggtaatcaggagg

SEQ ID NO: 25510 - DNA, 361 bp, Homo sapiens
  misc_feature 2, 5: n = A,T,C or G
anagntcagatgaaagttgagaaaactaaggagagtcgtgaagcagttgagaaagaatttgagcctctgctgaattggatgaaagataaagcccttaaggacaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaagatgataaaacagttttggatcttgctgtgg

SEQ ID NO: 25511 - DNA, 341 bp, Homo sapiens
  misc_feature 9, 45: n = A,T,C or G
agatcgagngacgaactagatacaatttgtcccaaagctcccaanttagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagagg

SEQ ID NO: 25512 - DNA, 355 bp, Homo sapiens
tctccggaacacaaagggagcacacagctcttcttaaaattgaaggtttttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttacta

SEQ ID NO: 25513 - DNA, 403 bp, Homo sapiens
  misc_feature 46: n = A,T,C or G
gatgaaccaacccttatctggcaacataattgcagcacaataatgntttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccccccctcccttcgcacataggcatttggtttgcttccatctttttttatgcagtgcctgtttttttttaaccaattaaaatcccttttgttgatgagctattgagagc

SEQ ID NO: 25514 - DNA, 454 bp, Homo sapiens
  misc_feature 11, 15, 28, 30, 44, 70, 106, 425, 446: n = A,T,C or G
agagaatatanggancgagcggatggtnanaaggacacctactnttcttggcttaacccttctggaaggntctgactgtgtagacccgcagcaaatagttcatgtnggaaagaatgaaaacaactcaagttcatagcagccagcctgccgcattggacctcccttttaaaaactgagaccaagactcccatcagctggtctcggatttacatcggaactgctcaggattgatacatttcaagtctgtaaatacggcaccaacgccatttaccctaatttaagaacagcggggactgaccctccgtgccgagggctgcatgctacccgcactaagtcaatacatggctcccgattcgcagctgcgtcttgcagcacttgtcacgttggcagcactttgagagcaagtctgagtgggcccacatgtnacctgctatgaaaaccatttnatagtgtg

SEQ ID NO: 25515 - DNA, 386 bp, Homo sapiens
  misc_feature 47: n = A,T,C or G
caggatggttggatctccttgaagtgcttccctctctgtcactcttncttttcttcatttctcactcagtggtgagagatcttgatgccaactggaaccacctgtacctcagtgacccacctgagcaccaaaaaatcacacaggttcttctgccatgagtgaaagagcaatgagcttacagagctaagtcccacttagcttttcaaatatctttatgtactctgaagagcctatatttgagttctgaagccaggatttcttgtcttgatccatgaaatctaacctgctgcactagatttacctaaaaggtattccaaaaagattttacgaataatagcaacatttataaaagaagaaatgcaagtagccaacaagccaacaaacac

SEQ ID NO: 25516 - DNA, 297 bp, Homo sapiens
  misc_feature 10, 16, 30, 60, 68, 102, 123, 249, 269: n = A,T,C or G
tgagggcctngcgccnaagctggacccggnggagatgaaacggaagatgcgcgaggatgngatctctnccatacggaactttctcatctacgtggccctccngcgagtcactccatttatctnaaagaaattggcagcatatgaagacaggacatcacatatgaatgcacgatatgaagagcctggttacagtttcgactcctctctgcaagtgaataggcccagaaaggtgtaagagactctttgaanggacataaaactctgcttgntaagaacaagtttggctctggtaactga

SEQ ID NO: 25517 - DNA, 337 bp, Homo sapiens
  misc_feature 2, 6, 336: n = A,T,C or G
cnatanaaaatctaaagtagaaaaataaataattggctgggttcgtgcagtggctcacgcctgtaatcccagcactttcagaggctgaggcaggaggattgcttgacctcgggagttcaagaccagcctgggcaacatggtgagaccccatctctgggaaaagatgaaaaaaaaaattagccaggcatggtggcttccacctgtagtcccagctgctctggaggctgaggtgggaggatcacttgagcacaggagattgaggctacagtgagccctggtcacactattgcactccaacctgggcagcagagccagaccctatcttagaaaaacaanc

SEQ ID NO: 25518 - DNA, 430 bp, Homo sapiens
  misc_feature 4, 14, 29, 46, 47, 48: n = A,T,C or G
aaantcttaggaangttggaaggaagaanggaaatattgggatccnnntttaaaaattatatcaagattttgcagggcctttctgtgcaccacctccttttctagtttaattgtaacacaaatccaattctgtgatagtgaaacaaatcagatactaaagttaagaatgaaaaaaaaaattgtaaaaagttggataggaatgaattttacttcttttaaaatacttatatacttttattgcaaccatttatgttattttaattttcaaagcaatatattttaatttttattttaattttttaaaatttattttaatttaaaatttattttaatttttaaagcaatatattttaaatgcagcttatagtgtccagttgatccttgaaactgcttcttgtatttatttttcaaatcccatactaagattctg

SEQ ID NO: 25519 - DNA, 336 bp, Homo sapiens
  misc_feature 46, 48: n = A,T,C or G
aacccctttgctcatcactcatttccaaaatttatattttcaaagntnattttgtacagagttcctaaaaaaagggatcatgatgccagtgtattgcctcactgattgctaaatgaagaggactatactgaagcattcaaagaacgtgatgtgcctctggggcgactgaaggattgctatctgacttatgcatttaaaaccttcaaagtggaagtttgtctggaatggcttaggcaaacagactgggttggattgagaattgaatgtatacataaaatttggtttggtcagatgagaacaccaaatgtggtagctagctcacctttatttatgaga

SEQ ID NO: 25520 - DNA, 123 bp, Homo sapiens
gagctgctagggtcattacagctttttacttttgtcatattttgcaaaacatttgcctcttgctattaatatttgctttgtaaaaattactgacatttaataaacatttgtaaacaattcaga

SEQ ID NO: 25521 - DNA, 127 bp, Homo sapiens
  misc_feature 3, 39: n = A,T,C or G
ttnctaagatattgcttagccgttaagtttttaacgtanttttaatagcttaagattttaagagaaaatatgaagacttagaagagtagcatgaggaaggaaaagataaaaggtttctaaaacatga

SEQ ID NO: 25522 - DNA, 349 bp, Homo sapiens
  misc_feature 3, 6, 59: n = A,T,C or G
tantgnacccgacaacctttgcaaaagaggaaacagagtttttatcaatccattctcanttgaccaatttggaagacattgatgtcaatcataaaagcaagttatcttctctgcaagatcttgaaaaaactaaacaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgc

SEQ ID NO: 25523 - DNA, 403 bp, Homo sapiens
aaaacaacccaatcactcactgaaattatgctttgtaaaatatatatttttaaattttcggactcggccgtgtatattcaggaaatgtaaattatctattaagacccacaatcatttgtgagatgtttatattgttctctgataggtatagatgacattaatttcaatagatgttcattcatgcattcattcatttattttttgttcagaaaatgtttatcactgtgtactggacactgagaaaatgacagtggcaaaatagacaaagtctctgcccccatggagattaaattccattgcatgctggtgtctggtcataggatctgaatgtctagttagaaaggaggcagatatgaccagaattatttcagaacgatatagtacctcctacacctttcacctg

SEQ ID NO: 25524 - DNA, 336 bp, Homo sapiens
  misc_feature 4, 13, 55: n = A,T,C or G
aaanccccaaaantcggtgaatccaagagctggttttttgaaaagattaacaaanttgataaactgctagccagactaataaagaagaaaagagagaagaatcaaatagacacaataaaaaatgataaaggggatataacccccaatctcacagaaatacaaactaccatcagggaatactataaacacctctacgcaaataaactagaaaatctagaagaaatggataaattcctggacaaatacaacctcccaagactaaaccaggaagaagttgaatctcttaatagaccaataacaaattctgaaattgaagcagtaattaatagcctacca

SEQ ID NO: 25525 - DNA, 395 bp, Homo sapiens
  misc_feature 3, 4, 51, 338: n = A,T,C or G
ccnnttagcatcttttttaaacaaagtcatattgctcttctgtgcttaatntatatgtatagagaaataaaagctggtaacataattagttttttctacctttataataaatgtgtttttggctgggcgtggtagctcacgcctctaatcccagcaggttgggaggtggaggttggtggatcacctaaggtcaggagtttgagaccagtctgacccatatggtgaaaccccgtctctactaaaaatacaaaaattagccaggcatggtggtgcacacctgtagtcccagctactcaggaggctgagacaggagaattgcttgaactcgggaggcagangttgcagtgagctgagattgtgccacttgcctccagcctgggtgacaagaagtgaga

SEQ ID NO: 25526 - DNA, 403 bp, Homo sapiens
  misc_feature 2, 8: n = A,T,C or G
gngaattncccagccagcgcaggggcttctgctgagggggcaggcggagcttgaggatccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagt

SEQ ID NO: 25527 - DNA, 424 bp, Homo sapiens
  misc_feature 1, 3, 59, 397, 418: n = A,T,C or G
ngnaaggaaccgataaaaggtttctaaaacatgacggaggttgagatgaagcttcttcntggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatctaaagcctagttaacgcatttactaaacgcagacgaaaatggaaagattaattgggagtggtaggatgaaacaatttggagaagatagaaagtttgaagtggnaaactggaagacagaagtccnggaagg

SEQ ID NO: 25528 - DNA, 466 bp, Homo sapiens
  misc_feature 1, 2: n = A,T,C or G
nnattgcccagccagcgcaggggcttctgctgagggggcaggcggagcttgaggatccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaagtg

SEQ ID NO: 25529 - DNA, 144 bp, Homo sapiens
  misc_feature 48: n = A,T,C or G
gacagtttggaatggctcaaaagaaaatgtgcagcttgcgtgaccacntcaaaagattgtcccacctaggcagctgaagaacaacaacttagccttggcaacaaagcaagatcccgtccttacaaaacaaacaaacaaacatcc

SEQ ID NO: 25530 - DNA, 450 bp, Homo sapiens
  misc_feature 26, 35, 49, 79, 232, 344: n = A,T,C or G
gacatgcacataatatagatacacanggaataatntctgatccaggatngtccttccaaatggctgtatttataaaggnttttggagctgcactgaagcatcttattttatagtatatcaaccttttgtttttaaattgacctgccaaggtagctgaagaccttttagacagttccatctttttttttaaattttttctgcctatttaaagacaaattatgggacgtttgtngaacctgagtattcttctttttaccagttttttagtttgagctcttaggtttattggagctagcaataattggtctggcaagtttggccagactgcttcaaaaaattaatgngtatccagggacattttaaaaacctgtcacagtgtttattgtggtaggaagcaattcccaatgtcctataagaaatgtgcatcaagccagcctgccaacatggtga

SEQ ID NO: 25531 - DNA, 126 bp, Homo sapiens
  misc_feature 44: n = A,T,C or G
aacaggacagagaacaaaaacagctgttagcttgagacacccanagacaagaatctgacaaaaatggggaaagtgcaagtcctgaaagagatagggagagtttgaaggtagaaattgagacatctg

SEQ ID NO: 25532 - DNA, 382 bp, Homo sapiens
  misc_feature 4, 11, 44, 51, 55: n = A,T,C or G
ctgngcggggncttgtgctgagggggcaggctggagcttgaggnttccgcngatnagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagctta

SEQ ID NO: 25533 - DNA, 383 bp, Homo sapiens
  misc_feature 8, 20, 41, 299, 306, 343, 366, 369: n = A,T,C or G
ctgaactntatcaacatctnaaagaggaaaatgggatggtnacaacagaaaatggaaaagccagccggcagtgaagagtgacttgaagaactaaatttagcatattgcaaaaatattttgtgcggaattcgatataagtacttttacagcaagatggtatagttatgttgcctggactggtttttacatttttaaaatatttcagctgcatttttgtctaattataaaattggcacataattcaaaaatatacatttgagatgatttgtcctcccaaattatacaagttattttatggnataaagnggtctctctggaaatgtttttaaaaaaaaattcttangctctctttgcgaaataaaactnttnaaatatttgaaatg

SEQ ID NO: 25534 - DNA, 456 bp, Homo sapiens
  misc_feature 4, 18, 32, 49, 109, 118, 163, 192, 309, 345, 436: n = A,T,C or G
ccantgacagaaatggantcgaaataccagtntgtgaagctgaatgatnttcacttcatgcctgtcctgggatttggcacctatgcgcctgcagaggttcctaaaagtnaagctctanaggccgtcaaattggcaatagaagccgggttccaccatattgatnctgcacatgtttacaataatgaggagcangttggactggccatccgaagcaagattgcagatggcagtgtgaagagagaagacatattctacacttcaaagctttgggagcaattcccatcgaccagagttggtccgaccagcctnggaaaggtcactgaaaaatcttcaattggctatgtngacctctatcttattcattttccagtgctgtaaagccaggtgaggaagtgatcccaaaagatgaaaatggaaaaatactatttgacacagnggatctctggccacatggga

SEQ ID NO: 25535 - DNA, 294 bp, Homo sapiens
  misc_feature 2, 53: n = A,T,C or G
tnccgcagccagcgcaggggcttctgctgagggggcaggcggagcttgaggtnaccgcagataagtttttttctctttggaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtattt

SEQ ID NO: 25536 - DNA, 429 bp, Homo sapiens
  misc_feature 9, 10, 27, 44, 406: n = A,T,C or G
tgtgaatanncatggaggccgcgacgngtgacttcgaaattgtnttccctgctgttccgcaggacctccaccttcgccctcaccatcatcgtgggcgtcatgttcttcgagcgcgccttcgatcaaggcgcggacgctatctacgaccacgtcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgttgaagtatgtttaagtcaagcatgctcangaaataaatgtgaattgcccttg

SEQ ID NO: 25537 - DNA, 264 bp, Homo sapiens
ggggtcaaggaggaaaagctgttgaaaatctttctcctatttatttagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 25538 - DNA, 242 bp, Homo sapiens
  misc_feature 6, 34: n = A,T,C or G
attttnagtaaagataaattatattgtttttttntatgtgtgtttgtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgctggatttttgtgctgtttgccaaacttatacaataaataaatgaaatattgtgcc

SEQ ID NO: 25539 - DNA, 463 bp, Homo sapiens
  misc_feature 3, 310, 321, 363, 399, 410, 414: n = A,T,C or G
gangctaaccaacacaatcggatcgactgttctactaaacaacaggaaaatgtgtatctggcagcctgtggagaaacactaaacattgatttttctttgccttttacggactttgttccagctacatgtaataccaagttctctttaagagtatgtatagttgaatgcattatttattccacaggtgtattagtaaatttgatttcccaaagcttatcttcactctcttctccccagtccattgcaacttcaaagtatttttagctttcctccaatgtctactacctttagtgcacagagttcctgttgntttctttttgnagttaactgcatctaagaaattggcaattaaaaatatctcanggtgattattttcttagagtcatttctgatctctgnggctaatctgnatgntagcccttctagccctaatggttactaatcatatgaactaattttatac

SEQ ID NO: 25540 - DNA, 169 bp, Homo sapiens
atgcaaacccatgaagctgttgccctacctcacaccatatatacaaattaattcaaattggatcatttgcctaaatataaacaatacaactataaaactattagaagaaaacatagcagtaaatctttgtgattttgtattaggcattgattttttagacattcaccat

SEQ ID NO: 25541 - DNA, 463 bp, Homo sapiens
  misc_feature 9, 15, 409, 430: n = A,T,C or G
gctcccggntcggangaggccaaggtgcaacttccttcgatcgtcccgaatcttggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgctctgcctgatcatcaaagccctcaaggaaccaccaagagacagaaaggaacagaaaaacattaaacacagtgggaatatcacttttgatgagattgncaacattgctcgacagatgcngcaccgatccttagccagagaactctttggaac

SEQ ID NO: 25542 - DNA, 355 bp, Homo sapiens
  misc_feature 3, 33, 58, 244, 355: n = A,T,C or G
gancaaggcccgtctatttgcagcagagatatnttgaaaagaagaaaattgttttatnttaaaaggaaagccatgaccacctttctacctcagatccatcttcatccattgcattggaaactgctttgtgctgctgcagtctgcaaagtctagagcttttatcaggccatgtcatacccaagaaagcacctatttaaagaaaaaacaattccctgagctctcaactccaagttgtagatttggngcttccttgtcttactttaaaaagtcatgtgttaattttttttctgcctgtatttgtatgcaaaatgtctctatctgctattaaagaaaagctacgtaaaacactcattgn

SEQ ID NO: 25543 - DNA, 248 bp, Homo sapiens
  misc_feature 4, 48: n = A,T,C or G
gaanaagagtgcaatcaaagttaagtcattatgaggtcaacgttgtanattttatttatatttacctgcttgttttacaaaatggagccatacttcctatgctgtttgctaccttgccttcttttttaaaaaatgtaacagcatatggtgacattagtatataatcatcagtgtcatttataataattgccatatattttgctgtgtggatttttgatagttattaaacaaaacccctattgatgggt

SEQ ID NO: 25544 - DNA, 386 bp, Homo sapiens
  misc_feature 56, 57: n = A,T,C or G
taaaatccccgatgaaaccaaaagtgagcctgaatagccaaggcaatcctaagcannaagaacaaactggaggcatcatgctacctgactgcaaactatactacagggctacagtaaccaaaacagcaaggtattggtataagaacatacacagagaccaatgccacagaatagagaactcagaaataagaccgcatacctacaaccatctgatctttgacaagtctgacagaaacaagtaatggagaaaggattccctattcaataaatggtgctggggtagctggctagccatatgcagaagattgaaactggactccttccttacaccttatacgaaaattgtctcaagatggattaaaaaccatctttaaatgtaaaacccc

SEQ ID NO: 25545 - DNA, 359 bp, Homo sapiens
  misc_feature 2, 4, 306, 321, 347: n = A,T,C or G
ananagagagacagagagagagagatggatatctatctttccctctatgtgggcctctcttagggttctgccttcgttttccacataaacatacttttactgtagttcattctatttccatttctttcaatactatttatattgttgggaaaagaatgattcccaaattagtcatcgtattaaaactcatctctgacatccagataccagtatggaactattaactttatagctgagattggatgctttctatttatgttcaaaactaaatggctgaatctttcactcccattttcatcctactgnttttctcacgcagtnaggtattgccacatctgttcaggtgnggacattcttga

SEQ ID NO: 25546 - DNA, 419 bp, Homo sapiens
  misc_feature 9, 57, 334: n = A,T,C or G
taacatccncacctgtaagaccaaagtgaagacatgaattaagagattactcaaganaaattgattttagtagataaacaaggttttttgaaacaatttgctcccttttgatcacaagagcaggatttttggcctaaagcatctagaaaactgcagtcttccttttcagtgcatatccatggagtagtctacaaccattcaccaatgtgccaggcatagggaattcaagagcaacaaggtgaagaaaatcttaatcagctgattgagaatccattttatggaaagatccacctctttggggaaatggacttgatatttagaaactaaaacaatnttaaaattttcaacaatagaaggacagaaataggatatgaattaaacaccaagcctgtggtaatttgctttcagtgaaaaagatg

SEQ ID NO: 25547 - DNA, 472 bp, Homo sapiens
  misc_feature 1, 402, 465: n = A,T,C or G
ngaaattcccattaataaaagttgattaaaaataaatacaataaaaaattgtatattttatatactgtaaaatcttatctcatattaatataaattaaataaaaagcattctcacaagacagagaaatatttcatactgataaaaggttcaattcaccaggaatatgtaattgttctacaactctaattcacttactaacatagctttaaaattatataagataaaaatgtctgaaccacaaaagacaaaaacacaaattcataatgtagcaaggttttaacacatggtgctcataaatgagaagaaaaaagatatttaaattcagtaaagatataggagttttggaaacagaatgaactattttgaattaaatgacatatgtagatggtttatactcctangggaggcagacgctttttagcccactcaggaatttaccaaaaaatgggcctgtcttgggcccnagtgagt

SEQ ID NO: 25548 - DNA, 100 bp, Homo sapiens
  misc_feature 3, 25, 27, 35, 49, 82: n = A,T,C or G
ctngactggatgtgtctagtgctgntnttgatcangcaacttcctctgnatacgcgaagcatgtgtcaatcatgggactggntttgacggaccccgcctg

SEQ ID NO: 25549 - DNA, 384 bp, Homo sapiens
  misc_feature 4, 17, 28, 336, 346, 380, 383: n = A,T,C or G
tccntatgtagagatgntccttaccctnttgaaatttcttagccagcattttgttctgcaggggcccactgaagcagaaggtttttctctgggggaacctgtctcagtgttgactgcattgttgtagtcttcccaaagtttgtcctatttttaaattcattatttttgtgacagtaattttggtacttggaagagttcagatgcccatcttctgcagttaccaaggaagagagattgtctgaagttaccctctgaaaaatattttgctctctgacttgatttctataaatgctttaaaaacaagtggagcccctctttatttcatttgggtattgngattgctggncaggaaaaatgctgatagaaggagtggaatctgntgnc

SEQ ID NO: 25550 - DNA, 143 bp, Homo sapiens
ccaggcgtggtggtacatgcctgtagttccagcttctcaggaggtggagacaggagaattgcttgaggctgggaggcggaggttgcagtgagccgagatcgtgccgctgcgctctaatctgggcgacaaagcgagactccatg

SEQ ID NO: 25551 - DNA, 254 bp, Homo sapiens
  misc_feature 1, 13, 59, 60: n = A,T,C or G
naaacagccggtnggcagctgacgggacaagccggggtctattttgttgcgggtttttnncaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaac

SEQ ID NO: 25552 - DNA, 413 bp, Homo sapiens
  misc_feature 2, 399: n = A,T,C or G
anaataaccctttttaatcatttagagtttttttattctctccttcgaaaaatgcacttatgccaaccttttgaatacagtttcaagagtctgaataccttctacatccatccatgggcatagactccaagctgagaacctctgtggtcagaatttcttctcactactgtgttataaagtgcaatttggtgtaagcttaggggaggaagagggagaagacactggactttctattgttagacttgtattttattccaatcctttcatagatttgctctttgattggagataaagtgtaaaacctctctatatcatattctatatctatatgatattctatatcataatttcttggatggcaaaatgtggattaaaattctgtcctttctttcctcaaangaatggtgaaattt

SEQ ID NO: 25553 - DNA, 413 bp, Homo sapiens
  misc_feature 1, 57, 302, 306, 334, 343, 381, 397, 410: n = A,T,C or G
naaaaaaccccacaggttaggagacgtcgctttgaacgtgctataggaccttctcantcacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgcggctatgattactatgccttttctaaagatcaatactatacattgatgtgcctagtagaacagcaagagccattctactcgtctgggcagccntatncaaagctggtccactgtccctagactgntgagccaangaggggccacttatggagaaatggattattaattttgncctggaaaacattttnttattaaagaatnttg

SEQ ID NO: 25554 - DNA, 350 bp, Homo sapiens
  misc_feature 6, 300, 345, 347: n = A,T,C or G
gacaangatccaataatgtctggtcgcggcaaaggcggaaaaggcttggggaagggtgtttgctaagcgccatcgtaaggtgctccgggataacatccagggcattacaaaaccggctattcgccgtttggctcggcgcggtggccgtcaagcgcatttccggtcttatctatgaggagactcgaggtgtgcttaaggttttcttagagaacgttattcgagacgccgtcacctatacggagcacgccaagcgcaaaactgtcacagccatggatgtaagtatatgccctaaaacgtcangggcgcactctgtatggcttcggcggctgaatctaaaaatacgcngnctc

SEQ ID NO: 25555 - DNA, 414 bp, Homo sapiens
  misc_feature 47, 316, 382, 411: n = A,T,C or G
ggttccaacttttctgcttatctgggaggtgttgggcgcggacagtngagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgcctgcttaatacattctanggcagagaacccaggatgggacactaaaaaaatgtggttatttcattatctgcctggattatttgngttttgtacacaaaaaaataaatgtttgnttt

SEQ ID NO: 25556 - DNA, 378 bp, Homo sapiens
  misc_feature 2, 21: n = A,T,C or G
cncgaaagatgacatcacctnttggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaaagcattttg

SEQ ID NO: 25557 - DNA, 475 bp, Homo sapiens
  misc_feature 60, 360, 459: n = A,T,C or G
tctgacttcccattagcaacggtggaagccagaagatagtggaacatcttcatagttctnaaataaaatataaaatcttataaccaccaaaaatgtccatgagaaagagggaaaaactgtatctttgggcttgcaacccacagaaaagagacattatcaaagatgtacttcagggagaaagaagtaatcctttgattacttaaccaaagcaaagagtgtaagaattacatcagagtgtaagaatcaagtaaagcactcaaaatggcaaatgtgaaagtataatgaaacaagaaatgacggtatgcaacaataataaaaatttcttctggtagttaaaaaaatcggaactaaatatgtgcnactatgatatatcaataaaaaaacccaaaaatgcatgatgagaaaatcatgtaaatcaggagactacatgtatccaaatctagatttaatgaacaagcntgggtaagaattgttt

SEQ ID NO: 25558 - DNA, 358 bp, Homo sapiens
  misc_feature 2, 9: n = A,T,C or G
tnaaaaaanccctcagccatgcaaagcagcaagaaaataggacccacagtgaggagatttatcagccaacaatgaccaaccctgaactgacacagaaacagggacattaaaatagagataataccagtttgggaaaattacttaagctaaacttttacacagtttatattctttccttatatgtgttatgcttcaatacagttttattatttaaaaaaatcaaaactgtataaaaagctaagtagaaataggaagatattttaaaatacccaaatctatcttctaaagacagatactataatgtgtgatgtgaagatgcctactggataggattaatgcatattagatgttgcagaag

SEQ ID NO: 25559 - DNA, 328 bp, Homo sapiens
  misc_feature 1, 7, 60, 304: n = A,T,C or G
naaaaanccctcctggaccagatggattcgcagcccgaattctaccagaggtacaaggtnggaactggtaccgttccttctgaaactattccaatcaatagaaaaagagggaatcctccctaactcattgtatgaggccagcatcatcctgataccaaagccaggcagagacacaaccaaaaaagagaattttagaccaatatccttgatgaacatggatgcaaaaatctcaataaaatactggcaaactgaatcagcagccatcaaaaagcttatccccatgatcaagtgggcttcatcctangatgcaaggctggtcaatatacgc

SEQ ID NO: 25560 - DNA, 439 bp, Homo sapiens
  misc_feature 1, 8, 58, 299, 324, 350, 357, 370, 414: n = A,T,C or G
ngatgaancccatatgtttcatatgatctaaactgtattttccaatttaaattaaaantgtaatatagattcagaaaggttcatatttttctaatgacttcattctatattattttgttaggttgcataaagaagcaaggaattgtacttgtattaaaagatgaagaaagctattaggtatatttgtcatgactgcaaatgagtctatgcccgtttaaaagaaaagatggccactattttaaagtgagctttaatatgcctttatataaacaaatttgaagtcaggttaagttgggtgngttacctaacaagccccataagccncggggttggcctatttggataatccnagcccgngacttaatgtgangccttgcttggcttttggctggcctaacctcattggcatgtacncagaacattttaaaccttttttttc

SEQ ID NO: 25561 - DNA, 341 bp, Homo sapiens
  misc_feature 13, 57, 298: n = A,T,C or G
gacaagaacctgntggagctggcaaggtcaccaagtctgcccagaaagctcagaagnctgaatgaatattatccctaatacctgccaccccactcttaatcagtggtggaagaacggtctcagaactgtttgtttcaattggccatttaagtttaagtagtaaaagactggttaatgataacaatgcatcgtaaaaccttcagaaggaaaggagaatgttttgtggccactttgggtttcttttttgcgtgtggcagttttaaggtattagtttttaaaatcagtactttttaatggnaacaacttgccaaaaatttgtcacagaattttgagacccattt

SEQ ID NO: 25562 - DNA, 394 bp, Homo sapiens
atctaagatctttattctctaacgttcttggtcctattgaaacattgcagtatgcaaaactactgcaatgttaaacccaagagaaaagccattatcatgtgtatgctggtcatcatgatcagtgtggtacaatttttaaaaataaactatcatgcccttcatgccattatttgtctttatttctatgatttataatcctgatatgtgatgtgtttgtaacacagggtgtgcacttgagcctggttttactgtttttattagacagagttgtttatatgctgtaactgtaacgcagcgagactggttctacagccatgtgtcgtaatcttgttccccgtccaagctgttgtatctgaaggtacccagtttgcacccaggatgagggaacgcattc

SEQ ID NO: 25563 - DNA, 500 bp, Homo sapiens
  misc_feature 4, 18: n = A,T,C or G
cacncggggattcggccnttatggcggggaggggaaaaagaggcaaacccatcagcatagttgatgattttaagaccagtctttcctaactggtatgaaaactaggcaaaatgttaaggatatagatgatttgatcaacactatcaaaggtcttgccttaattgtcatttataaagcatcagactcaataacagcaaaatatacattattttcaaatgcacatggaatgttcatcaaaatagtccatagtaaggctcaagaattttcaaatgattaaaattacacagattatgttctttgatcacaaggaaattaaattagaagtcggtaacaataaaatagccgaatagcctcggatgtttggaaattagaaaacactctttcatactatcaaagagtcaaggaataactcagttgaaattatgaaatattttaactgaatggtaatgaaaatacaacatacccaaattcgtgaatgcagctgaagctgtgctaagggg

SEQ ID NO: 25564 - DNA, 434 bp, Homo sapiens
  misc_feature 11, 13: n = A,T,C or G
taagtcggccntntatggtccgggaagagaactacagttatgtcagctacccagaacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacttgcacaatagtattgtttttattactggtttaatggagtaatggtacttttattctttcttgatagaaacctgcttacatttaaccaagcttctattatgcctttttctaacacaga

SEQ ID NO: 25565 - DNA, 104 bp, Homo sapiens
  misc_feature 7, 85: n = A,T,C or G
atggcgngggtgatttttgacgttcatacctaatctagactttatgaggaatttttttttttaccctcgtaatttctctggaaangtaattttcttttcttttc

SEQ ID NO: 25566 - DNA, 466 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctcttttttctggaggctggcacctgattttgtatccccctgtagcagcattactgaaatacataggctta

SEQ ID NO: 25567 - DNA, 283 bp, Homo sapiens
gatatggagctgctgagcccataccattgctgcattcttggggggagctgctgttcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgt

SEQ ID NO: 25568 - DNA, 426 bp, Homo sapiens
  misc_feature 2, 26: n = A,T,C or G
tntattggaccggggggcaaccaagnataatgacaggccttggaacttctaggatgtgtcctacaggcaaatccaaacacgtcttctgggctgtgttttcatttaaaatcgattggatgaagttggcaccaaaagcacatttcattgtactcagtattttccctagttctggtctgtgcttgccatattgttgggttcagtatcactgtcaactgagagacaagggcacatgagcaggactgaaagtatttgttctgttccacctctgtacctggcagaaatgttagaactgccaaaggcctggcatgactgaagcctacgaaactaactgtgtgctgttgaggggcaggaaggaattaacaataggaagagattttatttcccttctgaaattttttgtttttccttgaaccttgacatttctga

SEQ ID NO: 25569 - DNA, 371 bp, Homo sapiens
aaacagggtctgctattcagttacaggagtcttttcgaatgtagtcagtatggtacctacaaaccatgatttgtgtgtattatggacaaaaattcatcataattctaatagaatgattttaaagccaagtcagcttggagtatttatacagcttgtatttacttttgctaaaataattgaatttgtaacaattataaggctgcccagatctctttagtgatgagtattgattattacactcagaagctttccctcattaaaaataaagtgttctagtcattgtggctccatcaacagaccttagtgtcattgttacagtaatcatgtgcttgatggatatattgggacctctttaaagcttcagttgtaac

SEQ ID NO: 25570 - DNA, 173 bp, Homo sapiens
  misc_feature 3, 6, 161: n = A,T,C or G
acnggnatcatataaagcaactgtcgacttcagcctgtttgtgagtttagttgtgcatgcctttgttgtatataagctaaattctagtgacccatgtgtcaaaaatcttacttctacatttttttgtatttattttctactgtgtaaatgtattcctttgnagaatcatggtc

SEQ ID NO: 25571 - DNA, 489 bp, Homo sapiens
  misc_feature 1, 14: n = A,T,C or G
nttggccggggaancctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtaggaggcgacaaacctaccgagcctggtgatagtttggttgtccaagatagaatcttagttcaactttaaatttgcccacagaaccctctaaatccccttgtaaatttaacttgttagtccaaagaggaacagctctttggacactaggaaaaaaccttgtaggagagagtaaaaaatttaacacccatagtaggcctaaaagcagccaccaattaagaaagcgttcaagctcaacacccactacctaaaaaat

SEQ ID NO: 25572 - DNA, 105 bp, Homo sapiens
  misc_feature 13, 24: n = A,T,C or G
aaacctgaagaanccagctaaacnaaaagacagagctctaattctaaagcgacaactcctaaacctcaaaagccaaccaaagcacccaaaaaaccccactttcta

SEQ ID NO: 25573 - DNA, 252 bp, Homo sapiens
  misc_feature 2, 24, 28, 36, 38, 44, 48, 50, 55, 101, 104, 143: n = A,T,C or G
anaggggggtgggggggcgaaaanaggnggggaagntngactcntccntnctcanggaactcaacattactagtcacaagcccctatacttccctctacantantttaccacaacacaatggggctcacttcacccatcacanttaacaacataaaaccctcattcacacgagaaaacaccctcatgttcatacacctatcccccattctcctcctatccctcaaccccgacatcattacccgggttttcct

SEQ ID NO: 25574 - DNA, 317 bp, Homo sapiens
  misc_feature 27, 284: n = A,T,C or G
tggcccggggaggcattgaggcagccnagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaancttcttcatggagtaaaaaatgtatttaaaaga

SEQ ID NO: 25575 - DNA, 331 bp, Homo sapiens
  misc_feature 2: n = A,T,C or G
ancgtaaggacttgtactatattaccataatcaactaccgtaatgtatgctataggccaagcgcggtggctcacatctgtaatctcagcactttgggaggccaaggcagggagatcacttgagctcaggagttcgagaccagcctgggcaacatggtgaaatcctgtctactgaaaatacaaaaagtagccaggcgtggtggtgtgtgcctgtggtcccagctcctttgggtactgaggtgggaaggatggcttgagcctgagaggtcaaggctgcattgagccatgatcatgccactgcactctagcctgggtgacaaagtgagactgtt

SEQ ID NO: 25576 - DNA, 424 bp, Homo sapiens
gcattttaaaatatcttacattttattttttgagaaataaagttggtgcagtcgctacccttgctggtatgacctacaatgtgctgcatttcagtttctaatttctgaatgtgaagatgacgagccttgttttttcctaatataatgacaacaaacacaaagctctacccaaaatatacattacattgtaaatatttcaagtttgtgccagttaaggacagttgtgaaggacaggtgatttttattctatttacttatttattttcaccattgtggaaacagtggaagggaataaaagcactcgcacccatccgctctgtttgctggctctctgatgacaaacggccgatatgtggagagcacatacctcatttacatcagatgcataatgtactctatctgggatattagcttctcggtcttg

SEQ ID NO: 25577 - DNA, 381 bp, Homo sapiens
  misc_feature 2, 3: n = A,T,C or G
cnnttggccgggagaaatcaacaggacagacgagtactcttctaagatgctgtggaggggtgggatggaaggattgacaggagccatgtttgggtttctcttcccttctcagtatatatttcctaatatcaatatttctcaggggctataaacattttcttctttgtccagctcaagatacagattgaacttcaaacaaggtagaccagagacaattttttatttgaatgaatagaatggtggactaaaataaaaggaaaaataatgtcttgattgtaactgttatcttagttgtgacaatacattgaggccatcttatctaacactgttggagtattataagggcaataagtttaatctcttccttataagtttggaagc

SEQ ID NO: 25578 - DNA, 279 bp, Homo sapiens
  misc_feature 13, 28, 63, 217, 237: n = A,T,C or G
ggaataagaagantcaagccaataaaantttaaaaaacagtttttacactgatatgaaaaagngatcattttgattggcaactcgtatctcagacaaaaatagtatctccaaaaaataagagctcctgcgaattgataagaaaaaagaccaataactttttaaaattaattttttggcttaagaggcattacagaatttacagaaaataagtatgtntagatataggataaaacagngttcggaggaatatccatatctttaaacatgactattacagg

SEQ ID NO: 25579 - DNA, 240 bp, Homo sapiens
  misc_feature 9, 18, 96, 119, 122, 129, 134, 139, 206: n = A,T,C or G
tttgaggcngcccagcgnggggcttctgctgagagggcaggcggagcttgaggaaaccgcagataagtttttttctctttgaaagatagagattantccacctccttaaaaaatatagncantaggttnctaanatatngcttagcgttaagtttttaacgtaattttaataccttaagattttaagagaaaatatgaagacttanaagagtaccttgaggaaggaaaagataaaaggtt

SEQ ID NO: 25580 - DNA, 388 bp, Homo sapiens
  misc_feature 1, 2, 25, 34, 54, 57, 65, 85, 92, 98, 179: n = A,T,C or G
nnggcgcggggtgcaggggaggagntagaaaaangattcatagcttgtaaaaanggnttgggganatttatgactacttattttngaaaatnccaagnatttcccagaacctagaattgttgagtaattttctgcttcattttgaaagtaagaatatgccatctaagggttaatacttnactttaggcaaccaaagggggaaaggtaaacgttacccttattttatagcttccctgtctaattctcaaagtttttatgtatataaagttgcctactatgcaaataatttgaatatgttaatgttgcctaagtgatacatctcttcatctgtatgcatgtgattaatataacctgaccaccttacgcagggggctgaaaccattgcaac

SEQ ID NO: 25581 - DNA, 487 bp, Homo sapiens
aatattacaaagttacagtaatcaaaaaagtccggaactggcataaagacagacatataaactaatgtaacagaatatagagcccagaaatacatgttcgtgtatatggtcaaatgatctttgaagatggtgccaagaccattcaatggggaaagggcagtctcttcaataaacgttgttgggaaaacagctattctctttgcaaaagaacgaagacagacccttatcttataccatgcacaaaaattacctcaaaatggattaaagatctaatagttaagtctaataggtaagacctgaaactatgaaactcacagaaggaaatatgcagaaaaactttatgacattgaaatgggaaacgatctcttggatatgataccaaaaagcacagacaacttatacaaatgtagacaaatgagactacctcaaatttaaatattttctgcatcaaaggaaacaatcagcagagtaaaatggcaacaacaga

SEQ ID NO: 25582 - DNA, 431 bp, Homo sapiens
  misc_feature 2, 19, 424: n = A,T,C or G
cnccggggtaattcggccnttatggaccggggtgcggagaaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtngaaaaac

SEQ ID NO: 25583 - DNA, 316 bp, Homo sapiens
gaccggggctctttttccggctggaaccatggagggtgtagaagagaagaagaaggaggttcctgctgtgccagaaacccttaagaaaaagcgaaggaatttcgcagagctgaagatcaagcgcctgagaaggaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcaga

SEQ ID NO: 25584 - DNA, 311 bp, Homo sapiens
  misc_feature 13, 16, 32: n = A,T,C or G
tactgtcggcaanttntggtcgcgggattgcnagaagcctgcctggggaatacagcatgaaagtgacaggagaaggatgtgtctacctccagaacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctcttggggcttttccattttccccctggaagccca

SEQ ID NO: 25585 - DNA, 426 bp, Homo sapiens
  misc_feature 15, 33, 36, 41, 224, 231, 378: n = A,T,C or G
tggcggggtgaagcnaaagcctttgccctagcnatnaagantgttgccgttaagaagaccttggatgttgttccagttatgctggattccacagtgaaatcatttaaaaccatctaaataaaccactatatattttatgaattacatgtggttttatatacacacacacacacactctgacattttattacaagctgcatgtcctgaccctctttgaattaagnggactgnggcatgacattctgcaatactttgctgaattgaacactattgtgtcttaaatacttgcactaaatagtgcactgaagaccagaaaattttacaatatttttttctctacaatatgttctgtaggaatgtttaccctctttatgaagngaattaccaatgctttgaataatgttcacttatacattcctgtacaga

SEQ ID NO: 25586 - DNA, 307 bp, Homo sapiens
  misc_feature 4, 29, 124, 200, 278: n = A,T,C or G
tctnttggcgcggggataattaaaaactnagtggaggaaggcagcccagcatcctgaaggagctgtgataaccatctccaaatgcaccatgaagctgaaggagacaaaatcaagatcaaaaccntcaaactattggaagtttcagatgaaaggaatcaagattgtggggaaatggaagcaagtgaaggtagacccaaatntgtttgtaagtggacagatggctgatgtggtatgctttgaggaactgagattactgggttggtcccctctgccaaganttcctccagtctcttctcaaaggaggcat

SEQ ID NO: 25587 - DNA, 344 bp, Homo sapiens
aatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagaggtgggaagaattgcaggaagaaaaagaatgtgaaaaaccacaaggggatgaggaagaggaggaggaggaggaagaagtggaagaaga

SEQ ID NO: 25588 - DNA, 340 bp, Homo sapiens
  misc_feature 22, 23, 73, 118, 214, 217, 220, 277: n = A,T,C or G
atttgtgaactgagctgctatnnagttgttaatttcataacttttttcatctttctgaacaagacttttcagnggccaaatagtcaggacattcaaaggtttatgtggtaatatcagngatatttcgaactgtgaaaatggacttaataattagaccatttctacaaagaacaactgaataggtggaaaacatggaatttcttttaggtgcagnggnggncttcaaattacattagttttttttatatatattttaaacatatgtaagaaattaagnggcaaagaactgagaaagcttaagacctgcttcaaaagcctgaaaaatggaaaaataaaattg

SEQ ID NO: 25589 - DNA, 461 bp, Homo sapiens
  misc_feature 4, 10: n = A,T,C or G
gtantcggcnttatggcggggggaatatgaagacagtgcctacaaccaccacatacacagtaaacattctctcttctcagtggttgaagttgttcctgattacagctctcttatctgttctccctttgatttgctgactgatggatgcagtccatttaagaaatgagcatagcatattggaaagagcactagacttagattctagtcccagttctgtcacttaacagctatgtgttgaggtgaggtgagggaagagtacttggatctctggatctcttttaactttaatattctcctctataagggtagaagatgaactagaggatcacaacagtaccatttagttttccgttcagtggcaattttgacatacttttttgagcatacataatctcagaatcctatgcctcaaaactttgattcattggacagatttcaagaaaaatataatttaacaaatg

SEQ ID NO: 25590 - DNA, 368 bp, Homo sapiens
  misc_feature 116: n = A,T,C or G
atggagaaacgacacaggttaggagacgtcgctttgaacgtgctataggaccttctcaaacacacaccatcagaattcaatattcacctgccagactggcttatcaagacaaaggngtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatg

SEQ ID NO: 25591 - DNA, 335 bp, Homo sapiens
  misc_feature 277: n = A,T,C or G
atacagactcaaggacgcagcaagtggcggagcaagaatcacactcaggcagtctctctcctttctgaacagagatgagccctaagataccctggaagattttgtttttaacctcacattaaggaaagcacacatcaccttgaaaggttgcacactttactcctatgatggtgccattgcacagaaacatttcagaatacttttctaaattaaagagtttgtggagtgttttataaatatcaatgctaggaaatctttatcaaatgaagataggttngactttttgaaacaaaagtcattcagagataagtctggtgtgattgaagccaaatcat

SEQ ID NO: 25592 - DNA, 404 bp, Homo sapiens
  misc_feature 3, 12, 67, 403: n = A,T,C or G
tantgtcggccnttttggccgggaaaagctgtagaagaaaagattgaatggctggaaagccccaagnatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaana

SEQ ID NO: 25593 - DNA, 321 bp, Homo sapiens
  misc_feature 5, 19, 27, 31, 34, 52, 97, 122, 130, 144, 165, 171, 202,226, 256, 267, 300: n = A,T,C or G
agggnaaaagattttttanccccccantggnaanaaagtggggttggggggnaattttttttttggtttttggtttttggtttttttggtttttttnggtttttggtttggtttttggtttnggtttttnggtttttttttttnggcccaccttaaaattttttnaaggtnattttccattttcctggccatttgcctaagnataaaaaaaagcctggaaaggttnaccttttaatggtttttgggcccttttttnaaatggccttncaattttccaaataattgggacaatttttggtnaagttttgaacccgggggggg

SEQ ID NO: 25594 - DNA, 216 bp, Homo sapiens
gaggcattgaggcagccagcgcaggggcttctgctgagggggcaggcggagcttgaggaaaccgcagataagttttttttctctttgaaagatagagattaatacaactacttaaaaaatatagtcaataggttactaagatattgcttagcgttaagtttttaacgtaattttaatagcttaagattttaagagaaaatatgaagacttagaaga

SEQ ID NO: 25595 - DNA, 381 bp, Homo sapiens
tctgtccggccctctttggccggggctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactg

SEQ ID NO: 25596 - DNA, 349 bp, Homo sapiens
gaaagagctcctgaaggaagcactaaatatggaaaggaaaaaccggtaccagccactgcaaaaacataccaaattgtaaagaccgtcaacactatgaagaaactgcatcaactgaggggcaaaataaccagctagcatcataatgacaggatcaggattcacacataacaatattaattgtaaatgtgaatgggctaaatgccccaattaaaagacacagactgtcaaattggataaagagtcaagacccattggtgtcctgtattcaggagacccatctcacgtgcaaagacacacataggctcaaaataaaaggatggaggaatatttaccaagcaaatggaaagct

SEQ ID NO: 25597 - DNA, 460 bp, Homo sapiens
  misc_feature 8, 12, 98, 247, 459: n = A,T,C or G
tattggcngggncagtggaagaaaagccaagaagtaaacttttacagtcgttgatttgactataacgctgatccccccaaatcaaaggtaatttcacntttgaagattgcgttctgatttgtagctttaagcgattagagaaaattgtgcaatattcccctctacctgtttgaaaataaacattcttaaaaggatgtaatttagataatgaattgctttctctgaaacttatcccttgggacacctnaaatctgattggttttcaaagcttgggggaaggaaattaattcctgtgttaagtggttggctgaacagaatgtcttgaaaggttagcctgtagcattaggagaaatacctaatgtaaacgacgagttaatgggtgcagcacaccagcgtggcacatttatacatatgtgacaaacctgcacgttgtgcccatgtaccctagaacttaaagtnt

SEQ ID NO: 25598 - DNA, 170 bp, Homo sapiens
attatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacg

SEQ ID NO: 25599 - DNA, 300 bp, Homo sapiens
attacaaaattttgggctttatctaatgatgtgctgatccataatgtttgtatacttataaatgtgttaataacttaaataacttttaaaaagtgaatcttttactgactcaattggttttcccctaaaataatttcttctggtatttgcagtcttgtaggcagttaacagactttaagtaaataactttaaaatgtttagtagcaccttgaaaaaaggcttcaactttatattttatgtaagatatactttgggaagcaaattattttgataaattatgagataaagatatggttcaga

SEQ ID NO: 25600 - DNA, 204 bp, Homo sapiens
cagccctgcccatcagaaagccttcgacgctacagcccaggattggcccactttccccattcacaaatgcctaccgcaggaatgggatggcttttctagcctgctgatgtgacaactgtgatgtgcctgcaacaacaggaaaggcaatgttatattaaggtgatttcttgtgaacaaaataaaatacaaatttacctttctttt

SEQ ID NO: 25601 - DNA, 386 bp, Homo sapiens
  misc_feature 2, 3: n = A,T,C or G
cnntggcccgggccccagatctaaccccctcagactttcagtgaaaagttctacaagggaaaaatcattgggtgattgatttctatgctccttggtgtggaccttgccagaattttgctccagaatttgagctcttggctaggatgattaaaggaaaagtgaaagctgggaaagtagactgtcaggcttatgctcagacatgccagaaagctgggatcagggcctatccaactgttaagttttatttctacgaaagagcaaagagaaattttcaagaagagcagataaataccagagatgcaaaagcaatcgctgccttaataagtgaaaaattggaaactctccgaaatcaaggcaagaggaataaaggatgaactttgataatg

SEQ ID NO: 25602 - DNA, 268 bp, Homo sapiens
gacataaatctgaccagaacacaagcatcttaatttgaatccacaaagtttcatgtaatgaaaagaaatacataattttaattcaacccgagtgttttccaagaagattgtatttgcttaaattgctacagtaattcaagagacagccctgtctggacacagagttactgtggatttttaagagactcagttaaagaatttaggaatttctgattcatttaaaggatttacaaattcatcaacccctgaaaactaaagcaaattgaac

SEQ ID NO: 25603 - DNA, 366 bp, Homo sapiens
  misc_feature 354: n = A,T,C or G
taactacattcttccctgcacaagatgattaatacagatcttagcagaatcttgaaaagtccagagatccaaagagcccttcgagcaccacgcaagaagatccatcgcagagtcctaaagaagaacccactgaaaaacttgagaatcatgttgaagctaaacccacatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaanaagcctctggtg

SEQ ID NO: 25604 - DNA, 248 bp, Homo sapiens
aatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagcctgaagatgatgaggatgacgatgtcgataccaagaagcagaagaccgacgaggatgactagacagcaaaaaaggaaaagttaaact

SEQ ID NO: 25605 - DNA, 399 bp, Homo sapiens
  misc_feature 17, 343: n = A,T,C or G
agagaagattcccgagngtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgctttcgaagtattcaatactgtaggaacaagcatgatcttgttactgtgatattttaaatatccacagtactcactttttccaaatgatcctagtaattnctaagaagtatctttctcttacctgttatttatcaaatttttcccagtatttttat

SEQ ID NO: 25606 - DNA, 413 bp, Homo sapiens
  misc_feature 15: n = A,T,C or G
attctgggtcacagnatataaggtatttaaaatctatttatgctttatagagaaaccagacattaaaacttcatgcactacttatttcgaattactgtaccttatccaaatttacacctagctattaggatcttcaacccaggtaacaggaataattctgtggcttcatttttctgtaaacaactgaaagaataattagatcatattctagtatgttctgaaatatctttaagactgatcttaaaaactaacttctaagatgatttcatcttctcatagtataggagtttactttgtacacgtttgaaaccaactactgtagaagatgaggaatctattgtaatttttttgctttattttcatctgccagtggacttatttgaaattttcactttagtcaaattatttttttg

SEQ ID NO: 25607 - DNA, 396 bp, Homo sapiens
tgcttagaaggaaggacatatgacatgaggggagccacttctgaataagatctaatgttggaaatttttgtttcttcctctcagttccttcattttttttcacatcgatcctatctaccagcccaaaggtggagtgtatttcaggggagcatattgggccatagtactggagaatgtttgctgacccacaatttagggtctcacttaaaatcctagttctgccatttcctagctgtatgtaccgaggtaaattattccatccagttgcatctctttttatcttcctctgttaaataatagtatactccacagagagctcctgtgagattaaatgagctatgcacgtgatgttattctgttacctaaaatggagaccagtgtttgtctaatggagtg

SEQ ID NO: 25608 - DNA, 418 bp, Homo sapiens
  misc_feature 10: n = A,T,C or G
gattctaagnatttggtttgggatcaataggaaagcatatgcagccaaccaagatgcaaatgttttgaaatgatatgaccaaaattttaagtaggaaagtcatccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaaga

SEQ ID NO: 25609 - DNA, 340 bp, Homo sapiens
atgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtgggggtctcaataaaagttat

SEQ ID NO: 25610 - DNA, 446 bp, Homo sapiens
gagctaatccctgaatatctgaacttcgttagaggggtggtagactcggaggatctccctctaaacatatcccgtgagatgttgcaacaaagcaaaattttgaaagttatcaggaggaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttaagaagtgatctatatgaattgag

SEQ ID NO: 25611 - DNA, 416 bp, Homo sapiens
  misc_feature 2, 6, 42: n = A,T,C or G
tntatncttggtatcaaaacaaagaccagcatatagtcaagnaagatcatccaagatattgacctctgtgaaaacagcgtgcagcggcacattggacatgctaacctcaccttcgagcagcttcgtagcttgatggaaagcttaccgggaaagaaagtgggagcagaagacattgaaaaaacaataaaggcatgcaaacccagtgaccagatcctgaagctgctcagtttgtggcgaataaaaaatggcgaccaagacaccttgaagggcctaatgcacgcactaaagcactcaaagacgtaccactttcccaaaactgtcactcagagtctaaagaagaccatcaggttccttcacagcttcacaatgtacaaattgtatcagaagttatttttagaaatgataggtaaccaggt

SEQ ID NO: 25612 - DNA, 240 bp, Homo sapiens
agaaagaaatcacagaagcatttctcaccaatactctttggcttaaaatgttcagcagaattgggcagtgggggtgacttttcttatattaataatatttacatccaatacactgaatcttcctttagaggtaagactttaatatctatactgtaatatttggtttatttggcactactgtaagttttgtttttcacaaagctcttattatgaagcaaaataaaaattctagtttcttac

SEQ ID NO: 25613 - DNA, 205 bp, Homo sapiens
atgttaaagttttgcgaacttaaagggctgactttagttccttcatggtaatggcttgagtaacatcatctttgggattttttaaatactggtccagtctaggagaacctggaagatgaccagaggtatttcagtttccctagggagagcttcgttatccatgtggatgataagtctgcttgatttattattaaatcattatagc

SEQ ID NO: 25614 - DNA, 460 bp, Homo sapiens
  misc_feature 7, 424, 456: n = A,T,C or G
tcggccncttattggccgggggtataggtgatggcatgtctttatggtagcaaaaaatatatatattatagctagaaataaaatagacagcaaacatgcaaacctttaaaaacactttggaagacctaaaaatactgatataaacattactagaagtctgtataggtatccattctcatcaaaaacagtgtaataaaagcccagtcaaaatctcagtgagactattttggggacacttgacagaatgattgcaaagtttagaataaacatgtaaaggtggccaggaaaatgttgaaaaaggatgaagataagggaggaaagggggccgaagaccatctatcaagcattaaaaggaattgtaaattaaaagagtgtggtactggaaccagaatagaatgacagattaatgaaaataggagtaggncagtcagaaacacatctgtgtatgtattaaanaaga

SEQ ID NO: 25615 - DNA, 442 bp, Homo sapiens
  misc_feature 5, 10: n = A,T,C or G
aattntggancgagttttcgctgaatggagtgccatagaaaaaagaaatgggtgatggactgcagagtgctggtcatcatatggatgtgtatgcatcttctattgatgatattttggaagatgaagaacattatgcagatcagttaaaagagtatcttttttaggcagaagcattgcgggctgtgtgcaggaaacatgaacttatgcagtatgacttggagatggctgctcaggacttagcatccaagaagcagcagtgtgaggaactggtaactgggactgtgagaacattctctttgaggggaatgactaccaagctctttggtcaagaagctccagagcagagagaagccagaataaaggtgctagaagaacaaataaatgaaggagaacaacagctaaagtctaaaaatctggaaggcagagaatttgtgaaaaacgc

SEQ ID NO: 25616 - DNA, 381 bp, Homo sapiens
cagaaaaaacttttcaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagaga

SEQ ID NO: 25617 - DNA, 398 bp, Homo sapiens
aattaaaatgctaggtttcctgtaatcgcaatcttcagggaatttttcactcaagcccagaaaataaactccagataatgatactgagaaatttattggttggaaaactgctatctacaggccttccactacctatttcttagtagattttacatttttaaagggttgtagaacaccaaaacaatatatgacagatactgtgtttgggccttaaagcctaccctttatataaaaagtttgttgactcctaggctctcatttgcaagtagacaaatgagaaacagcaaatatttaaggaaaagagcaacatgaaaaatacacagcaaacttaacaagcagaaagaattcctggggaaacaattcagggggaaaaaatgaccaagtataattagtattat

SEQ ID NO: 25618 - DNA, 353 bp, Homo sapiens
  misc_feature 2, 14, 36: n = A,T,C or G
tngttgggcatgcncctgcaccacggctcctagaanacgctgacctggctctcggaaacgcaggagtccttcctggtagccagctcagaatacccatgtagcagcaacttgaacgaatgtcacaacttgtacgttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagttcttctgatgccaatctcaacattgtctttttaatactgtcaccagatattgccatttttctttttgttaaaagattat

SEQ ID NO: 25619 - DNA, 312 bp, Homo sapiens
  misc_feature 1, 2: n = A,T,C or G
nncccccaggaagtagccagaatctgaactccctacttatcaatgaagaaattgaaaaacaaatccaggatttgtacttgatctccttatcttcccctattgctgccaaccgattgtttccacgtgggcagaggttcttaagctttttgttctcaagtcccattttaccttcttaaaaattattgaggcatctgaagagatgttatttatgtggttaattgtattaatagcactttgggaggccaaggagggaagatcacttgaggccaggggtttaagaccaacctaggcaacatggcaagaccacatctc

SEQ ID NO: 25620 - DNA, 359 bp, Homo sapiens
  misc_feature 11, 12, 351: n = A,T,C or G
tattccggccnnttattggccgggatctatgaaaaagcaagcctaccacaaggaatataggcagatgcccagaactgaaattcgaatggcgaggatggcaagaaaagctggcaacttctatgtacctgcagaacccaaattggcgtttgtcatcagaatcagaggtatcgatggagtgagcccaaaggttcgaaaggtgttgcagcttcttcgccttcgtcaaatcttcaatggaacctttgtgaagctcaacaaggcttcgattaacatgctgaggattgtagagccatatattgcatggggggtaccccaatctgaagtcagtaaatgaactaatctacaagccgtggntatggcga

SEQ ID NO: 25621 - DNA, 148 bp, Homo sapiens
gccgagtttctgcctcagaactgtctctcctgggcccagcagcatgagggtcccgaggccattgtctccgaagcgtatgtgccaggtttgagtggcgagggtgatgctggctgctcttctgaacaaataaaggagcatgccgattttt

SEQ ID NO: 25622 - DNA, 310 bp, Homo sapiens
agagacattgtaataatttaacaagcctaagcaggtgataggacactcctttgtaaattaagcctctaatctttctttatgctcatgccgatttgagagaaacctgggaatttccttttcccccattaggctattacacaacttaatgcttggaaaattcttcacaggaagaaacagggtgtaacagtttttgtgaggcatcttttaaaaatgcacccttttagctgaagtctgactatacaattgcctctccacctctttgctctagtttctttttgagagtcttaatttctccacataattatatact

SEQ ID NO: 25623 - DNA, 381 bp, Homo sapiens
  misc_feature 215, 260: n = A,T,C or G
actgagggttgttaacaaagtctgtggctaatctcttttgcttttcccttttaaatgacttggtcttttgtgtatccaaaggatttttttttcacattaaaaaaaaattctaggctgggcgcagtggctcatgcctataatcccagcactttgggaggctgaggtgggcagatcacttgaggtcaggagtttgagaccagcctggccaacatggngaaaccctgtctctactaaaaatacaaaaattagtcaggtgtggnggcatgtgcatgtggtcccacctgctcaggaggctgatacaggagaacgtgggaggtaagaggttgcagtgaactgattgtgctgctgccctccagcctgggcaacagagcgagactctat

SEQ ID NO: 25624 - DNA, 218 bp, Homo sapiens
  misc_feature 218: n = A,T,C or G
aaccctatttatacaaagggggaaagaaacacattcaaaagctagcagaaggcaagaaataactaaaatcagagcagaactgaaggaaatagagacacaaaaaacccttcaaaaaaattaactaatccaggagctgtttttttgaaaacatcaacaaaattcatagaccactagcaagactaataaagaagagaagagagaagaatcaaatagatccn

SEQ ID NO: 25625 - DNA, 115 bp, Homo sapiens
  misc_feature 82, 106, 110: n = A,T,C or G
taattcggccttatggcgggggaggcattgaggcagccagcgcaggggcttctgctgagggggcaggcggagtttgaggaanccgcagataagtttttttctcttngaangatag

SEQ ID NO: 25626 - DNA, 281 bp, Homo sapiens
gcatacagcagcacataaaacgcaaaactctaggacataaaaagtggcattcggacgatgttgctctgaaatttatgcattaattaaaccggtatatatgtatgcattaattaaaccaatatttatgaagttcctactgtgttacagacgtggatccaggcactgaggatgcagcaggccatccaaatataaagttacttccttaggaagcttccattctaatgggagagtgttgttaaagagatatataataatatggtaaaaatgaatccataatggtg

SEQ ID NO: 25627 - DNA, 297 bp, Homo sapiens
  misc_feature 3, 9, 121, 136, 182, 230: n = A,T,C or G
ganagtggntattcatttactttttaaaatacactgggtaaatcacctatacttagagtaacagttggttatcaaaatgcctgataaaatatattcttaataaaagtcttcatttcataangaaatcaatttattnggcatcttaatatattttttttagattcatcaacagaccagttttngggggcatatatatatacacgtgcaaatatcagaattgttaataattngttacacatgggacatttgttccaaactgactaaaaatcaatatagatattttatatacatatatat

SEQ ID NO: 25628 - DNA, 473 bp, Homo sapiens
  misc_feature 53, 388, 407, 438: n = A,T,C or G
gactgtcttaaagattatgctagctttagaacacatgcaaacagctgcagctnctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtaggaaagttgctttatttaaatttgtactgtagaatgtttgtgatacagtatttgtaaaattgatatgaaaaataatttctcaaagtctattgtttgatctagttattttaataaaggactctagaagtttcaagtggccagtgaagtgtgaggaatagagagtaaaggaaataattaataaatggngaccctctgttaagggggnttactttttccattaatataaatttcatttnggaaagattaaaaaaccaggtttgattggaccttg

SEQ ID NO: 25629 - DNA, 444 bp, Homo sapiens
  misc_feature 13, 92, 118: n = A,T,C or G
aaactttaaaagnatgaatttgctttctcaagctcagtcagtggcagaagtggggcatgagacaggccttaacttctcctttcattgcaganccatatgtgatttaatatggcagggnattcaaggaaacccaagtgacttggattccaagttatttggaatatttctgtcctgttgtttttggtctgctttctaaaccacacggttgtgatcttcttccttcgatagtacattttaactcttcttattgaaattgaaggacacatggattccttgctccccccatgtcatgtgcatgtcagatttaatcaggttatctttggaagtcacagccattctgtaggttcagtcactcttggtactcatcagtagaaactaacagataagtctccctgaatgttctaaaataaatgtttctatgaatccagaaagtcataatagatt

SEQ ID NO: 25630 - DNA, 348 bp, Homo sapiens
gccctttccggcggtgacgacctacgcacacgagaaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccattctcaataaacacattttggat

SEQ ID NO: 25631 - DNA, 471 bp, Homo sapiens
tggtgtcttttattaagaatttactccccccatttctcacagaagaaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgtta

SEQ ID NO: 25632 - DNA, 469 bp, Homo sapiens
aggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtagggagagaagtggggtttataaatgttttctctaagatatctttgctgctttccagactttgaaactattaagcttcttaactgcctcttaccggaaatact

SEQ ID NO: 25633 - DNA, 473 bp, Homo sapiens
gggaagctctgtttggtgctttggatccatttccatcggtccttacagccgctcgtcagaactccagcagccaagatggtgaagcagatcgagagcaagactgcttttcaggaagccttggacgctgcaaggtgataaacttgtagtagttgacttctcagccacgtggtgtgggccttgaaaaatgatcaagcctttctttcattccctctctgaaaagtattccaacgtgatattccttgaagtagatgtggatgactgtcagatgagaaaactgaaacacagaggttgttcatgaagtttcagatgttgcttcagagtgtgaagtcaaatgcatgccaacattccagttttttaagaagggacaaaaggtgggtgaattttctggagccaataaggaaaagcttgaagccaccattaatggaattagtctaatcatgttttctgaaaacataaccagccattggctattt

SEQ ID NO: 25634 - DNA, 345 bp, Homo sapiens
gagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatggaagtagatgctgatggtaatggcacaattgacttccctgaatttctgacaatgatggcaagaaaaatgaaagacacagacagtggaagaagaaattagagaagcattccgtg

SEQ ID NO: 25635 - DNA, 298 bp, Homo sapiens
aaggtagactttgctttgaagtgaagtgagataccttctaaagcaaaagtctgtttaatattttccaccattagaaaaaatgcgtgcttaggccaaagtgcaagaagaggaattccatgtggaaaactgcaggtgtgtctagttaggccaagaggtataaaaggctgagcagttgtctggcacacctggtatttgcaccatcagcatcttgcacttagtggatgctaagcaaatatttgtgatttttttcaatagcagggatgtttgtctgaatatttaaatattcaccttagtttga

SEQ ID NO: 25636 - DNA, 340 bp, Homo sapiens
ataacagctttatttataatagccaagagtggaaacaacccaaatgtccatcaacagggaatggataaacaaatagtgggatatccattacaatggaatacgcctcagcaataaaaatgagtatactattggtacgcacaacaaaatggatgaatctcaaaatagttatgctgagtgaaagaagccaggcaaagaagagtacatgctgcatgatgtactatttatataatttataagtatacatttatattaaaattcctagtgaatgcaaattataatgacagcagaacagtggttgcctggggacaggagcagtgtagttgtggaagggagagattac

SEQ ID NO: 25637 - DNA, 473 bp, Homo sapiens
  misc_feature 15: n = A,T,C or G
agttcagggactagnacttcagccctgggaaggaagctgccaaaaagaagcagtgtccttgtcttagatatgcaaggccctaagctctaaacaaaagacagacgtaggcattgctgtcagacctgcgtcatcagatttcagccagaatcacatcaggagtaaatatgccagattccacttgaaatgatgattagccttgggtaagaaccagaggagcttagctgtgaggagggagactgcttagcatggctagccaggatgggcccagcactaaaagcacaaagttgtagactttaacgtcaaagggccaattaaagtgaaacgaatgaggcctgttctcatatcagcactgaaaacgtgctgctggtctgttacctgaacaaatatcttctctgatccatattggaaaaaagtaagaaggcaatatacatttctctctgtctctgcaataactaaaaactcctgcctttgat

SEQ ID NO: 25638 - DNA, 471 bp, Homo sapiens
ctgaagaaactgcaaagtgcaattccaaaagccaaggtgagaaagaaatgtatacgctgggaatcactaattttcccattcctggagagcctggttttccacttaacgcaatttatgccaaacctgcaaacaaacaggaagatgaagtgatgagagcctatttacaacagctaaggcaagagactggactgagactttgtgagaaagttttcgaccctcagaatgataaacccagcaagtggtggacttgctttgtgaagagacagttcatgaacaagagtctttcaggacctggacagtgaagggagcccgggcagccaccgtctccagagccctgggcagcattttccagcaagatgtacacaatcttttgcctttatttcgtaaagttttatacagaagagagaagagcatgtctttacttgaaaaactcttgatcaagaatttgggtgggagaaaagaaagtgggtt

SEQ ID NO: 25639 - DNA, 468 bp, Homo sapiens
  misc_feature 462, 464: n = A,T,C or G
catagaaaattattgtaaaagatcatttcttcacaaattccttcaccaatggaaacctttaatatcttgaagatgaatatccatgtctgtaaatgttaagccactttaataaatcattcaatcaaatttacttcatattaatcagatgaaatcagttccttttcaaaatttggagatttggaaaccttaaaatttttatatttggctggtcttcaaataataaaataaaataaggaataaaaacagccgacccaatttaaaatttaaaaaaaaatgtcttaagtcatatctgggtttcctaacatgtatgccaaggctcagctatttatcaatgttatatagctgactgaagatttaagtctcccaaaagcaaaacttaaattggaaacttagagaaaatttcaactattgttacccgcatgtttgggtgttagccgtgaacctaaagacaaaaggtgttgngntttg

SEQ ID NO: 25640 - DNA, 367 bp, Homo sapiens
  misc_feature 6: n = A,T,C or G
aataanaagggaatttgggtaaagaaaggaatacttttgttagaatgagaattaaagagaaaacaaaagaatcttggcaaaattttccctctgaaattacaaactttaggaacttttccagatgtatcgaatttaatttgacattgatgtcactcttcataccaagtgaatctattctcatgaactttgaacccatgttaattttggaccctataactaatttcctttctgtatcccatggtggtcaaagcagtaaaggagtttagagatacttagcaaatgccattcatatagtattgttagccaaactattattccttccttagaagttgatgtatcaagaaaatttataagttatttgtattta

SEQ ID NO: 25641 - DNA, 324 bp, Homo sapiens
  misc_feature 23: n = A,T,C or G
gaagacatttttaccaacatagnaggcagatctcagagcagatccctcttggttaatgcaagaccaaatttccttgcagctgaacagaactgccaccacattcagtacattacaaatccagtactccagtgatgctcaaatcactttaccaagagcagagatgaggccagtgaaacacaaatggactatgatttcaagggataacaatactaagctggaacatactgtcttggtaaggtggaacccgttggcctgaactgcccaggccaaggagaccccaccccacacgtggattggcttctagctgatggaagtaaagtgaga

SEQ ID NO: 25642 - DNA, 134 bp, Homo sapiens
tggcgcatgcctgtaatcccagttacttgggagctgaggcagggggattgcttgaactcgggaggcggaggttgcagtgagctgagatcatgccactgcactccagtctggcaacagagcaagactcttgtctc

SEQ ID NO: 25643 - DNA, 406 bp, Homo sapiens
atttgattaaaaaatgcttatttttgaatttttgttttgccttttgctctgcatcatttcattcttaccctatacaaatctgatcattccttcccttgaggagggaaagaggcttcttgcttataaggagttttcagaactggtacgtggtaagagaaagcatcccctgcaggtgatatctcaatcaaaggaggatcgactgcagagctaagttgagtgaggagctaaggttagttaggcaactgagcaagtcattagacgaaagcaagtttaagatccagattaagagtccaaggaattggagagacagaaagatgagagctgggcattgaaagtctctctagagaggaatcaagaggatgggcttgcacaggcctttgggatagtgttgctgggaaagaagggt

SEQ ID NO: 25644 - DNA, 184 bp, Homo sapiens
gagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaat

SEQ ID NO: 25645 - DNA, 262 bp, Homo sapiens
  misc_feature 1, 23: n = A,T,C or G
natataaggaatcccattaaagnaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattattttttgtttcctgacttt

SEQ ID NO: 25646 - DNA, 104 bp, Homo sapiens
  misc_feature 4, 95, 99: n = A,T,C or G
attncttccccctttcctctcttcgtgttttaaggaagaaactataaattttttttaccccatgaatttttaaagaactattctaaacattggtngaangaaac

SEQ ID NO: 25647 - DNA, 431 bp, Homo sapiens
  misc_feature 12: n = A,T,C or G
atagtcttccgnacctaaaatgctcaccgttcactctctgctagtccagttcttttaatgcttgccttaaccttccctgaggttttctaatttccctagccagaaacaatcttttgaactcttgtggaatttttaaaactactttttttaccattttaaataagtggcacacatgttattaattagatatgcccagtatgtaactacttgtgttcagatgtaaggaccctaatttaatgtaagctttttgagggcagggattgcctcatatatcttactgtctgtttggtttctaacttagtgccttaagagcttgttaatgtgtctttccacgactagactgtgaactttttgggagcagggaccacagtttaatggcatttgtgatggcagtgtcaggcatctagaaggtactcagtaaatgtttattg

SEQ ID NO: 25648 - DNA, 450 bp, Homo sapiens
  misc_feature 21, 436: n = A,T,C or G
accggccgggaccctaagagntgaataaaagctattaaagaataagtttacttaactattccagttaccatgaaccgtattgaagtgttactcatttattgtaatcagaattatcactatttttacctgttatctttccctggatacatctgagtatattcaactctgtattttttggcaaaaagcatgaaggcattcattggtcttttgcacttattagggagaagtggcactcacagtccctgagctgtggtttttgacagctttagcatacaaagaattggaaaagagctgtgatgatccaggtgagccacagtttttactgaatccagatcttgcaaagtcttgaccaccaggtcctccacaagacaaagatgcacgacgctggcgaaccatactacttaacacataaactgcagaagaatccataggtggngaagtcatagctat

SEQ ID NO: 25649 - DNA, 452 bp, Homo sapiens
  misc_feature 22: n = A,T,C or G
gacacatgtgacaaaaacaagncaatggggaaaggattccctatttaataaatggtgctgggaaaactggctagccttatgtagaaagctgaaactggatcccttccttacaccttatacaaaaattaattcaagatggattaaagactgaaacgttagacctaaaacgatgaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaaccttacaaaatgggagaaaattttcgcagcctactcatctgacaaagggctaatatccagaatctacaatgaactcaaacaaatttacaagaaaaaaacaaaccac

SEQ ID NO: 25650 - DNA, 374 bp, Homo sapiens
ataatgaattaactagaaataactttgcaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccta

SEQ ID NO: 25651 - DNA, 405 bp, Homo sapiens
  misc_feature 14, 24, 30: n = A,T,C or G
ccccgaaggggggncggcccggcnccctcnggccggggtttgagcccaggggttcaaggtttgtgtgagccatgattgagtcaccacactgcagcctgggtgacaaagcaagatcctttctctaaaaaaagaagaggcgaattttggatgatcttgcctgcgtctgagtactgactcctccactcactgaaagtcactttggccaagtgacttcgtgtttttgtgtctctgcccccacaccagtaaaatgggaataataataagatatctttgatggactgttgtgataaatgagaaaatcagtgtaaagtgcttggagatgtgcctagtgcagagtgggcacttgctgaatgttaattatttgtataacttgctggtgtgggaagcctgactcttctccggctg

SEQ ID NO: 25652 - DNA, 209 bp, Homo sapiens
  misc_feature 36: n = A,T,C or G
attctcagccttttgggcatatgtatctttataatnagactggaaacgggactttctattaatatcattttcagaataaaaaataggataatttaacctaccagcccttctcccccaataactgtggtctatacagagtcaatatattttttcagagaaagttattcgctcgattttttctgaatcataattaaactttatgataaaat

SEQ ID NO: 25653 - DNA, 294 bp, Homo sapiens
atccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagggaagaccagtgccaaccctgagactctgctgggggagatggaggcgaagacaagagagctcattgctagaagaaccacacctcttttggaatatatt

SEQ ID NO: 25654 - DNA, 272 bp, Homo sapiens
  misc_feature 2, 5: n = A,T,C or G
anaanaaggccgggtgcccaattgagtgcttcatgcctttagaatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcat

SEQ ID NO: 25655 - DNA, 379 bp, Homo sapiens
  misc_feature 4, 5: n = A,T,C or G
cccnntggcccggggagtggatgctaggcctgagaggggtgagaaaaagctgaggaggagctgtgtgtctaggaaaggcaggagacaccaatgcactatctttctagattctcctgctgccatgctttctagaattattttaaatatttcagctcagttattctttcctgtaactttagaagaaatcattctgtgaatttttcttggggtgggggaaggaggtaaattagcatctttcaaatatttactcatggaagatatggctctatattaattcaagccttctttattataagtttcattattttttatgtataaagtcacacacttttctcattaaggttttttcagatacttggtatgaatcgtatttctttta

SEQ ID NO: 25656 - DNA, 360 bp, Homo sapiens
  misc_feature 2, 4: n = A,T,C or G
cncnggccggggataatgaaaggtatcagttgtgttgagtggagggagtttaagagaaaggacccttcccaaccagcagccagtagaaaatacaacctactcacctttttcccttctaagttctgctaaatcacatctgcctcatagagaaaggaatgttgcctttgagaactgtcttggagaacagataagcttgaaatgttctctctagagaggacatagggtttgggatcctctgaaaaggcccagaaaaatagctcagttcaaatacaatgttctaggacaattggaatataaatattgtccaaaaatataattaaaagaaaaaagtttagcactgtgtaaagtaagtgttaactg

SEQ ID NO: 25657 - DNA, 432 bp, Homo sapiens
gtcatcaacacatggaacattctccggatagaccatatgttaagacacagaacaaggctcaataaaattttaaaaattaaaatcatatcaagtatcttctcagaccacaatggaataaaacttgaaatcaataagaagaagaaatttgcaaactgtacaaatacatggacattaaacatgctattgaataatcattgggtcaatgaagaaattaagatggacatcaaaaattttttttaaacagaaaatggaaacacatcatgcaaaacctatgggatacagcaaaagcagtactaggagggaaagtttatagcaataaatgcctacaccaaaaaagtagaaagattttaaataaacaacctaatgatgcacctcaaggaattcaaaaagcaagaacaaatcaaacacacaattagtagaaagaaaaaatat

SEQ ID NO: 25658 - DNA, 397 bp, Homo sapiens
  misc_feature 2, 32, 266, 279: n = A,T,C or G
tncgggcgcggggaaaaatcacctggcaaccntgggtctcgcttatgaagttacaaaatcttcagcttcagcccaggcaaccgctaagcctctgaagaactccctttggctacttttgaaaatcaagatgagatactattagatatatatccatacatttttattgtcagaataaaattaggaacagtaaaatccaaagaactatgtaaacaaaaaagcttttgttttgcttacaaagtatatttatgggattattctgctgaagnattcagtttaagnagttttccttgggagaactaagtaagaaacacaatgccaacagctggccagtaattaagtggttgtgcactttcatgtcattaatcaatttctcaatagttcttaaaattagtggaga

SEQ ID NO: 25659 - DNA, 252 bp, Homo sapiens
  misc_feature 6, 91, 94, 97, 112, 166, 199, 207, 209: n = A,T,C or G
cagccnagcgcggggcttctgctgagggggcaggcggagcttgaggaaaccgcagataagtttttttctctttgaaagatagagattaatncanctncttaaaaaatatagncaataggctactaagatattgcttagcgttaagtttttaacgtaattttaatancttaagattttaagagaaaatatgaagacttanaagagtancntgaggaaggaaaagataaaaggtttctaaaacatgacggaggt

SEQ ID NO: 25660 - DNA, 405 bp, Homo sapiens
  misc_feature 14: n = A,T,C or G
aacatacacaaatnaataaatgtaatccatcacataaacagaaccaatgacagaaaccacatgattatctcaacagatgcagaaaaggccttcggcaaaattcaacagctttcttgctaaaaacacgcaataaactaggtattgatggaacgtatctcaaaataataagaactatttatgacaaacccatcgcaaggaagctaaaaaccctgaaaaaagattagatgaatggctaactagaataaacagtaaagagaagaccttagatgacctgatggagctgaaaaccatggcatgagaacttcgtgaagcatgcacaagcttcaatagctgaatcaatcaagtggaagaaagggtatcaggtaactgaagatcaaattaatgaaataaagcaagaagacaagg

SEQ ID NO: 25661 - DNA, 366 bp, Homo sapiens
gattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggaacaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaaga

SEQ ID NO: 25662 - DNA, 399 bp, Homo sapiens
  misc_feature 9, 18: n = A,T,C or G
gaccggggnattgacagnaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagaaaattaatgcaaaacttcatgatggagtatgtcagcgctgtaaagaagttcttgagtggcgtgtaaaatacagcaaatacaaaccattatcaaaacctaaaaagtggttgaataaagaaacagaaaaaatagaacatactgaaaataatctaagttccaaccatagaagaagctgcagaagaaatgaaga

SEQ ID NO: 25663 - DNA, 376 bp, Homo sapiens
  misc_feature 16: n = A,T,C or G
tagatatagtaccgcnagggaaagatgaaaaattataaccaagcataatatagcaaggactaacccctataccttctgctaatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtaggagagag

SEQ ID NO: 25664 - DNA, 267 bp, Homo sapiens
  misc_feature 8, 16, 24, 29, 30, 265, 266: n = A,T,C or G
ggaagggncttagttnaaaaaacnaagannaaactgctctcactttaaatttgtggtgtctgtgagatgtgcacctaagtcagatgctctttgccatgcagtaaaagacaaccctatgtgaatttagaaaggggagcccccctttctaatgctacattcaaagtagcattcttagcacaatttagacagtgccttctctggagaggtaaatgaagaaatcacaaactagaaaaaaagaaacaatatctacagaacaaacacagcnna

SEQ ID NO: 25665 - DNA, 316 bp, Homo sapiens
  misc_feature 2, 11: n = A,T,C or G
cnggccggggnaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaagataaaaggtttctaaaacatgacggaggttgagatgaagcttcttcatggagtaaaaaatgtatttaaaaga

SEQ ID NO: 25666 - DNA, 489 bp, Homo sapiens
  misc_feature 2, 430: n = A,T,C or G
cncactctggccgggattagagaaaagcaaatcaaaaccacagtgagataccatctcacaccaactataatggctattgttaaaaagtcaaaaaataatagatgctggcaagggttgtagagaaaaaggaatgcttatacactgttggtgggagtgtaaattaattccacattgtggaaaacagtgtggcaattcctcaaagacctaaagacagaaatagcatttgacccagcaatcccattactgggtatatacctaaaggaatagaaattgttctgttataaagacacacatgcatatgtttttgagtttttaaaattgtttgatagttgaagcaaaaattatgacaagatctgtttctgaatgtatagtgaggaattttgaagacaattaggaggaagaaaggattaaacataattggaggtaaggnttctacatttcactcaaagtgataaaacattgataccagtagattatgatgttacttat

SEQ ID NO: 25667 - DNA, 367 bp, Homo sapiens
  misc_feature 353: n = A,T,C or G
ctggccgggggctatgtagatgattaaggatatgtgaagttcataatttagtaacttcctaatttaataagctcaaagtctaattatttagcaacttccactatgtccttgtatgtggaatttgagaaaatacggaaatacttagtcttggcttttagaaataatcacagaaaaacaacatggagtagttatttataaaataagatttaatttcaaatggaataatctagctatgtttacatttctcaagaaaaatagaattgttcccttagaagttttaaaagcaggcactatctgtcaaagttttaccatggctgaaatttttaacattgaatttagtactttaaattggngaaactatgggagg

SEQ ID NO: 25668 - DNA, 188 bp, Homo sapiens
  misc_feature 4, 16, 41, 188: n = A,T,C or G
cagnaggaacgattgnagccattgtcacaggaaccaatgcnggaggctttataaaaacacatttttggtcgggcgcggtggctcacgcctgtaatcccagcactttggcaggccgaggggggtggatcacaaggtcacggagaccgagaccatcctggctaacatggtgaaaccccgtctctactaan

SEQ ID NO: 25669 - DNA, 240 bp, Homo sapiens
  misc_feature 3, 4: n = A,T,C or G
cannctggccggggacaacccttagccaaaccatttacccaaataaagtataggcgatagaaattgaaacccggcgcaatagatatagtaccgcaggggaaagatgaaaaattataaccaagcataatatagcaaggactaacccctataccttctgcataatgaattaactagaaataactttgcaaggagagccaaagctaagacccccgaaaccagacgagctacctaagaacagct

SEQ ID NO: 25670 - DNA, 394 bp, Homo sapiens
  misc_feature 7, 11, 25, 35, 189: n = A,T,C or G
aaaatgnggcngggggaggcgaagnaacgcaaagntgagaacatggacgttaatatcgccccactccgcgcctgggacgatttcttcccgggttccgatcgctttgcccggccggacttcagggacatttccaaatggaacaaccgcgtagtgagcaaccctgctctattaccagaccaactacctggnggtggctgccatgatgatttccattgtggggtttctgagtcccttcaacacgatcctgggaggaatcgtggtggtgctggtgttcacaagggtttgtgtgggcagcccacaataaagacgtccttcgccggatgaagaagcgctaccccacgacgttcgttatggtggtcattgttggcgagctatttccttatctccatgtttg

SEQ ID NO: 25671 - DNA, 307 bp, Homo sapiens
  misc_feature 106, 150, 219, 274: n = A,T,C or G
gaggcattgaggcagccagcgcaggggcttctgctgagggggcaggcggagcttgaggaaaccgcagataagtttttttctctttgaaagatagagattaatacanctacttaaaaaatatagtcaataggttactaagatattgcttancgttaagtttttaacgtaattttaatagcttaagattttaagagaaaatatgaagacttagaagagtancatgaggaaggaaaagataaaaggtttctaaaacatgacggaggttgagatgaancttcttcatggagtaaaaaatgtatttaaaaga

SEQ ID NO: 25672 - DNA, 429 bp, Homo sapiens
  misc_feature 170, 194, 327, 330: n = A,T,C or G
gggttcgatagggagaatcaggacactgtgcacatgcctaaggtttcaccttcaagaagtagtattagagactacacactgttgggggaaaaggacttcactgaagtagcccatccaatgcggtaaacaagtaaacaagtatatagtgcaacaacaagaagtccttgggngggggattaatcagtattcaaagngtctaaaatatagtatctaaaatgtctggttttcaacagaaatttaagagacatcaaagcagatcatagaaattgtctttcaggggacctggatgtgagacttaccagaaaaagacagcaaagtagctatttnttnttttgttcaaagaactaaaggaaactatgctgaaaaaattaaaggcatcatgaaaatgtcttaccaataggtaataccaataaaaagatataagttatg

SEQ ID NO: 25673 - DNA, 320 bp, Homo sapiens
  misc_feature 10, 11, 123, 126, 144, 239, 294, 318: n = A,T,C or G
tccggccccnnctggccggggaggcattgaggcagccagcgcaggggcttctgctgagggggcaggcggagcttgaggaaaccgcagataagtttttttctctttgaaagatagagattaatncanctacttaaaaaatatagncaataggttactaagatattgcttagcgttaagtttttaacgtaattttaatagcttaagattttaagagaaaatatgaagacttagaagagtancatgaggaaggaaaagataaaaggtttctaaaacatgacggaggttgagatgaancttcttcatggagtaaaaaatgtntt

SEQ ID NO: 25674 - DNA, 267 bp, Homo sapiens
gaccgggaatcctaacaagtaaaaagctggaaaaatggaaaaatgaacaattcttagatttgtaagagaagtgaggtcacagggcaaaccactggccccaaaatcagcgagagagacacgtatagagaatcataacttaccagagcagaaacccatgagcagaaacctccaagggaaccagtgccaaactggaaaaacctgaactgtaattaacaaattgctggaagctcaatgtggacaagtcagagagtttgaaacttcagaggg

SEQ ID NO: 25675 - DNA, 372 bp, Homo sapiens
  misc_feature 7, 19, 27, 63, 134, 287: n = A,T,C or G
gcggggnagaagccacagnatattggntttggtaatcgatgtggaaaacccaaaggaccaagnagatccaccttcagaatggacatgattcagggagctagaagacactttaagttatactggaaaattcaggngccactgaaagccagatttatagtattccatctttaatatgtgggactaacagcagcgtaggattgttaccttaatattttttgctgggaccatctacctgccttatactacacttaggaaaaagaattacatatggtttattttgaaacttnaagtattattgccttaatgtctcttaaccctgttacacgctgcttgtagacatgttaatatagtaatacctttatgatatattga

SEQ ID NO: 25676 - DNA, 305 bp, Homo sapiens
  misc_feature 76, 215, 259, 294: n = A,T,C or G
atttgaaaactttgattctggaacctttaaaactaatctcagtaaaaatttttggtgcccatgcagctgtagttgntcactgctttcctggatggatgggactcttatgtcataacttctgttactcctttggcccatagctaaggtcatccttccccacagaggtggctttgggattggatgatacagcttttgcttctgtgtagtatacctgnacatacttgtttcaggcagcctttctttaatgttttcagttggnttgtattctgtagctcagtagctgctaataaagtnaaagatcctga

SEQ ID NO: 25677 - DNA, 491 bp, Homo sapiens
  misc_feature 2, 20: n = A,T,C or G
tngaccgggattccaaaagnaactgaaatgaagtctttttagactcagtaggagccttatattcttgaagtcaatactgtaacctcatttctaaggtatacagggttgattctttttctcttaaatcatatgtaacttgcagaagattcagagtcctcagacctctagttcttggaattcctgtaggtttacggtgtatgtgattgtcaagaattaatgacaaaaatgtgtcactgcctacagttctgtgaacactcagaatgtattaatgagctgtttttccatagttttactttagcttaccttgaatactccctgtataatcctctaaaaaggtagcatcggcaagaaagatgaatccgttggaaatacagctgagccatacttcacggaatagaacaagtgtgttctgtgctggagctcaagacctgtggaaagggactgcccaccacacctggcctgaagacttgtaaatgctgccaaattcaaga

SEQ ID NO: 25678 - DNA, 371 bp, Homo sapiens
  misc_feature 9, 27, 30, 34, 57: n = A,T,C or G
gacccgggnggtccgcccaaatccggnagnaagnatgatggaaatcatgacccgagnaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttat

SEQ ID NO: 25679 - DNA, 184 bp, Homo sapiens
  misc_feature 128, 161, 175, 178: n = A,T,C or G
gaaaggcacaggtttggaaaagacctgggaaaaccttaagtttacattttccaggctgatcattggcacaaagacaataccaattcaagacaaaaaacaataaataggaaataaacaaccaaaacccngcaaaccctgaggaaagaggagaatctgatttnccggagtaaccctnttnttagat

SEQ ID NO: 25680 - DNA, 267 bp, Homo sapiens
  misc_feature 265, 267: n = A,T,C or G
atagccgggggttccacaaaaccacttttttttaccccaagtattaaactttaaagtacgatgatgaattttccaaccgatttcagggtccaaagaaaatagagctaagatactgatgacagtgtgagtgatagcatggtaatgaaggacagtgaggctactgcttataaatcattttctttcttttcttccccaaagtcagaattgctcaaagaaaattatttattgttatagataaaacttgagtgataaaaagctatacccnan

SEQ ID NO: 25681 - DNA, 448 bp, Homo sapiens
aactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaaatttttcccagtatttttatacggaaaaaattgtatttgaaaacacttagtatgcagttgataaga

SEQ ID NO: 25682 - DNA, 400 bp, Homo sapiens
attgcatacatggatcaggccagtggaaatgtaaagaaggccctgaagctgatggggtcaaatgaaggtgaattcaaggctgaaggaaatagcaaattcacctacacagttctggaggatggttgcaccgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttg

SEQ ID NO: 25683 - DNA, 441 bp, Homo sapiens
aacataaaagcctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaattttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgg

SEQ ID NO: 25684 - DNA, 309 bp, Homo sapiens
  misc_feature 24: n = A,T,C or G
agaagtggaaaactggaagacagnaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtttagaagatagaaaaatataaagct

SEQ ID NO: 25685 - DNA, 376 bp, Homo sapiens
  misc_feature 4: n = A,T,C or G
tatngcccgggatatttaatcctttcaaaataagataaaaacattttatatgctaacagaatatatttgttacaagttaaagtccagaagtatacacaagattgattactcctattattttttttaaatcacagaaaaatattgatttcattgtctccaaagtgataaaatcatgtattactcatttttgcacttaaaatttttcttatttattccaaggtggtttgaaggtccaagtatgaaaataaattagggggattaatgtataacagttataaagtatcatgttgtattaaagagcttacttagattgatgtttttaaaatgtatcctgatgaatgtctcaagaatgcatctgtcaagttttttagactga

SEQ ID NO: 25686 - DNA, 391 bp, Homo sapiens
atatttgaaaaagtggatttcttgagtctgttgtagtttagtacttacagcagtgcctaaaacagcaactaatatgaactgcctgagtcctacaacataaatgcataaagcttttttatgtaaaagccacaggaggggttcaaaattgaacttttccaaagtttatttctcttgcgttagatgaaaaactatttaaaaggactgaaaaccctgagctttttgctcgtcttggtagcagatatctgtaaaaacctacccagaattgtgattttacttcattgttcttgcatccttgaggctacagtataaatcatctccaaacttgactactattgggaagatgtgtataaaagcatcgctttgggaaattttttaaaaaatatgcaaaaat

SEQ ID NO: 25687 - DNA, 260 bp, Homo sapiens
cttctctcaagaaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaagggagaagagatcattttttaaga

SEQ ID NO: 25688 - DNA, 412 bp, Homo sapiens
  misc_feature 410: n = A,T,C or G
gatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatggtttgntg

SEQ ID NO: 25689 - DNA, 394 bp, Homo sapiens
gtcgaaggaggagcaaggggcttcttggtctatagactattgctaatgtgtctctggacataaatcttctttggttttcattatctattctggagaaagcaatggtgactctgagtaagtggggcagcaattcaggtctttaccacaccacatgcagcatttgtacaggagtagctttggcctcccagaccttagtgacctgggcaggccacccatctctgccttttcttggagtgatttttacaggcacagagtaaactcctgccctcaaatacctactgccatttgcttcctgatgcttaacattccacatttatagaaaaggcctcaaatataaggaccacaataataacacgtgatttaaattcacatagagatgtattggctcctattg

SEQ ID NO: 25690 - DNA, 484 bp, Homo sapiens
  misc_feature 34, 72: n = A,T,C or G
cctcccaaagtgctgggattacaggcatgagccnccgtgcctggcctggagttttgtaaatttgcttaagcntgcccttgatgaagcaacaaaaattattagtttactaaatctcaacctgtggacatatgtctttttcaatattttatgacaaaatgggaagtatacataaaacactgctgcaaaccaaaatacagtggtcatcccaagaaaatcttctgagattgttttaagatgcaagctgaactacctactttttgaaagaatgatggacacagaaattaaggtcattcagactggggtgttgagcagacattttctctcaaatgaacaaaatgaggctaccatttcaaggaacacaaccgacagtacttattgtcaaccatattcaagagaaaaattacaattttgagaaagctgtgtcgactatgaacttgacagctacttaaaaacttttatgatgaaattgctgatgacattgatg

SEQ ID NO: 25691 - DNA, 108 bp, Homo sapiens
  misc_feature 11: n = A,T,C or G
gcggggggcangccttgaggcagccagcgcaggggcttctgctgagggggcaggcggagcttgaggaaaccgcagaataagtttttttctctttgaaagatagagatt

SEQ ID NO: 25692 - DNA, 491 bp, Homo sapiens
  misc_feature 2: n = A,T,C or G
anctccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacccaccttccagccttttaggagttgctaaaattttaacagttatttcctgctttttatcacagttgatttctgaagactacattgccaagcagaatgatgaaatgactttttcgttgtcaggcaattttgggttaagtcaaatcttaatgccctcttcgctatcagatgttgcctgtgtttccataaagcaaaatgctgattttggtaaaaaacatgactgcttctagagctgggaggatctgcagactttcacggattcatggaacaagaaaagaagcataggtcttt

SEQ ID NO: 25693 - DNA, 256 bp, Homo sapiens
accggggagttgtggagtggccgtagacgagttaagtcctggtctgcgtggaggtcgacgactccgtcgcagactacggacctgtctgggtctcagccgccaaagaccccgtccggtaggaagtactagccggacatcatgagtggctgtcgggtattcatcgggagactaaatccagcggccagggagaaggacgtggaaagattcttcaagggatatggacggataagagatattgatctgaaaagaggctttg

SEQ ID NO: 25694 - DNA, 321 bp, Homo sapiens
acccattacaagtttaatacattttgagctttcctaattttttaccttgaagcatattgcatattctgggatgagtgtatgccccaaaaatatttttattggtattattaaagatttgaaggaggaaatattctctttcctatgataatctgaacaaaaaaccttctattcaaaataaatcttgcatagactatttttaattattatcttgaggacaaagaaagattttcccacatagtcctgtgtgtgtatgcgtatgtgtatgtgtgtgtgtacatatgtgtaccatgtgtgcatgtgtgtgttttgatagttatatta

SEQ ID NO: 25695 - DNA, 109 bp, Homo sapiens
  misc_feature 25, 60, 96: n = A,T,C or G
gccgcacctatggcgggggataccnaaagctagctttcttatgttttcctttaaattttnagatttaccttcattctgttttcactgatgtctttngcaagcctttgat

SEQ ID NO: 25696 - DNA, 175 bp, Homo sapiens
  misc_feature 8: n = A,T,C or G
caaaagcnagtggactgtcttttggattcaaagtgggcaaaggccaagaaaaggagaggaagctttatttacaaccagggagtctgtggttgactactgcaacaggcttttaaagaagcagttttttcaccgagccctaaaagtaatgaaaatgaaatatgataaagacataagg

SEQ ID NO: 25697 - DNA, 126 bp, Homo sapiens
ccttattggcccggggtacaaacttagtaagaaaattggaagatagaaacaagatagaaaatgaaaatattgtcaagagtttcagatagaaaatgaaaaacaagctaagacaagtattggagaagt

SEQ ID NO: 25698 - DNA, 377 bp, Homo sapiens
  misc_feature 2, 16, 28: n = A,T,C or G
tntggcggggataggnaatcgtgtttgnagggagatttctgatgccctctgtgggtgtgtgtaagttaaagtggccacatttaagaaggccaagctttgtagtggttgcacaagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttggggttttgcttctgtctgtctgtttattggaaacttgtacttcaagtagggggaatcctaatttaatacctccttagctaagttttattattcaggcaataaacatgttttcatg

SEQ ID NO: 25699 - DNA, 362 bp, Homo sapiens
tggcccgggatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgactttttaataataaaaagaaaagtgaagagt

SEQ ID NO: 25700 - DNA, 478 bp, Homo sapiens
gcggggattataaagattgaaaaggcaagtgtgaagtactcagcccatagtgagcaaccagtatatgttaactatacgataagtatttctttactcaccaaattttgaaataaaccattacctgaggtggttggtaatggtgaaattataatggaagagagctgggcacagtggctcatgcctgtaatcccagcactttgggaggccaagccaggtagattgttttagcccaggagttcaagaccagctggggcaacatggtgaaacagcatatctacaaaaaatacaaaaattagccaggcatggtgagatgtgcccatagtctcaactaatagggaggctgaggtgggaagatctcttgaacccgggaggttgaggctgctgtgagccgtgatcgcaccactatactccagcctgggcatcagagtgagactctgtctcaggaaaaaacaaacaaacaaacaaataaaacaattat

SEQ ID NO: 25701 - DNA, 485 bp, Homo sapiens
  misc_feature 453: n = A,T,C or G
agaactccaaatgcacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaagtgctctcatagttctatcctctaattccattaaatccatactaggagcgtcagtgaggggttttcatagctcttggaaatacttttggtctctgaactgtaattagcaagaagtaaaaacagaaacgtcaaacgtcaaatgtttgcttttgttaccttggaggactaaatggnaagatgtctttagtatactttggatggttctt

SEQ ID NO: 25702 - DNA, 380 bp, Homo sapiens
aggaaggaagttgagagaacggagcggacgccatggcgaccagcatcgagcagatttttaggtctttcgtggtcagtaaattccgggaaattcaacaggagccttccagtggaaggaatgaaggccagctgaacggtgaaacaaatacacccattgaaggaaaccaggcgggtgatgcagctgcctctgccaggagtctaccaaatgaagaaatagtgcagaagataggaggaagtacttttctggggtcttagatacagaactacgatataagccagacttgaaagagggctccagaaaaagtagatgcgtatctgtacaaacagatcctactgatgaaattcccactaaaaagtcaaagaagcataaaaagcgcaaga

SEQ ID NO: 25703 - DNA, 145 bp, Homo sapiens
atcaggcctcaggaaaatgatggaatatgctggatgtgatgaccaccaagccatatgctgctgcgtattgaatcagaattccaacagccttttttatctgccattgttttacatagtctggagagagttacagatattatttagg

SEQ ID NO: 25704 - DNA, 319 bp, Homo sapiens
aatagccgggatcgattctttggcaatggattcagcaaatggtggctttgtagaatgatcagttaactgcagggatcagtcgtcagacggagctaaaaagtcccatgctcggggagcctcaccggagttccaggaaaatgttaagaagaagaataacaacttaagcttctacacgtcctaaccctgcaccaaatgctttaggtacggtgttattcatttaaatcccagaacatgcaacagcaggtttcatcagatatattttatccagggggtatataaggctcagagaataaaaaggatatccaaggtcaccaggttg

SEQ ID NO: 25705 - DNA, 177 bp, Homo sapiens
gtgaaacccagtctctactaaaaatacacaaattagctgagtgtggtggcgcatgcctgtaatcccagctactcggaaggctgaggcacaacaatcgcttgaacccaggaggcggagattgcagtgagccgagattgtgccattgcactccagcctggtgacaaagggagactccat

SEQ ID NO: 25706 - DNA, 229 bp, Homo sapiens
  misc_feature 1: n = A,T,C or G
nggcccggggaagactggaaaaagaaatgttggagcagacattacagaaggtcattgagttggaaaatcggctgaaatcttttgagaaaaggtcgagaaaattaaaagaagggaataaaaaattaatgaaagaaaatgattttctgaaatccctcttaaaacagcaacaagaagatacagagaccagagaaaaagagctagaacagataataaaggggagtaaagatgc

SEQ ID NO: 25707 - DNA, 311 bp, Homo sapiens
  misc_feature 30, 205, 260, 283, 295, 310: n = A,T,C or G
ctccccacaaaaaaaacaacaaatcacagnataaggtctgtagtttcaaaacagactaagacagacctttcttagcaatgttatataataaatgaattctggctaagtaagttaattcatatttatactatattgtatttaatgtatttataagtactctttaaatacaattctttggaagataatgccttaaattaaggctgtncctctctctatttctggtaaaactagcactgtattgctggccagtggaggaggtntatattactataggagaaaggcnagagatcaggcnacccatgaggatatna

SEQ ID NO: 25708 - DNA, 303 bp, Homo sapiens
gaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtgggagtttgataatctgtatttggatatgaaatggaatcatccatccctgtactcatcctgaagacaaaccagcccc

SEQ ID NO: 25709 - DNA, 260 bp, Homo sapiens
  misc_feature 9, 11, 41, 166: n = A,T,C or G
attcaaagnanaagtgcaccattgttccccagctccagaanatagagacttgcctagggggagaagtatgctgtaagacagagttctaaatccctttctaaagcaactaacttcatttgctggggagaagttcaggcctaagagtattcaaaaacaggagggtgcnggtgagagacagttaggaggagattggtaggtgcagtggagataaataaactgtagaagggctagtttgctggagagaaccagggaaatgaaga

SEQ ID NO: 25710 - DNA, 352 bp, Homo sapiens
atattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagcgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaat

SEQ ID NO: 25711 - DNA, 351 bp, Homo sapiens
attatttctggatgctaagtccattcagtccaccatctccagctcgcagaaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaaga

SEQ ID NO: 25712 - DNA, 285 bp, Homo sapiens
  misc_feature 5, 6: n = A,T,C or G
atatnnggtcctagtgatgcttctggacgagccctcaaaacaaaaggttgttcattctttgaaggtgatttagcacctaattgtaattcagcagtacgtgaagattagagttgttctatctacagcagtacaacagtgctttttttaaaaataagaaataaattaactgaacaactgtgcttcgtaattcttggacttaggtaagtgacatataaccaaataagagttgtgtataaaaccaagatgatagcccatgaaaacccaaagggatcttttagggtgaga

SEQ ID NO: 25713 - DNA, 430 bp, Homo sapiens
accctcttctgccctcatttcatgtgacagccattgtgagactgatgcacaaactgtcacttggttaatttaagcacttctgttttcgtgaatttgcttgtttgtttcttcatgcctttacttactttgtcccatgctactgattggcacgtggcccccacaatggcacaataaagcccctttgtgaaactgttctttaaatgaaacacaagaaattggccactggtaaaactctgcagcttcaactgtacttcatttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatgggggg

SEQ ID NO: 25714 - DNA, 312 bp, Homo sapiens
agaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttga

SEQ ID NO: 25715 - DNA, 364 bp, Homo sapiens
atatttgaattagtaactgtatgaagtcataaataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttaggagaaatgatttccacctttatgttttaatatcctaggcatctgctgtaataatattttag

SEQ ID NO: 25716 - DNA, 298 bp, Homo sapiens
gcacacccgtctatgtagcaaaatagtgggaagatttataggtagaggcgacaaacctaccgagcctggtgatagctggttgtccaagatagagtcttagttcaactttaaatttgcccacagaaccctctaaatccccttgtaaatttaactgttagtccaaagaggaacagctctttggacactaggaaaaaaccttgtagagagagtaaaaaaatttaacacccatagtaggcctaaaagcagccaccaattaagaaagcgttcaagctcaacacccactacctaaaaaatccct

SEQ ID NO: 25717 - DNA, 380 bp, Homo sapiens
  misc_feature 20: n = A,T,C or G
atattagaaaaaccccaagnaggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtaaccataatgagcaaattgactaagagaagcaaaggtttcttggggttattaaccagtagtgtgg

SEQ ID NO: 25718 - DNA, 459 bp, Homo sapiens
tcaatagaccgggatgttaaaaacatatagcaaaaatctgaagaaaatgtgctaagctataaaagagataacttctggggaaggaagtagagtggaaggatgatgaacctagtggggacccagaggagacactgtatctctgtccaaagaaattgctatgattacacgtttgtcccctccaaaactcatgctgaaacttggtccccagtgtagcagtgttaggagatgggctgatgagaggtgattgaatcatggagctctcatgaatgttttattgtcattattgagggagtgggatgttgtaaagggagccaagcccattgtgctttccctctttagtactcactcccttgctcttctgcgatggaatgacacagcacaaaggtcctcaccatatgccaacccctcaaccttggatttcccagcatccagaaccatgaactattctttataaattac

SEQ ID NO: 25719 - DNA, 498 bp, Homo sapiens
aatagccgggtatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctc

SEQ ID NO: 25720 - DNA, 426 bp, Homo sapiens
  misc_feature 104, 107, 110, 151, 269, 275, 332, 369: n = A,T,C or G
gaggcattgaggcagcccagcgcaggggcttctgctgagggggcaggcggagcttgaggaaaccgcagataagtttttttctctttgaaagatagagattaatncanctncttaaaaaatatagtcaataggttactaagatattgcttancgttaagtttttaacgtaattttaatagcttaagattttaagagaaaatatgaagacttagaagagtaccatgaggaaggaaaagataaaaggtttctaaaacatgacggaggttganatgaancttcttcatggagtaaaaaatgtatttaaaagaaaattgagagaaaggactacaganccccgaattaataccaatagaagggcaatgcttttanattaaaatgaaggtgacttaaacagcttaaagtttagtttaaaagttgtaggtgatt

SEQ ID NO: 25721 - DNA, 366 bp, Homo sapiens
  misc_feature 6, 14: n = A,T,C or G
catagnacctcganagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggggatcagtattgtggaggactccttgacagaccttccggctcttttaaaacccccaactggccagaccgggattaccctgcaggagtcacttgtgtgtggcacattgtagccccaaagaatcagcttatagaattaaagtttgaga

SEQ ID NO: 25722 - DNA, 210 bp, Homo sapiens
  misc_feature 4, 25, 39, 43, 48: n = A,T,C or G
caanacgctgaaggctgatgcaccnacttgctgtcgtcngcancctgntgcctgtgtgcatcctatcatgacagattattgcttagtcatagcttgctttggctggaagtaagcgttactgtaccaccaatgttttgaggcagaggaggctcggaggtgatgctgaaccagaattacatgctcctgaaccgggtacctctttaacagtgt

SEQ ID NO: 25723 - DNA, 384 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgaga

SEQ ID NO: 25724 - DNA, 314 bp, Homo sapiens
agaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaagggttgtgattgctgtggggaaaaatcacaacctcaggaaaagtcactcattgggttaaagaatacagaaaataatgacgtagagattagtgaaacaaaaaagg

SEQ ID NO: 25725 - DNA, 320 bp, Homo sapiens
gagggcgaaggtaccgaagccagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaagg

SEQ ID NO: 25726 - DNA, 213 bp, Homo sapiens
  misc_feature 10, 211, 212: n = A,T,C or G
cacatccagnatgtcctgttactggagggcaccatagtttatcctgcacctaacactaatacacctactctgggaattcttctacctacaactatttatttatctgatcccatctggtattaaagttctaaaagttaacagaattcttaaaggttcccaatgcctcccagaaaccccatcatctcaaaatcactagctattaaaagaagcnna

SEQ ID NO: 25727 - DNA, 215 bp, Homo sapiens
gacaaccttagccaaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacct

SEQ ID NO: 25728 - DNA, 333 bp, Homo sapiens
  misc_feature 16, 28, 31: n = A,T,C or G
gaccggggtctcaatncttaaatttagnagnaccagttgtttttatgatatcagccatttgattttttttcttttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaat

SEQ ID NO: 25729 - DNA, 187 bp, Homo sapiens
gaccgggggttcttcacgattctcctggaacccagtctagcaaaatgagaggaaaggccctagggagatttatttctgttaaatagttaactctgctgagtatgacaaatagtgtctactacctcaaccctccaaaatttgcagagtgttgggactgtcatttgtgattttttttttttttgggggg

SEQ ID NO: 25730 - DNA, 387 bp, Homo sapiens
  misc_feature 11: n = A,T,C or G
ctggccggganagtatgttatacatttgttaacatgttttactcttttcatagcctttacacatattttcagttgatctcatccctcctaggagctgtgtcagagatggggttttcctcttttgtagatgagggaacacagtgtcagaggttttgtaatttgtttgaacaagaatggacaaggacctcaacacaggtgttctagctcctaatccacttgtcctgccacagccccattgctgtcagttcttcattactttcctgatgtgctggagaatctgaaatttgtttttactttgtgagttctgtggttatgtcataaattctgctggcatatggcagtgttagccttgttttcaaatatcttttgaattctcagaaaaagcct

SEQ ID NO: 25731 - DNA, 421 bp, Homo sapiens
  misc_feature 2, 15: n = A,T,C or G
gnaataattcacagnctaaagctattatgaatactctctcaatactcctaaaatctaggagaaggtaaggatatccatattgaccactttcatccatcaatgtagtggaggtcttatatacagagagaaagagaaggcaggagaaaaagaggaaggaaaaggaaattaagaagtataactgcctttattagaagatgttatgctcctgtatgtgaaaataccaagaattacacatacacgtgcatacacacacatacacatgcacacacatacacatgcatacacattcacacacacaactatggaggctaataaagattaataccagatacatatacaaaaatacacatttttgtagtatacaatggataatacaaatgaaattaagaaaataatttcatttagaatagcttcaaaaaga

SEQ ID NO: 25732 - DNA, 433 bp, Homo sapiens
  misc_feature 26: n = A,T,C or G
agggagagagatgtactttttaaatntgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagctttagattttcctattgtgacagagccatggtgtgtttgtaataataaaaccaaagaaacat

SEQ ID NO: 25733 - DNA, 318 bp, Homo sapiens
gagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttagacgggatctcgctttgttgcccaggctggtctcgatctggcttcaagtgatcctcccactttggccttccaaaatgttgcgattataggcgtgagccactgtggctggcctgaaattttctagtatccacattcataaag

SEQ ID NO: 25734 - DNA, 396 bp, Homo sapiens
atcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaatcgaagttaacattcttattttcaagagaatttatggacgttgtagaaatgtacaaatgcatttccaaactgccttaaacgttgtatttttatagacatgttttttaaaaatcctaagtttttaaataactatggatttg

SEQ ID NO: 25735 - DNA, 193 bp, Homo sapiens
  misc_feature 7, 190, 193: n = A,T,C or G
gaaaganttttttggcaatataaattctgacagtatataaggggacaggagaacaacacaagaccattatattcagtgaagaaggcaaaatatcaaatctgtcaacaatgtaactgcatttttatatgtatatatttgtatttttgtatgctttggaaaaagacaggaaataaacaccaaaatgttgccngtn

SEQ ID NO: 25736 - DNA, 420 bp, Homo sapiens
  misc_feature 3, 14: n = A,T,C or G
acngggccgggganggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttt

SEQ ID NO: 25737 - DNA, 333 bp, Homo sapiens
  misc_feature 6, 8: n = A,T,C or G
cccccncnggaccggggcagtagaagttttgtgtgtattttgatggtggttttaagtgtgcaggctggggggcggccccagaaaatctaacatctcatatgtaaatcttaagcaactcatgttaaatgggcagcaaatttatggatctatatcaatgtgttaaaatgtttcaagtccataagcagtgaaataactaatagtaatggatctcaaaggaaaaaagaggcagaactagaaacatcaaatgtataagaattattttaaataactggttgctcatcttggttctctgagccaagatgagcaaacaattcccagactttttttttttga

SEQ ID NO: 25738 - DNA, 441 bp, Homo sapiens
gaccggggaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcaga

SEQ ID NO: 25739 - DNA, 471 bp, Homo sapiens
  misc_feature 11: n = A,T,C or G
aactgactttnacgaagtcaacaaaaataaacaatgaggagaggataccttttattcaatgaatggtcctgggaaaactggctaatcatatgcggaagaatgaaactggaccactacctctcaccatatacaaaatttaactcaagatgggctaaagactaaaatggaagacctgaaattccaaaaattctgtaagacaacctaagaaaatctctcttagtcattgtcctagacaaagaattcatgactaagaccttacaggcaaatgcaacaaaaccaaaaattgacaatggacctaatgaaactaaagagcttctgcacagcaaaagaaactatcaacagagtaaacagacaacctatagaatgggagaaaatatttgcaaattcttttctgttttcttaatgctctggtattttttggcctttctgactgaagagagactgctttttccaggcctagccaattattag

SEQ ID NO: 25740 - DNA, 260 bp, Homo sapiens
  misc_feature 4, 9: n = A,T,C or G
gcgnccccnaccggccggggagcacactaagtgagtcaggagtgggtggaagaatctctccagtgattgaatgacctgacttgaaacatgagtcagacacatctgttatttaatcagcactgccactacctgggtttgtcaccttgaagatatttgtcacttattttgacctcagttttttagctgtaaattgcattatattagtagggcttgaaaggtagaaaaatatttacaaaggtcatgaaagaggtgggtttcag

SEQ ID NO: 25741 - DNA, 245 bp, Homo sapiens
  misc_feature 2, 245: n = A,T,C or G
cnccttcagtatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatggtggatgttttacccacatgacttattatgcataaagccaaatttccagtttaagtaattgcctacaataaaaagaaattttgcctgccn

SEQ ID NO: 25742 - DNA, 246 bp, Homo sapiens
  misc_feature 10, 15, 26, 27: n = A,T,C or G
cggcactgtntggcncgggcacgatnnaaaagggacaagcatcaagcacgcaacaatgcagctcaaaacgcttagcctagccacacccccacgggaaacagcagtgattaacctttagcaataaacgaaagtttaactaagccatactaaccccagggttggtcaatttcgtgccagccaccgcggtcacacgattaacccaagtcaatagaagccggcgtaaagagtgttttagatcaccccctc

SEQ ID NO: 25743 - DNA, 313 bp, Homo sapiens
  misc_feature 1, 15, 26, 29, 31, 40, 269: n = A,T,C or G
nagaagggggggagngggggaaaaangancnggggagttnaaatgattctcctgcctcagcttcctgagtagctgggatttgcaggcattgtgtcaccacgacctgtttaatttttgtacttttagtagagacggggtttcaccattttggccaggctggttttgaactcctgacctcaaatgatccgtccgcctcctaaagtgctgggattgcgggctttagccactcacctggcccacacagctgtttttagattggtatacgaagnagagtgaatttttattgtgcataaaaggtggaaaaatgaacagg

SEQ ID NO: 25744 - DNA, 322 bp, Homo sapiens
  misc_feature 81, 190: n = A,T,C or G
gaagatgataaagatgattgaagatactacagatctgcagccaaatgggtttcctaattatacttctcagtgacagttaangcgacagcatggctgaatagtgacatggttgcacctctccctctcagagtcgaggctgcatttattaattggaagggaaattgtcttgacatttttttttgaaaggtanaaatttcttctaatttcactaattgtattagcccttgtaagattgaaggaaaaggatttcagagtatttcccaatactttgtcaagggaggatattgcagctttataggctaaggtaggagcccttggaagg

SEQ ID NO: 25745 - DNA, 344 bp, Homo sapiens
cttcagtgtgttgataaaggagagccggatgaaaggatcaagtcacctaagcctaacctgtaatatggcaactgcacaagtccccttggcaattttcaagagcaagtgctgctgaggccagtgcctccttggttgctgcattccttcctgctatcactccttgtccccactagccactcagaggtcaagtggggcaccttcaaaagggaaacaactgcccacaaggccagtgcaaatggagctcacccccagatgtttttagtaacaatttgtaaagtcaaaacaacagggtgccaaacccaaggtcatctagattttctcctgttatcttctaggagttttat

SEQ ID NO: 25746 - DNA, 485 bp, Homo sapiens
  misc_feature 3, 4: n = A,T,C or G
acnnacaaaagtacccttggctacaaccactactaatgtcccttcctcttctgcctcaaagttaggaaagaaatataaacactgagattgccccagagctgcagtgggcagcctaggagtgccaagccatgacctacagccagcactcaagggggagagaagcacattttcagatcattgagagggaacatggctgcaactgtaaggaaacataggggagccacatgaccaagcaagagtctaccaactgaccagtaagcccaagtgccacctactggatcacatcccaaagcttcagcatcaaaaataccttactaatatactcccctctgaaaccagaaatgagaagtcagcttcaaataaagaccctgcacaaagcctcagcctggtgaaaacatccgaaaataggtctacggactgtactcaatctacactgcaattaaaggaaaacccataggtggaaatgagaagaaaccaatgcaaga

SEQ ID NO: 25747 - DNA, 317 bp, Homo sapiens
caacttagagtggggagcagagaattctcttatccacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaac

SEQ ID NO: 25748 - DNA, 354 bp, Homo sapiens
  misc_feature 9: n = A,T,C or G
gaccggggnagtcctcgaaggctcggaagcccgtcaccaggtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagaga

SEQ ID NO: 25749 - DNA, 422 bp, Homo sapiens
  misc_feature 7, 13: n = A,T,C or G
tctggcncggggnaggcattgaggccagcccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttt

SEQ ID NO: 25750 - DNA, 467 bp, Homo sapiens
  misc_feature 10, 12, 34: n = A,T,C or G
gcggaggatntnttagttgctgtaacattgagangtgaaatttggaggattcgaaataaatgcagctaaatggaacttttggatgaagaatccctggtttgttcagatctgttaaagtaataggggaaagcacaaaaggatcaagaaaaggaaggccccaatctttgttcgatgactgataaaacagcattacttgggtgaaaattggcctgaccttcacctacaggatgcttccgctgcctcagtgattcttgcttcgctctgattagactctcctctaaagctctgctgggagaggacggccggagaaagacacaagtctccctcagctggctggaacagaaacatcactgagttacaccaggtcctatttgccatccatttcttctttttgccacaaatagagcatcaaaatagattgttcatttagaaggaacacgtccaagctattgccaaccctatgttgg

SEQ ID NO: 25751 - DNA, 410 bp, Homo sapiens
  misc_feature 3, 4: n = A,T,C or G
canncactggccgggatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatatttt

SEQ ID NO: 25752 - DNA, 209 bp, Homo sapiens
  misc_feature 11, 14, 27, 42, 44, 51, 58, 78: n = A,T,C or G
acaccccccgngancccccgccccccnccgggcccgggaaanancaaaacnttgaaantctggttaggctggtgttanggttctttgtttttggggtttggcagagatgtgtttaagtgctgtagccagaagcggggggagggggggtttggtggaaattttttgttatgatgtctgtgtggaaagcggctgtgcagacattcaattgc

SEQ ID NO: 25753 - DNA, 100 bp, Homo sapiens
  misc_feature 6, 13, 49, 67, 71, 82: n = A,T,C or G
tctgantggcttnttgttgaaactgttagactaaactgtggagcactgngctggactaaacgcggtnttgnatcctctgcangcatgctatatctgcttg

SEQ ID NO: 25754 - DNA, 423 bp, Homo sapiens
  misc_feature 194, 228, 251, 258, 277, 299, 308, 341, 388: n = A,T,C or G
aaatgcaaaaaaaaaatctgacaaaatccaacagcttttcattatgaaaaacactcagcctactcggaatagaaggcaacttcctcagactgatgaggagcatgtgtaataaacccacacctgaaaataagggcatctagattggagagaagtcaacttacctctttttgcagatgacatgattttagatgtanaaaatcttgaggaattgacaaacaaatctgttanaactaatgagtcctggaaggatncaggatncaagaatgatttgcaaatntcaatttttgtttttatacagnggcattgtncaagccaaaaatgaaattaacaaaacaactctntatagcaccaaaaaatatacaatacttaaatgtaaattttaaacaanaaatgcaatacttgaacactgaaaactataaaatg

SEQ ID NO: 25755 - DNA, 453 bp, Homo sapiens
taataggccgggcttctcgctcatcatttattaatctttcccatgcaagtcatacgtgaatatatccttgtggtaaagttttcaggtgatagcgaaaactcagtctcctgtcaccgtcttctctcctcatctaggtgcgcgctataactaagtcctttgcctcttccagagtttttttctccctgtgtaccattggccctctgcacttgtgggttttgcatcctcgtgttcagtcacatagggtctcaaggggaaaatattcaagaaaaaatatccaataaaaactaatacagcaatttaaaaaatacaaattttggccagacacaatgccttatgcctctaatcctagcactttgggaggctgagacaggggaatcacttgagcccaggagtttgagaccagcctgggcaacatagggagacgtctctgcaaaaaatttgaaaattagccgg

SEQ ID NO: 25756 - DNA, 381 bp, Homo sapiens
cattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcgtagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataaga

SEQ ID NO: 25757 - DNA, 100 bp, Homo sapiens
  misc_feature 2, 3: n = A,T,C or G
gnncgggcattctggaaacttttgttagggctgcttttcttaagtgcccacatttgatggagggtggaaataatttgaatgtatttgatttataagtttt

SEQ ID NO: 25758 - DNA, 290 bp, Homo sapiens
cacacgaaatggagcaggcttcaaactcaaaagtagctgaagaatacttacaatggaaatgaaagtgaccctagagcatcaatctgtaagtttatccacacacacaaaaagagggtttgtaagagttaaatgtaactggctgaagcttatagctggtgtttgttacaaagtacccaagcttttcctttccaacttcgtggctttgaagaattataggaattttatgatgtgctgttggagttatactggcagagattacagtaaaggggttaaagttggtttatggtaga

SEQ ID NO: 25759 - DNA, 370 bp, Homo sapiens
  misc_feature 6, 34, 41: n = A,T,C or G
gtgcgncccttatggaccggggccaggccgaaantcagggnactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagaaaatg

SEQ ID NO: 25760 - DNA, 472 bp, Homo sapiens
aagcggcgagggtagccatgacggcctccgtgctgcgaagtatctcgccagccctgcgcccgactagcgggcttctgggaacttggcagacgcagcttagagagactcaccagcgagcgtcattgttgtctttctgggaactcattcccatgagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaagagagcggcctcaggtggagcctcacctttgaggagactgagaggagagctctgcttctgaagaaagtggtccttgtacaagcagcaagagcataagatgggagagggacaccatcagggctatgcttagaagcccagcaggaagctctggaggaactgc

SEQ ID NO: 25761 - DNA, 481 bp, Homo sapiens
gtgtcattggaatactggaggagagcaaaggtgtaacacttgtgtcattaaagtcctgaaaggagattaataaggaaaaagaaggcaggcacaaagaaataatggatgaaaatgttccaaattagcaaaaggcataaacctacagatctgagtagctgagcaaaccccaaacacaataagccaaaataaatcaggaatggccatattagtgtcagataaagaagactttagagcaaagaaaattaccagagacagagagggctgttacattgtaataaaagtgtcaaacaaccgagaagacaacaatcctaaatgtgtatgcagaaaataacacagctgccaaaatacatgaaggaaaaactgtcataactaaaaggaaaaagacaaatctacaattacagttgcagacttcagcacgcctccctctcttactgataggtagaacaactagacagaaatagcaaagaggtagaactcagca

SEQ ID NO: 25762 - DNA, 426 bp, Homo sapiens
  misc_feature 3, 5: n = A,T,C or G
atngnccggggtagttgaaggagttgcatttatctttctggctcctaattcctttaaaattacatttgttgcagaacctccacaaggctaaataaaattacatttgtgaccatcagagaactgaataaaccattaactggccatcctggttttgcagagatcaggttgttgacagttcctggttgacccacagctacccatgtcagttatctccactaacatatccaagaatctttgtaggacaatttctccacctgcaaggtctttcgggtagaactcttcttttaaggcaattagcccattgccaaaaggttttactgtcttaaagctgtctttctgagatctaattccaaggacttctccacagctaagtgagatgcctcacaccattaggtgatgctttggacagaacagaagtattttcat

SEQ ID NO: 25763 - DNA, 163 bp, Homo sapiens
caacaaaaaaagaagaagaagaagaagaggaagaggaaagaaagagagagagagaaagaaagagagaaagagagagaaaagaaagaaagagaaaagaaaagaaaagaaaaaagaaaagaaagaggaaggatggaaggaagggaggaagggaagggaaggaagg

SEQ ID NO: 25764 - DNA, 313 bp, Homo sapiens
  misc_feature 3, 5: n = A,T,C or G
aantnaagtgtccccttctgcatgggatgacaagaatcatttaatgctttctggggaaaataatggagtttcctatgggaaaaatgtgtagagagataatattgaaagagatgggaaatacagaacagagttcagggagattaaggcagctggaatatgcagaaccagtaataaagaggaaaaagagaatgccaggtgcagcggctcacacctgtaatccaagctactttgggaggcacaggccagcagattgtttgaggccaggagtttaagaccagcctgagcaacaaagtgagatgccatcactaccgct

SEQ ID NO: 25765 - DNA, 382 bp, Homo sapiens
taatgattccccatgtttttaggtgtaatcatccatccattcattcagcaaatgtttattgaatgcttaccccatgtattttagtaactagagcggcaggaggacgttggggaatgtaataaagatatatagtagacaggtcctgctgttgaagagcttacagcccagtaggaaggtaagaagatacacgtgggctgggcgcagtggctcacgcctataatcccaacactttggtaagccaagatgggcagatcacttgagctcaggagtttgagaccagcctggacaacagggcagaaccctgtctctacaaaaaaatacaagaattagctgggcatggtggctcatatttatagtccaagctcttgggggactgaagtgg

SEQ ID NO: 25766 - DNA, 232 bp, Homo sapiens
  misc_feature 10: n = A,T,C or G
cggcacctcnggccggggttcacacaggatccggagctggtgctgataacagcggaatcccccgtctacctctctccttggtcctggaacagcgctactgatcaccaagtagccacaaaatattaataaaccctcagcacttgctcagtagttttgtgaaagtctcaagtaaaagagacacaaacaaaaaattctttttcgtgaagaactccaaaaataaaattctctagag

SEQ ID NO: 25767 - DNA, 464 bp, Homo sapiens
gccctggaagaaggcctgctctaaattatccgtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaaatttttgacactgaaaaacattttattaataaaggaatattgac

SEQ ID NO: 25768 - DNA, 336 bp, Homo sapiens
atgacagtaatatttacaaataggtaaaaaaatatagagttgtctggtttagactcctgttgtcatggcatgtttaaagaagaaagcttccagccgagaaaggcttgtgatgaagtagcatcacctttcagttagttctctgtagtatagattatgtgtatgtgtctgcctggtcatagatgctggtagctaggtgtccttgcctgatgccaatatgattctgggctgaatgcatatgaatccattctaatataagtgtaaatagcacatgggaagataaacctaccaagagaaccacatacagatcatatggtttattccagaggcaagaatgat

SEQ ID NO: 25769 - DNA, 318 bp, Homo sapiens
aagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatc

SEQ ID NO: 25770 - DNA, 192 bp, Homo sapiens
gttcagacagaatttgaaaattacttttaagtttgcaccagaatgtaactacctttgatatttaaggggcaaaagcaggtgtagagtttgtaggaaacctttatgttatttaatccctgtaatcatggtaccctcttgagagtttgcatgtttgaaatatttaaatttaactcactcatgatttttttcagc

SEQ ID NO: 25771 - DNA, 367 bp, Homo sapiens
gttaacatttggcatttaaaaataaacacgttttttgaatacttggttttattatttgcataggagtataaaatgaacaaccagaaaggtgctaggttgcatattacacatttgcactttgtaatttcatatttgcagtttgtgctttgatttagaaaacactaataacttcattggaaatgccttgtaatacaaaattatatttcagttgtccttttctagttatttgtagattcgtgtacattctgtatcattataaaagaaatcaagaaagcaatcccatttacaatagtgccaaataaataagataactaagaattaaatttaaccaaacaagtgaaagacccccataaggaagattataaga

SEQ ID NO: 25772 - DNA, 493 bp, Homo sapiens
  misc_feature 9: n = A,T,C or G
gaacggggnagtgtgaaatcttcgcagaagcaatttctctttagttctttgcaaggaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgagggaggttgttttagctctgctaaaaactccagcgcaatttgatgctgatgaacttcgtgctgccatgaagggccttggaactgatgaagatac

SEQ ID NO: 25773 - DNA, 456 bp, Homo sapiens
  misc_feature 9: n = A,T,C or G
cgcaatagnatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactagaaaaaaaccttgtagagagagtaaaaaatttaacacccatagtaggcctaaaagcagccaccaattaagaaagcgttcaagctcaacacccacta

SEQ ID NO: 25774 - DNA, 495 bp, Homo sapiens
  misc_feature 4, 14: n = A,T,C or G
tacntgcggccctnatagaccgggggagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaaaga

SEQ ID NO: 25775 - DNA, 354 bp, Homo sapiens
cactctgtgaaccctgcagaagataattatcaaaatatgttccttgaagtgcccaaagaaagaccttttattcagttcctcgaatctctcccccttgttgactcagatggaagaatgcagtcccagaaaggcgaaagagggaaccaaggacacatttttggtcaaccaaaagaaagccggcattggtgaccacagttgagttagcagttggttaacaggtccgggctattttctacccccaaagggagagctgaaccaagctcaaccccagtggagtcagtggccgtgcttagcaatgtgccaaggcatgcaccctccatcaaacttgctacgtagctctgtgagagcagactt

SEQ ID NO: 25776 - DNA, 278 bp, Homo sapiens
  misc_feature 8, 32, 44, 55, 83, 129, 145, 149, 170, 177, 210, 220, 267: n = A,T,C or G
gtactggngaagaaggaaaatagaaggctgangatccaggtganagcaaatggangagcttttggataagaaaaatagattangctgcataactctcaaagctcctgatttcaagatgtcacaacttgngtctgcgagaaaaaanccancttgttgattccctgactcanatccgtnagctccagaggtctctggatgaaggagaaaganagaaatgaanacttagagactgaactcaggcacttgcagaactgatgattccttcanctgtacgactc

SEQ ID NO: 25777 - DNA, 383 bp, Homo sapiens
ctagttccttgagtgtactcttaggttatttatttaggtcatttttcttttcaatgttagtgtttaatcccataaacttccctcttagacctgattttgctgcatcacataggttttggtatgttgtgtccccatttttatttatcttaaggtaatttttaatttcccttttaatatcttctttgacccattgattgttcaggagcatgttgtttcatttccatgtatttgtgaattttctgaaattcctcctgttattgatttccagttttatgccattgtggttggaaaatatacttgatatgattttaatatcactaaatttgttaagtctgatgttttatttactttttttctgtatgatttgtccattgctgaaagtg

SEQ ID NO: 25778 - DNA, 387 bp, Homo sapiens
aagggcaaatgtctgataaacatatgaaaagatgctctaccttactaatgatcaagtaaagggagaatgaagcaaagcaatgccggttttaccttctcaagtttccaaaattaaagttttaggatgccaagagttggaaagatttgaagcaagaggaacactcaagtgttgctggtaggaattttaattggtatcagtagtttagagattgatttggcatgatatactaaagttgaagatgtgcattccctactctctagcaacttactgctagctacatagcctagaacaatgcttgcatatgtatattgatacataagtagatatatattctttttaaaattgttttttaaaaaagggtcttgctgtgtcatccagactggagtg

SEQ ID NO: 25779 - DNA, 370 bp, Homo sapiens
aaggcattgaggcagcccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttaga

SEQ ID NO: 25780 - DNA, 305 bp, Homo sapiens
aggcattgaggcagccagcgcaggggcttctgctgagggggcaggcggagcttgaggaaaccgcagataagtttttttctctttgaaagatagagattaacacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaac

SEQ ID NO: 25781 - DNA, 461 bp, Homo sapiens
  misc_feature 7, 18, 25, 26, 29, 37: n = A,T,C or G
gcaagangtagtaggtgngtccctnntanaaaggggnagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacaga

SEQ ID NO: 25782 - DNA, 420 bp, Homo sapiens
  misc_feature 12: n = A,T,C or G
atctcagaaacngtcttccccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtggtttttttatttctactgtcaaatgatgtgcaaaaccttttactggttgcatggaaatcagccaagttttataatccttaaatcttaatgttcctcaaagcttggattaaatacat

SEQ ID NO: 25783 - DNA, 167 bp, Homo sapiens
gtatgaatgttaatgttgtcagtgtatgtatgaatatgaaagtgctttgttttgtttgttgctgttttttgtttatgtgtgtgtttttaattttttgttcttatcagcagtcttgtgttagcactgggtaagctttaattgtcccttagccaatcaaacattaagga

SEQ ID NO: 25784 - DNA, 401 bp, Homo sapiens
gaccgggcaccatgttcctttgtatatgatgcagcagcataaatgtaagcttttatatcataagttctggtctttccagtcacatctggaaataaagcgtattattttcttgggaaaacatacttttcatatctcttgccccaaagattgggctgtaagccattttctagcaaatgtctctatgaaggtttctaagtacctgaatggggtttgattctgaaatctttctacctgttgcaccgatattcaaataaaaatgatagacacagaaaggtttggtaactttgggttttgtaaaatcagcaaaggcagtgtttcaaaaagtgcaaaaaaaaagattctgttataaagtgattttctaagtatttcctaactttatttttcaaaatgatgttatgaac

SEQ ID NO: 25785 - DNA, 477 bp, Homo sapiens
  misc_feature 10: n = A,T,C or G
gaccgggggnaggcgtccgcgtcgctagctagtcgttctgaagcggcggccagagaagagtcaagggcacgagcatcgggtagccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcggagaaagtgtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacga

SEQ ID NO: 25786 - DNA, 499 bp, Homo sapiens
  misc_feature 2: n = A,T,C or G
tnggcgctctatggacacgggggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatg

SEQ ID NO: 25787 - DNA, 495 bp, Homo sapiens
  misc_feature 2: n = A,T,C or G
cnggggtttttatatatttctagaaatttttatagcagttgcaggtaaactgtcaggattggttttaaaatatttttgtaactttaaaatattctataattatgcatgtgattttaacatttaatattcaaaaataaatctcttgctggatttgagagtattgcatttttaaagtctctcttctgtaactggatgttttggcaacctttgtggggagagactgctggatttcttaaagcaacgtattcctgacactggccacagaatgcctttggaaatcggatgtactgttctcttgttcacgtttagtggtgttttgctgttttgttttttaaacaaatgatgctgagaataaggagagaaatgaatgtagagagaggtagagagagaaatatgaactctaacaaaggactgaggagtgcagtctgctggttcaggcccttcaaaagatgtagaaaaagagatagaaggaaccacctatgcttaaaatactgt

SEQ ID NO: 25788 - DNA, 324 bp, Homo sapiens
  misc_feature 12, 14, 51: n = A,T,C or G
cattggtgttgncnaagtaccgttttgtgacaggcaataaaattttaaganttcttaagtctaagggaccttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgttt

SEQ ID NO: 25789 - DNA, 259 bp, Homo sapiens
gaagatattgatcacttaattctcaatgtaaagattaaagatgtcatcttatttgtggataatccatgggggcaatagcaagaagtccctttttcaccataaaggaacccaagcgcttgggtaaggttcccatcatggcactgagcccatggtggattagagcagaggtgtagagtgattttaaggagactggattgcttgagcccaggagttcgagaccagcccaagcaacatagcaaggccccatctcaacaacaac

SEQ ID NO: 25790 - DNA, 282 bp, Homo sapiens
agtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttcctgc

SEQ ID NO: 25791 - DNA, 429 bp, Homo sapiens
  misc_feature 3, 10, 47: n = A,T,C or G
acnggagtanttgcggcccttatggaccgggggagcggacaaacggnaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatat

SEQ ID NO: 25792 - DNA, 174 bp, Homo sapiens
  misc_feature 1: n = A,T,C or G
natacataattatatgtcatctgtgtggcaggaaatagtttagcatcctgtggatacaatagtgagaaaaacaggtaacaattcctgccttcctggagcttacattctagtcagggaaacagacaataaccaagataaataagtaaacaataaagtatattaggtagtgataac

SEQ ID NO: 25793 - DNA, 468 bp, Homo sapiens
aactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatgggg

SEQ ID NO: 25794 - DNA, 452 bp, Homo sapiens
gagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgattt

SEQ ID NO: 25795 - DNA, 433 bp, Homo sapiens
  misc_feature 19, 359: n = A,T,C or G
atcaacatgctattttatnatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacgattaaagaatatgcccaaaacatctggaacgtggaacccttcagatctaaagatttctctatccaatgaatctaacaaagtcaatggaaattgaactctagaatgtctctagaaaacatagcttcttactgaacttgaacatttttacaacattcactggtttttgttttgttagctaataatctataataagntggagtatctctgggaatggggagggaaattatatgtaataggagcttaaaaataaagtgtcaatttccaaggc

SEQ ID NO: 25796 - DNA, 332 bp, Homo sapiens
  misc_feature 6, 14, 34, 47, 70, 319, 322, 331: n = A,T,C or G
agtccnagtggcanagagcgagctgagtggttgngtggtcgcgtctnggaaaccggtagcgcttgcagcntggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaanaanaaattacana

SEQ ID NO: 25797 - DNA, 167 bp, Homo sapiens
agttttagtggaaaacatgatagctggtgttactgagtaaatttgagtgttaaatgtcaatgtaagctaacggccaagatagggaccactgcagggtggttacttgcagctatgactcaactggtccttcactgccaaacatacctgggtgacagagactctgtctc

SEQ ID NO: 25798 - DNA, 122 bp, Homo sapiens
  misc_feature 5, 115: n = A,T,C or G
cggcnttatggcctgcaggatccggccgcctcggcccagtcgactctagactcgagcaagcttatgcatgcggccgcaattcgagctcacttggccaattcgccctataggaggntcgtata

SEQ ID NO: 25799 - DNA, 160 bp, Homo sapiens
gactgaagagagggtgagaggtcacggctggggctggagatggggagtcatatgcattcaggtggtaattaaagccatctgatgggagcttccatgaggagtgtgctgtgagggaacaaagcccatggccccaaactgagccttgctggaggaaagaagg

SEQ ID NO: 25800 - DNA, 195 bp, Homo sapiens
ctatggagctgtgatctcctacaaatcaaatggggaatgtctgtggatgtgtaagagctgagaaagaagaacaatatgtagatcctgccaaaactcctttgaaccctgaaaaatactctcctggaagaaaatatttcagaagaaaaccgatcaaaaaaactggaggtgacaaagagtcagttggggcaaacaacg

SEQ ID NO: 25801 - DNA, 479 bp, Homo sapiens
  misc_feature 76, 142: n = A,T,C or G
caggtattctgtaatatggaaactggggaaacatgcataagtgccaatcctttgaatgttccacggaaacactggnggacagattctagtgctgagaagaaacacgtttggtttggagagtccatggatggtggttttcagntttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattg

SEQ ID NO: 25802 - DNA, 388 bp, Homo sapiens
gaacgggggtgtgagctaggatatgatttaaatttaaaatatttctaattacattcctgttgtcataattattgcacttaagctatactgtctctagaagaagcactgagtaaatatataagaaaaattgttagttttggtttattataaacaaattgatgcttctggaaaacctgtgattatatttaaacaaaatattacccttgtcatcatttctgtgttttgctgaaagcctttatttggagataatgtaacaaacctgaggcggaggtatttgtcactatcacaacttccaaattaagtgtaaatgtttgacgttttattatattctctccatattgttacatttaaacattagcactttagcagaaagaagtgttttggttat

SEQ ID NO: 25803 - DNA, 359 bp, Homo sapiens
gcaaaatggcgtgatgaaagcatagttctagggaaattagcctgagaatagcagaaagaatggtacagaagaaaaatagaccaggcacggtggctcacgtctgtaatcccagcactttgagaggtcaaggcgggaggatcacctgaggttgggagttcaagaccagcttgaccaatatggagaaactctgtctctactaaaatacaaaattagctgggtgtggtggtgcatgcctgtaatcccagctactcagaaggctgaggcaggagaatcgcttgagcctgggagccagaggttgcggtgagctgagattgcgccattgcactccaggctgggcaacaagagggaaactccatctc

SEQ ID NO: 25804 - DNA, 295 bp, Homo sapiens
  misc_feature 15: n = A,T,C or G
gaacagctaaaaganccacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaccttgtagagagagtaaaaaatttaacacccatagtaggcctaaaagcagccaccaattaagaaagcgttcaagctcaacacccacta

SEQ ID NO: 25805 - DNA, 475 bp, Homo sapiens
  misc_feature 8: n = A,T,C or G
gaaacagnaaaatctcggaaagaaatagaagatataaagaagaaccaaatggaaattttgaactgagaaatataatattcagtgaatagattcatgagcagaatggtgaagacagacataatgacaagaacagaaattacacaatctgaaaaacatagagaaaacagactgaaagagaaaagaacagagcctgagaacagtgggatataacaagatatctaacattcatatcatcataattttggaaggagaggagactgaaggtgggagtgaaaaagtactcaaagaaataatagctgacaacttgccaaatttggcaaaagacatctacagattcaagaaagctgttcaggataaactccaagaaacctacaccaagatatatcatagtaaactgaaaactaaagacaaaggaaaggcttgaaagcaatgagagagaaattatgcattacctttaaagagaaaaacaatttga

SEQ ID NO: 25806 - DNA, 431 bp, Homo sapiens
  misc_feature 13, 33: n = A,T,C or G
acatcaaaacagnaacctctttaaagctaaatnacacagtacccataatgcaaaaatacaagttaaaaagcaaaaacacaaaacaaaaccaaagtacataggcaagaaagagcactacgaaagtaaagtaacggtacctcacatttcaatactaacattgaatgtaaatgacctaaatgctccacttaaaaggtacagaaccgcagaatgggataagaactcaccaaccatctgctgcctttgggagactcacctaacacataaggactcacataaacttaaagcagtggaaaaaggcatttaatgcaaatggacaccaaaagcgagcaggggtagctcttcttatatcagacaaaacaaactttaaagcaacagtggttaaaagagacaaagagggacagtatataatggggaaaaagggcttttgtccg

SEQ ID NO: 25807 - DNA, 100 bp, Homo sapiens
  misc_feature 2, 3, 35: n = A,T,C or G
cnncccgggtattcggccttatggccggcaatagnacttgtttaatgcagggttgccacaaaccttcaatttgtaaaaagaacagtatctgtaaaatgct

SEQ ID NO: 25808 - DNA, 318 bp, Homo sapiens
  misc_feature 9: n = A,T,C or G
cgcaatagnatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagataagtccaaagaggaacagctctttggacactaggaaaaaaccttgtagagagagt

SEQ ID NO: 25809 - DNA, 470 bp, Homo sapiens
attcaaggagaagataccctttctctcataaaaacacttagaagcaaactaccactattaaatcacctattgcatactgcctcagagccatgtgtccagttattctggtttttatctggtacccacacacacataatacttagtacatttccttatatgtaaataattagtaatgtaacacatcgagtgaatgaaattgtgattagcaaagtatgacagctaaaaacaaaggaaattttgtatagtttaagtttttgtacagcagaaggtaatggaaaatatttgcaacatatgacagtgtttttaatgtcttaagtatatgaagaatttgtttcaattggtaagaaaagaccaactgaaaaataggcaaaacataccaaatttcgattcacaaaaagatacaaatggccaacaaaacatgaaacaccttgaaccccattggttacaaaaaatacaaataaaaacaatgc

SEQ ID NO: 25810 - DNA, 283 bp, Homo sapiens
gtggatatttttaaacaattaaaaattaaaatgaaaaacaattatcttgttcctggtggttctcagaacatatgaatatccaattctaaaaagtaaacacctttagttgtatttctgtgtacaggatgtctcaactctgtatattatttaaaatttagccttttcttttagaaatgcttaattttttatttaaaaataattattttagttagctagggtttttgtattcctttcaagtctgctttctgagccatactccagtgtcatgtggaaaatgttacca

SEQ ID NO: 25811 - DNA, 450 bp, Homo sapiens
  misc_feature 5, 19, 393: n = A,T,C or G
gcgcngggtaattacggcncttatggaccgggattgctgatcttgacaaaactttagcaagtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatattaggtnggaaatagcagtaagctttcccattataatatattttttgtatacaaataaaatttg

SEQ ID NO: 25812 - DNA, 477 bp, Homo sapiens
  misc_feature 14: n = A,T,C or G
gttacatttatgtnatacaaatgttattttattataactaaagttatttgtacctttggacaagcattatattgatagcaatatagcacttaaaggatttctatcaagtacaaaagaaaatagtaacaaacacagaaggtagggtaacaggaagtaaaaccacagacctaagaggcaaagcatttggctttattggtgaacaaaatgtgagacatgaatgcttactaacatttttgacatagtaggtatcctttatttcatgaaaatatccccataacatgttaagaaatgctttagaatcctgagattaaaaaactaataatatagaaagtatgtatctcctatcatatatgtatgacttaaattaaataaccatataagatggagctatttttaaaaatattggttttcacctattattaatgatcattccttgaaatcaagacctgctaagttaaggtatatttaatgccaaac

SEQ ID NO: 25813 - DNA, 472 bp, Homo sapiens
ataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatag

SEQ ID NO: 25814 - DNA, 402 bp, Homo sapiens
  misc_feature 18, 25, 240: n = A,T,C or G
gctccccaaattctcagnagacagnagtagcccaagttgtgggcctgtggcagagacttcttctattggaaatggtgatggtatttcaaaactgatgagtgaaaattaattgtgcaacatcctggatacatcctgatacaaaagatcagtacattatttttggaactgaagatggtatttacacactgaatctcaatgagctacatgaggcaacgatggaacagttatttccacggaagngtacttggctgtatgttatcaataatactttaatgtcattatcagaaggaaaaacctttcagctctactctcacaatcttatagctttgtttgaacatgccaaaaaaaccaggattagctgcccatattcaaactcacaggtttccagaccgaatactacca

SEQ ID NO: 25815 - DNA, 468 bp, Homo sapiens
tgggttaaaagatggttgtagcatttaaaatggaaaattttctccttggtttgctagtatcttgggtgtattctctgtaagtgtagctcaaataggtcatcataaaaggttaaaaaagcgaggtggccatgttatgctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttgggatccttcagcacaggaattctcaagacctgagtattttttataatagggaatgtccaccatgaacttgatacgtccgtgtgtcccagatgctgtcattagtctatatggttctccaagaaactgaatgaatccattggagaagcggtgga

SEQ ID NO: 25816 - DNA, 232 bp, Homo sapiens
gaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaat

SEQ ID NO: 25817 - DNA, 499 bp, Homo sapiens
  misc_feature 6, 29: n = A,T,C or G
tggacnggggttacctgatttcatgatanatgatgcttcttgtcaacaccctcttaagcagcaccagaaacagtgagtttgtctgtaccattaggagttaggtactaattagttggctaatgctcaagtattttatacccacaagagaggtatgtcactcatcttacttcccaggacatccaccctgagaataatttgacaagcttaaaaatggccttcatgtgagtgccaaattttgttttcttcatttaaatattttctttgcctaaatacatgtgagaggagttaaatataaatgtacagagaggaaagttgaggttccacctctgaaatgagaattacttgacagttgggatactttaatcagaaaaaaagaacttatcttgcagcattttatcaacaaatttcataattgtggacaattggaggcatttattttaaaaaacaattttattggccttttgctaacacagtaagcatgtattctctataaggcatt

SEQ ID NO: 25818 - DNA, 422 bp, Homo sapiens
  misc_feature 1: n = A,T,C or G
nagtgttcagtgcttctatttagaaagaagaaaggtgtaaaataaaagaatgaagcttccatcttaagaagctaggaagagttgaggaaatagaacccaaaggaaacagaaagaagaaaacaagaaaatcataaaagtcaaaatcggtcattggaaaaattgataaaattaataaacccttgctgcttctcaaaaaacaatttaaaaaagagggagagacagggctaggaaaaacatgcaaatatccaacctgagagggcttatcccctaaggcaagattgctgaacaaatccttgccagcagttaccagtgatgccctaagaatgtaaaacaggatagaggcttgattttacaaccaaagctttgcagaaaatataaacagtgatagtttgaggggccctacctagtaaaaacatcttcta

SEQ ID NO: 25819 - DNA, 409 bp, Homo sapiens
  misc_feature 4, 6, 29: n = A,T,C or G
tctntngacacggggggaagtagagcggnggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaag

SEQ ID NO: 25820 - DNA, 478 bp, Homo sapiens
  misc_feature 13, 406, 442, 453, 476: n = A,T,C or G
catcccattaatnctcctagccctgggcaaggtaagaccatgacagcaattttttaaatcccatctcggtcttctctaggttgctctgtaagaattgtttagatgtaagctggtgagtgctcaggaagccaaagtttaaagcaaaagttttaagcaaaagagtaacatgagctgatactaaaagccatctcttggcccggtgcaatggctcatgcttgtaatcccagcactttgggaggctgaggcaggcggatcacctgaggtcaggagttcaagaccagcccggccaacatagtgaaaccctatctctactgaaaatactaaaaattaggctggcatagtggcaggcatctgtaatcccagctactcaggaggctgagacaggagaatcgcttgaaccccggangcaaaggttgcagtgagctgaaaattgtgccactgncttccaacctnggcaataaaaatgaaactttttncc

SEQ ID NO: 25821 - DNA, 326 bp, Homo sapiens
  misc_feature 2, 19, 50, 92, 153, 165, 205, 234, 280, 296, 322, 326: n = A,T,C or G
tngccgggggcctccgtanaagctgagggaagttctttgcctgctgtcanaggagcagctatctgattggaaacctgccgacttagtgcggngataggaagctaaaagtgtcaagcgttgacagcttggaagcgtttatttatacatctctgnaaaaggatattntagaattgagttgtgtgaagatgtcaaaaaaagattttanaagtgcaatatttatagtgttatttgttncaccttcaagcctttgccctgaggtgttacaatcttgtcttgcgtnttctaaatcaatgctnaataaaatatttttaaaggacatacnaacn

SEQ ID NO: 25822 - DNA, 301 bp, Homo sapiens
gaaacaattcgggaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattg

SEQ ID NO: 25823 - DNA, 432 bp, Homo sapiens
  misc_feature 2, 11: n = A,T,C or G
gngggcccccnggccggggctttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgaga

SEQ ID NO: 25824 - DNA, 187 bp, Homo sapiens
  misc_feature 3, 4: n = A,T,C or G
tcnntggcccgaggaaaaggcaaaactttttctaaagggagaaaccttaaaaatacacccgcataagcctgatctaacaactccatttctaggaatctgtccctaaagagataagcagagaaaagtgctaagatgaatgtaacagggatatttaatagcaaacaatgagaaacaatccagatgtcca

SEQ ID NO: 25825 - DNA, 439 bp, Homo sapiens
  misc_feature 3, 8: n = A,T,C or G
tcngggcncggggaggcattgaggcagcccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttggagggtgatt

SEQ ID NO: 25826 - DNA, 367 bp, Homo sapiens
  misc_feature 9, 11: n = A,T,C or G
cggccctcncnggccggggtactttctgaacccacttcctttcttgcctttactcttaagggaaaacaataattatttcagatttaaaataaaacagtagattagtgaaatcaaattgagagttcagataaaaacccatataaccagagaatgttcttttcaaccaatggtgcttgggacaactggatatttccatgaaatgggaccccctacttcacaccatatacaaaagttaactcagactatagatcagtgacttaaatgtaagagcttaaagctataaagttcttagaagaaaacatagagaaaaatattcatgaccttggatttggcagtggattcttaggacatcaaaagcatgagcaac

SEQ ID NO: 25827 - DNA, 352 bp, Homo sapiens
  misc_feature 1, 14, 33: n = A,T,C or G
ntaaaagagcacgnggggaactcggccgcgggnacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttgg

SEQ ID NO: 25828 - DNA, 391 bp, Homo sapiens
gaatgtgaacactgaagctacttagtaatctccaaggacctctttcagtagggactcatttagtgaatttgcagaagaaacacacacagattgggagcttcccttccgttctttccactaaatggtggggtactgtttgctgttgtgtgtgtccaaaaataacagacctctttcccaaaaagcacagtctgagacaaggacttagtgtaggtaatttcctggaatggatgtttctgggagacagaggaggaaacgccaaaataaaggaacattatagcacttttggaggctgtggcaggtggatcacctgaggtcaggagttcgagaccagcctggccaacatggcaaaaccgtgtctctactaaaaatacaaaaaattagccgggcatga

SEQ ID NO: 25829 - DNA, 478 bp, Homo sapiens
gttttggaaaattatttttaaataactaaaattagttatttcaagatattatacagtagtaatgattattatatactcaagggtgatttcatgaaaaagttagaacatttcatgtagtggtaaacctttgggtgtttataatagacaacagatagttattagctattacaatgcaagattttatactagaatacttttttatttggtgtatatatatttagcaaggaaaagaatgaacaaacacaagttactacattaaatacatgttcttgagcagttacagggatatgggattattaatgtcaaattctggagaatgtaaagaaaagctattcattatacttgatcttgtttctattaaaaaatcatgtattacagttctatcttacatctccaatgtcaaatgtattataattgagaatggagaattagttatgtaaaccttttatcttacacagtgtaaggaggatagtagaag

SEQ ID NO: 25830 - DNA, 470 bp, Homo sapiens
  misc_feature 2, 20, 29, 30, 33: n = A,T,C or G
tngaaacggggggggggggngggcgttanntgnaccggggggagttgatttcattagttgtttgggttgtttaatccagaatttttaaaactgttatgggtttaatttgctacatttgtccattcttattcatttcatctgttttgatcactgaaaagttgtctaaaaactgtgctcattatacacagtttatagtattttaatactttgtttatagtatttaatagcttctgaaaactttaagagaacatactaaaccaaggaactatttattaatggtaatctatatttagtaataaatatatttgtaacttactaaatgtaagtttactaaatgtagattactaaatcactgagtaaatatttcttgaatatttggacaagagatggggggagggagaatgacttgaccctcaagaaacttaactgctacctttaaaaggttataatgaagctgggcacagtggtac

SEQ ID NO: 25831 - DNA, 439 bp, Homo sapiens
  misc_feature 3, 4: n = A,T,C or G
tanntggaccggggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttggaaggtgatt

SEQ ID NO: 25832 - DNA, 419 bp, Homo sapiens
tctggccggggaaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttt

SEQ ID NO: 25833 - DNA, 229 bp, Homo sapiens
gacaaggaagtggggggacaagtggtccacttttcctgcaacttggtggctgaatacacaatgcaattcctagtccacatcatccctcaattgattgcagtctgtagaaaaaataaaataaaatgagccccttactcaagatttcctcctacttccccagcattctttcccaaaggtgcagaatttcagaaccacagaggtctctcagaactttgtaaacaggcaaact

SEQ ID NO: 25834 - DNA, 331 bp, Homo sapiens
  misc_feature 2, 16, 308: n = A,T,C or G
cnctggccgggaagangcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcacttttcccaaatgatcctagtaattgcctagaaatatctttctcttacctgttatttatcaatttttcccagtatttttatacggaaaaaattgtattgaaaacacttagtatgcagttgataagaggaatttggtataattatggngggtgattattttttttatactg

SEQ ID NO: 25835 - DNA, 295 bp, Homo sapiens
  misc_feature 21, 23, 34, 35, 39, 42, 43, 48: n = A,T,C or G
acgcggggggggggggggttntncggcacggganntcantanntgacntttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctgg

SEQ ID NO: 25836 - DNA, 377 bp, Homo sapiens
  misc_feature 4, 9: n = A,T,C or G
gaanggggnaggcattgaggcagccagcgcaggggcttctgctgagggggtaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggacggaaaagataaaaggtttctaaaacatgacggaggttgagatgaagcttcttcatggagtaaaaaatgtatttaaaagaaaattgagagaaaggactacagagccccgaattaataccaatagaagggcaatgcttttaga

SEQ ID NO: 25837 - DNA, 331 bp, Homo sapiens
  misc_feature 1, 16: n = A,T,C or G
nggctttcgctctaanattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaac

SEQ ID NO: 25838 - DNA, 264 bp, Homo sapiens
  misc_feature 16, 23, 35: n = A,T,C or G
aacggggtaacttagnacccatnctgactccaaanccagtgccctctacactagaccacactgtctttcttaggttggatctaaaaaaatactaccagctggttggttttttaactaactgtaggaacacaacctagtattaagtagagtatgcatgctgcatagtggactgaggtagagtaaaacccattattgtaccacttttaggtaagaaaatgtattatctaaggaatatcattaaaatttccttacttccctccatga

SEQ ID NO: 25839 - DNA, 278 bp, Homo sapiens
  misc_feature 4, 15, 48, 262: n = A,T,C or G
gctngggggaaggtnacttcgtgggtgaggctgacatgcctcacacanttacaacagtagagagggaaaatcctaagacagaggaactccagagatgagcgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttattttttatttttttttngtaaagtgattttttg

SEQ ID NO: 25840 - DNA, 421 bp, Homo sapiens
  misc_feature 3, 30: n = A,T,C or G
atngaaagggatgtattagtgtattccagnatatttgattttatcccccttgtctctgattggggcatactagtgacttgtacatcatgaattaaaaccctttaacttctcattaatattgaaacccttagggctctctttttgagccaaataaattattcacattttcaacctggatagtttacacagagcaaatttaagggtgagagaaagcaaagaggaaaattaatttgactggaaaattgaaacaaaaagaaataaaagccttcaaaatttctcttcctaagaaaagcttaaggtgtaccaagcacccatgaacaagacattggattttctcaaatctctttccttggggtgagtttataacttcactgtcatgtctttcaggaaagatacccaaataatagtatgttcaatgagg

SEQ ID NO: 25841 - DNA, 374 bp, Homo sapiens
  misc_feature 351, 366: n = A,T,C or G
tctatggcacggggaaggaagcatgcattataactgtctaactcttctgcgttcatattgatgttaatgggactaaattaccttgctagcttaatgagataagattttaaatgggtgttttatgtactctgtgtgtgtgtatttaatgaagacttggtggtcgcttctgatttacacttgggaatcaattcccctcttgtggctttttactttgtttcctttcattcaccctcgaattaaggcatcctcagtatagaaaattttgaaaatacagaattatgtttaaaaaggtagaaaaatggaggtaaaatatgcacttgaaatctgtcataggcagtgttccaacaccangtcttgtcctcagangaggaaga

SEQ ID NO: 25842 - DNA, 439 bp, Homo sapiens
aaggccggggattagaagaaggcttcactgactcatttaaacttaatacctaccctgtgtgcagaaaagagttaatatagcagacctgagactgctatccttggaaaagcctgctgataagattggccgttagctggcatctgggaacttggatgataaacagctccctacactgatagaaaactttccctaaattataaggtgactcacggtgcatttgtgcacacatagtgatttttgctgaacatctgtttcccttccgggcatccagaattttggtatgtgctaggcttatgtgactagcccctaaccttgggcactgtctctgatgagcttcttttgtacaacatgtgtcacatgtgttgtcacaactcattactctccagtaatgttagtacatcctatttgactccactgatagaggactcttggaagcttg

SEQ ID NO: 25843 - DNA, 436 bp, Homo sapiens
  misc_feature 5, 20, 29, 42: n = A,T,C or G
tccangtatggcggatgaancccgcgacntgttgtgtctganatcccggtgctgaagactgacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacagggggtggcaaaatatgcctgacggatcatttcaaacctttgtgggccaggaatgtgcccaaatttggactagctcatctcatggctctggggctgggt

SEQ ID NO: 25844 - DNA, 100 bp, Homo sapiens
  misc_feature 2, 7, 27, 98: n = A,T,C or G
antttgntaggccggggaggtctaatnacctgaagtcacgagttgctgagtaccagccacgcccaatatggatggacccctgtctaatactaaaaatnca

SEQ ID NO: 25845 - DNA, 361 bp, Homo sapiens
  misc_feature 1: n = A,T,C or G
nttggccgggaatgaggggggaatctaaaagcctttcctgtaagatctggaagaaggcaaggaagcccactttcaccacctttcttcaacgtggtactggaagtcctagccagagcaattaaacaggagaagaaaagaaaaggcatccaaattggaaggaaaaatttagattacccttgtttgcagacaatagtatcttaaatttagaaaaacctaaggactctaccagaaaactgttagaactgaggtttagtaaaattgcaggatgcaaagtcagcatataaaaatcagcagcatttctgtatgccaagagcaaacaatctagaaaataaaccaagaaaataatcttatttccaatagc

SEQ ID NO: 25846 - DNA, 262 bp, Homo sapiens
  misc_feature 134: n = A,T,C or G
tcttttctggatgaagtgatgtatgctttgcatatgagttgccatggtgacagtggacctttccagtgcagcatatgccagcatctttgcacggacaaatatgacttcacaacacatatccagaggggcctgcntaggaacaatgcacaagtggaaaaaaatggaaaacctaaagagtaaaaccttagcacttagcacaattaaatagaaataggttttcttgatgggaattcaatagcttgtaatgtcttatgaagaccta

SEQ ID NO: 25847 - DNA, 402 bp, Homo sapiens
  misc_feature 18, 19: n = A,T,C or G
tactaaaggtaatacttnngaaatacgtgctcatatcattttagaaagaactatttactttttaaagccagtgttgttggggttttcgtaatatgtataacacagatattttaattttaaattcttgacttagtgatttagaaatcatctttgataaatgtagaattcacataagagttaataaatgagggaaaggaataaaattataggtatctttagcctttccaagaagtcagttttcatcctgtagctttaattggacgttattttaggaaatagaatatttttgagaaatttctaagaaggattcaagaaaacatctcacacctgtataaaaatttgtgtctgtgaaagtagaggactagacataaacacaaacttcaggaggggaattaggcaagg

SEQ ID NO: 25848 - DNA, 399 bp, Homo sapiens
  misc_feature 9: n = A,T,C or G
ccggggatnccgtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaggcctgtccacgagctcaatagggaagcctgtgatgactacagactttgcgaacgctacgccatggtttatggatacaatgctgcctataatcgctacttcaggaagcgccgagggaccaaatgagactgagggaaga

SEQ ID NO: 25849 - DNA, 362 bp, Homo sapiens
cttttttttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtggtatgctcacttccccatcaacgttgttatccaggagaatgggtctcttg

SEQ ID NO: 25850 - DNA, 423 bp, Homo sapiens
cagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagat

SEQ ID NO: 25851 - DNA, 487 bp, Homo sapiens
  misc_feature 7, 9: n = A,T,C or G
gtaggcntntttggccgggggcgcaatagatatagtaccgcaagggaaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaat

SEQ ID NO: 25852 - DNA, 238 bp, Homo sapiens
  misc_feature 5, 14: n = A,T,C or G
gaganccctgtctntaatttaaaaagaaaagaaaaaaacattcccagtggcagcctgcctaagactgtcttaccttatgttaaggaagtcaggtatttaaaatgttacatatgccggcgcagtggctcatgtgtgtaatcccagcactctgggaggctgagacaggtagatcatttgaggtcaggagttcaaaaccaacctggtctacatggtgaaaccccatctcaactaaaaatac

SEQ ID NO: 25853 - DNA, 100 bp, Homo sapiens
  misc_feature 2, 3, 34, 94: n = A,T,C or G
anncccgggtaatttcggcctctatggcccgggnatctttaaaaataattaaaaaggtcaggtgcggtggctcacgcctgttaattccccagcntttttg

SEQ ID NO: 25854 - DNA, 498 bp, Homo sapiens
  misc_feature 5, 14, 46, 53, 76: n = A,T,C or G
tcgtnctacacganacgtactacgttgtagcctcactttccactangtcctantcaataggagctgtattttgccntcataggaggcttcattcactgatttcccctattctcaggctacaccctagaccaaacctacgccaaaatccatttcactatcatattcatcggcgtaaatctaactttcttcccacaacactttctaggcctatccggaatgccccgacgttactcggactaccccgatgcatacaccacatgaaacatcctatcatctgtaggctcattcatttctctaacagcagtaatattaataattttcatggatttggagaagccttcgcttcgaagcgaaaagtcctaataggtagaagaaccctccataaacctggagtgactatattggatgccccccaccctaccacacattcgaagaacccgtatacataaaatctagacaaaaaaggaaggaatcgaaccccccaaagctggtttcaag

SEQ ID NO: 25855 - DNA, 468 bp, Homo sapiens
ctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcag

SEQ ID NO: 25856 - DNA, 107 bp, Homo sapiens
  misc_feature 1: n = A,T,C or G
naaattgagtttctttctctttaggcctttcacaactaggactgagaatgtatgtaaaagttctgtgacagtacagaaggaaaacaactttttatgtatagcttcta

SEQ ID NO: 25857 - DNA, 500 bp, Homo sapiens
  misc_feature 9, 13, 35, 90: n = A,T,C or G
gtccggccntctntggaccggggattgatttgtgnatgatacacattgtaatttgatgcaatagtttaaggcaataggtacggaaaatgnggtttctatttttcgatttcctgtaaatcagtgacataaataattcttagcttattttatatttccttgtcttaaatactgagctcagtaagttgtgttaggggattatttctcagttgagactttcttatatgacattttactatgttttgacttcctgactattaaaaataaatagtagatacaattttcataaagtgaagaattatataatcactgctttataactgactttattatatttatttcaaagttcatttaaaggctactattcatcctctgtgatggaatggtcaggaatttgttttctcatagtttaattccaacaacaatattagtcgtatccaaaataacctttaatgctaaactttactgatgtatatccaaagcttctccttttcagacagatt

SEQ ID NO: 25858 - DNA, 436 bp, Homo sapiens
ataattaaacatgatcctgagttatctgtattctgaactttcttaattgagaagaggcaggaaatcactgcagaatgaaggaacatcccttgaggtgacccagcaaacctgtggccagaaggaggattgtaccttgaaaagacactgaaagcattttggggtgtgaagtaagggtgggcagaggaggtagaaaataattcaattgtcgcatcattcatggttctttaatactgatgctcagtgcattggccttagaatatcccagcctctcttctggtttggtgagtgctgtgtaaataagcatggtagaattgtttggagacatatatagtgatccttggtcactggtgtttcaaacattctggaaagtcacatcgatcaagaatattttttatttttaagaaagcataaccagcaataaaaatactatttttga

SEQ ID NO: 25859 - DNA, 449 bp, Homo sapiens
  misc_feature 2, 5, 443: n = A,T,C or G
cntcnctggccgggactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacgtcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatgggatgttactctcttgcaccaaattatcttgatacattcaaatttgtctggttaaaaaatagggnggtaga

SEQ ID NO: 25860 - DNA, 380 bp, Homo sapiens
aggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttagc

SEQ ID NO: 25861 - DNA, 467 bp, Homo sapiens
gcccttttgcggccatcaccgagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtagggaaagggaaaagggcaaatacaaggaagaaaccattggagaaga

SEQ ID NO: 25862 - DNA, 377 bp, Homo sapiens
  misc_feature 3, 9, 359: n = A,T,C or G
gancggggnaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatanaagggcaatgcttttaca

SEQ ID NO: 25863 - DNA, 443 bp, Homo sapiens
  misc_feature 3, 4, 190, 220, 222, 269, 328, 389, 398, 416: n = A,T,C or G
ctnnggaccgggattttcaaagagaatgttctcttacatatgttaggaaaataggcacactttcaaagagaggtataggggctttttactgccttcgaaatcacttttaataaaagttgtatgataaatcattaaaaatgcgagtgtaaatattttttttttacctctatcagggtttttatttgaaagngtgctcttaccatttccttgtttgagtaananagtgaatggttctgagtgtttaggaaggatttgcttgcttgcagcanaagttctaggaaaagcaggcacctcccaaatatcttgaggacactggcagccttatggngactaaatccacactttctttaaagagatgcagatgaattacttttctgttaatatatagnaaaaatacncaggagaacatgcagatncatgtaaatatctacatacagggatat

SEQ ID NO: 25864 - DNA, 374 bp, Homo sapiens
gttgtaaaaattaaaacatcttgaagggtaaaagaatgtaaaaatcacttcataccctactgcttagtgatagtggctgtttagagtatttttctcgacatctcttcccttaggtacataacaatattgacacattaattgagcatctgttgtgtgccattcttagagtcacatgcatctttgcattaaaagacagacttggcttgaaggagttagccaggctgagggaaaggatttaggtaaatccagtggaactttccaggaagaaggacaccatagtgaagattctgaaagagctagctgtttttgaaactgacagaacacaaggatgtctgaagcatagagaaggagggagagttaaagaaaatgtagga

SEQ ID NO: 25865 - DNA, 371 bp, Homo sapiens
ctatatggacacatttgcatccacatacagaaatacatacaaaagaatgtatcctttgacctacaggcacatgcacgcctgcccatcatttcatagatatgtaagattttcctcccaccgtgggcgcttggtttatacaatgatggggcttcttttatacttactaattctattctctattatattccaaaagccatcatattatctgccttgtccaattttcttctgtgtctcattaaagtagcctgctgtgaagctaatttttcttgctcattttattgatattttgggagagtgagattttttccaagccattcctgcttcagtatagggttgtggtagctgtcaaaagaaggctttgaaaccatcct

SEQ ID NO: 25866 - DNA, 265 bp, Homo sapiens
  misc_feature 4, 19: n = A,T,C or G
tggncgggggtcattaatnctgctaatctgaaaaactgaatctatcacacaaagggatctatcttccttcctctgtgagaaatgacctatgaagagatgtcagggttgtctgatttcttgttattgggtttttgggattcataggaattgattatactgttagtaaatcaatgaaacatgaaataatgtgtaaatgaatgatgatgaagaatactaaatatggaccaatggtgggtttttgttgggtatgaaccaaggattaaga

SEQ ID NO: 25867 - DNA, 326 bp, Homo sapiens
  misc_feature 5: n = A,T,C or G
agggnatatttttaaatacttgtttctaataatacctcttagcagtaccttttaaataagtataagggatggcaaagtttttccctttaaaaatactcactttatgcttataaataggttaatgggctgataaaaggttttgtcaaacattgcaagtattcggtgctatatataaaggaggaaaaactagttttactttcagaatgatttaaacaagatttttaaaaacaagatacatgcaagcgaacagcagggttagtgataggctgcaattgtgtcgaacatcagattttttgttaggagcaaatgactcaatctgatttaga

SEQ ID NO: 25868 - DNA, 355 bp, Homo sapiens
  misc_feature 3, 5, 339: n = A,T,C or G
tcncnggcccgggggttatgatagcactcagcaatacggaagtaatgttccaaatatgcacaatggtatgaaccaacaggcatatgcatatcctgctaccgcagctgcacctatgattggttatccaatgccaacaggatattcccaataagactttagaagtatatgtaaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttagggnttttttttgtactaga

SEQ ID NO: 25869 - DNA, 475 bp, Homo sapiens
  misc_feature 148, 163, 167: n = A,T,C or G
gagagcatgcccttctggcttacacactgggtgtgaaacaactaattgtcggtgttaacaaaatggattccactgagccaccctacagccagaagagatatgaggaaattgttaaggaagtcagcacttacattaagaaaattggctncaaccccgacacagnagcntttgtgccaatttctggttggaatggtgacaacatgctggagccaagtgctaacatgccttggttcaagggatggaaagtcacccgtaaggatggcaatgccagtggaaccacgctgcttgaggctctggacttgcatcctaccaccaactcgtccaactgacaagcccttgcgcctgcctctccaggatgtctacaaaaattggtggtattggtactgttcctgttggccgagtggagactggtgttctcaaacccggtttggtggtcacctttgctccagtcaacgttacaacggaagtaaaatct

SEQ ID NO: 25870 - DNA, 310 bp, Homo sapiens
  misc_feature 8, 11: n = A,T,C or G
tccggccntcnatggaccggggaggcattgaggcagcccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagc

SEQ ID NO: 25871 - DNA, 415 bp, Homo sapiens
  misc_feature 3, 19, 40: n = A,T,C or G
ganagggggattcctgaanctgacagcattcgggccgagnatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagactagtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggagg

SEQ ID NO: 25872 - DNA, 350 bp, Homo sapiens
gcctcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatga

SEQ ID NO: 25873 - DNA, 343 bp, Homo sapiens
  misc_feature 6: n = A,T,C or G
aagatnaacacaaaaatatcaattcactagcaacgagtacacggacaccaaaataaaagctaacattccatttacgattgctcaaaaaatgaaacacttagatgtaacaaaacacgtacaggatttgtatgctgaaactagagaatcctgatgaaaaaattcaaagatctaaataaagggagagccaaattgtgttcatgaacttaatatagtgaatttatcaattctccccaaactgatattcaaatttaattcaatacctatcaaaatcccagcaaaaaatatttatagagacaagattcttcaaaaattcatatggaaaggcaaaggaactagaatagct

SEQ ID NO: 25874 - DNA, 238 bp, Homo sapiens
  misc_feature 3, 6: n = A,T,C or G
ctntcnggccggggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgag

SEQ ID NO: 25875 - DNA, 303 bp, Homo sapiens
  misc_feature 237, 267, 282: n = A,T,C or G
atgtctcgctcccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggnctggtctttctatctcttgtgctacactgnattcacccccactgnaaaagatgagtatgcctgccg

SEQ ID NO: 25876 - DNA, 475 bp, Homo sapiens
gttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtc

SEQ ID NO: 25877 - DNA, 444 bp, Homo sapiens
  misc_feature 4, 24, 28: n = A,T,C or G
gaangggggggggggggggaggtnaggnaggggtgaaataaacatactaacacattcgcctcctagtgttatcatgagaactggctctgagaaagcagtcagtgaatgttagatattattcttttatttcattgttagtgtcttcctgctgctttaactaagaaagtgatttttaaaacctgctcaatgtatataagaagtttcacctaccgtctcaaagataaggcaaggatctccctgaacagagtttgtattttttgtggcttgcccagttctgtataacattgtgcatttttcttcctttttgtatttagcgaatacaaataagaaaaacagaagaggctagatgtagtgactcacactttgggagaccgaggtggtaatatcacttaagccaagaaatttgagaccagcctgtgcaacatggctagaccccatccctac

SEQ ID NO: 25878 - DNA, 469 bp, Homo sapiens
  misc_feature 19: n = A,T,C or G
cttcagatggatgtccagngatccaagggccaccttacagacgctcagtgagtatcgtcagtggttaagggaagcgcactgcgctcctggacttatgcatccgactccctgctttatgacaagtgccgtgtgaccttgggcacatgccttgggagttgtttcccttgtaaaatggagataggaacactctcttggcctcacagagctaatataaaatggatcaaatgaaactggttatgaagttgttttttaaatgctgaagtgctttagaaatccgctatgtaggctgggcgcggtggctcatgcctgtaatcccagcactttgggaggccgaggcaggtggatcaccggaggtcaggagttcaagaccagcttggccaacatggtgaaaccccatctctactaaagttacaaaaaaattagcccggcatagtgggggggcacctgaaatcccagctactcgggaggc

SEQ ID NO: 25879 - DNA, 283 bp, Homo sapiens
  misc_feature 2, 5: n = A,T,C or G
cnctngccgggaaattaaaaaaatttccttctaaaaatatgctaagactttttaaatgtcatatgttatatggatgtttaattctatttttttctttactaagttttccttttaaatctgttactaaggtgaattttattaataacaattctaatagtcaaattgctggaataaacccaacttgatcatgatgtatcatcttttatttttcattgctggatctggtttggtaatatttgttcagaatttttgcatccatgttcataaagtgagattgaattgg

SEQ ID NO: 25880 - DNA, 366 bp, Homo sapiens
gtgtgtacccaaagttagattcaataatccaattatgagcgaaaatacttaaaattgctaataggcgctttgtactttattagttaccaggaatatgaaataaaatgtgaatcatgggctaatgatttgccaaagaaagatgcatgaattatattttttgtgttttgttttagtttaagtcaagtaaatagctataagtctagcaattccgaatttgaattgattaatgttacatttctttggcgcctgctgtttttatctcagggtggattattttttcagagttgaggagttgacctcttttgtttgtagaagaaaggagtgttttttaaaaaatgcaaaaacattagtaggccaacattgtat

SEQ ID NO: 25881 - DNA, 461 bp, Homo sapiens
  misc_feature 407, 437, 446, 452: n = A,T,C or G
agtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaaggatggcaatggctatattagtgctgcagaacttcgccatgtgatgacaaaccttggagagaagttaacagatgaagnaagttgatgaaatgatcagggaagcagatnttgatgggngatggncaagtaaac

SEQ ID NO: 25882 - DNA, 169 bp, Homo sapiens
  misc_feature 5, 6, 25, 26, 35, 48, 65, 103, 108, 148, 155: n = A,T,C or G
caatnnaggccgggggaaacacgannctactgcgnaacattgctgggnttcctgggcagaaattnatataaactgtgatactcacattccttgaagctatgancattnaaaaactgtgtacacgtcaccatagggattcaaaagaatntggaatnaactggtgaagttt

SEQ ID NO: 25883 - DNA, 372 bp, Homo sapiens
  misc_feature 7, 38, 108, 110, 118: n = A,T,C or G
ccggccnttattggcccgggggccatccctcctgaccngacagaaggttgatctttgctgggaaacagctggaagatggacgcaccctgtctgactacaacatccagnangagtcccncctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgaggg

SEQ ID NO: 25884 - DNA, 393 bp, Homo sapiens
  misc_feature 357, 369: n = A,T,C or G
acttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaggtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtntccaaccaactnggttctgcttcaataaatctttgg

SEQ ID NO: 25885 - DNA, 248 bp, Homo sapiens
  misc_feature 18: n = A,T,C or G
gagatcgacgtgctgagnacgttcttctgataaagtatctaaactagaaggtcaagtagaatcttataaaaagaagctagaagaccttggtgatttaaggcggcaggttaaactcttagaagagaagaataccatgtatatgcagaatactgtcagtctagaggaagagttaagaaaggccaacgcagcgcgaagtcaacttgaaacctacaagagacaggtagtagaactacaaaacagattatccg

SEQ ID NO: 25886 - DNA, 484 bp, Homo sapiens
  misc_feature 4, 12, 437: n = A,T,C or G
tagncacggggnaaacaacatctctactaaaatacaaaaattagccaggcgtggtggggcacgcttgtaatcccagctacttgggaggctgaggcaggagaatcacttgaacccaggaggcggaggttgcagtgagcagatgcaccattgcactcctgcctgggtgacaagtgcgaaacttcgtctcaaacaacaacaacaacaacaaagtctattcaaggctgggtgcggtggctcatgcctgtaatcccaacactttgggaggccgaggtgggtgtatcacttgaggccaggagttcaagactagcctgggcaacatagcaaaaccccatctctactaaaaatacaaaaattagctgggcatggtggtgcaaacctgtgatcccagctactcgggaggctggggcacgagaacgcttgaatctgggaggcgggangttgcaataagctgagattgcaccactacacttcagcctgggtgaga

SEQ ID NO: 25887 - DNA, 108 bp, Homo sapiens
  misc_feature 7, 13: n = A,T,C or G
aaagggnggtaangcaaattcaaaatgctgtcaacggggtgaaacagataaagactctcatagaaaaaacaaacgaagagcgcaagacactgctcagcaacctagaag

SEQ ID NO: 25888 - DNA, 366 bp, Homo sapiens
  misc_feature 4, 66, 78, 87, 100, 101, 122, 140: n = A,T,C or G
tctngacacgggcccgtcacacatggggaaacttagtatagtagcaggtgaaggtattttttccangattaccaaatnactgtctgngctgggattcgtnnccaggccgcctgactccaaantcaatattcttaactctnttgttatgatggagaaaggcatgaagtctaccttcaaattcatggcattttagaaggaaaaattgtcgcaagtaatgtgattatacttcctagttttataggtcagaaaaatgaggtccacactaattttgcctcttccacagggagatagattctcatctaccattgtgtcttttgtttctgtttttgtcatgatacctcaaattgatatatgttgtaattatga

SEQ ID NO: 25889 - DNA, 441 bp, Homo sapiens
tatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaagggaggagtcaactaatgaagaaatgaataataaaatttttgacactgaaaaacattttattaataaaggaatatttgac

SEQ ID NO: 25890 - DNA, 345 bp, Homo sapiens
  misc_feature 324: n = A,T,C or G
atcaataggaaagcatatgcagccaaccaagatgcaaatgttttgaaatgatatgaccaaaattttaagtaggaaagtcacccaaacacttctgctttcacttaagtgtctggcccgcaatactgtaggacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggngggtgattattttttatactg

SEQ ID NO: 25891 - DNA, 357 bp, Homo sapiens
agggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgtttgaagttaagttttccaataatgtgacttcttaaaagttttattaaagggggaggggcaaatattggcaattagttggcagtggcctgttacggttgggattg

SEQ ID NO: 25892 - DNA, 469 bp, Homo sapiens
gattcctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattg

SEQ ID NO: 25893 - DNA, 491 bp, Homo sapiens
  misc_feature 2: n = A,T,C or G
gnaggcattgaggcagccgcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaaggtgattaaaagaccttgaaat

SEQ ID NO: 25894 - DNA, 482 bp, Homo sapiens
  misc_feature 32: n = A,T,C or G
gattcctgaagctgacagcattcgggccgagnatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatac

SEQ ID NO: 25895 - DNA, 454 bp, Homo sapiens
  misc_feature 3, 13, 24, 45: n = A,T,C or G
tangtcggcctcnatagaccgggnatatcagctgacactgatagnattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagatattttaagtactctggatagac

SEQ ID NO: 25896 - DNA, 376 bp, Homo sapiens
cgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtaga

SEQ ID NO: 25897 - DNA, 467 bp, Homo sapiens
  misc_feature 5, 10, 28: n = A,T,C or G
cctcnatagncggggccttttcacaagnatggcgccgaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtgggatgttaaagccaacaagcaccagattaaacaggctgtgaagaagctgtatgacattgatgtggccaaggtcaacaccctgattcggcctgatggagagaaagaaggcatatgttcgactggctcctgattacgatgct

SEQ ID NO: 25898 - DNA, 253 bp, Homo sapiens
gctcttctaaaatagtgtttccctgactttgggcagtttgagtacaaacctcacaatttttgacatgtctgcacaccatttgttcttttacctgctgaccatgttttaaaaatctactttgtaaagtaaatcagaaaagggaactgtaatcactacatgactggaaaatcagtggtgcttactggtgtagattagtgtaaaagtaaataccattaaaaaaccccaacctgggcaacatactgagatcttgtct

SEQ ID NO: 25899 - DNA, 220 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagc

SEQ ID NO: 25900 - DNA, 200 bp, Homo sapiens
atagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctac

SEQ ID NO: 25901 - DNA, 486 bp, Homo sapiens
  misc_feature 2, 30: n = A,T,C or G
gnagcatttaagaagcatcctctgccaagnaccaaaaggaaagaagaaaaagggccaaaagccaaaatgaaactggtggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccatttctgatttcccacaaactgcactacatcagtataactgcatttctagtttctatatagtgcaatagacatagattctataaattcttacttgt

SEQ ID NO: 25902 - DNA, 192 bp, Homo sapiens
  misc_feature 2, 12, 45, 64, 105: n = A,T,C or G
gnaggcattgangcagccgcgcaggggcttctgctgagggggcangcggagcttgaggaaaccncagataagtttttttctctttgaaagatagagattaatacnactacttaaaaaatatagtcaataggttactaagatattgcttagcgttaagtttttaacgtaattttaatagcttaagattttaag

SEQ ID NO: 25903 - DNA, 440 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagatagaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaagg

SEQ ID NO: 25904 - DNA, 101 bp, Homo sapiens
  misc_feature 14: n = A,T,C or G
ccggaaggttgagnatgaagcttcttcatggcagtaaaaaatgtatttaaaagcaaaattgagagaaaggactacagagccccgaattaataccaatagaa

SEQ ID NO: 25905 - DNA, 253 bp, Homo sapiens
gcatggaagtcagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaagaagagttaaaacaacacatgtaaatgccttttgatatttcatgggaatgcctctcatttaaaaatagaaataaagcattttgtt

SEQ ID NO: 25906 - DNA, 244 bp, Homo sapiens
tgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagct

SEQ ID NO: 25907 - DNA, 431 bp, Homo sapiens
ggaaggatggagccacttcatcacaccttcaaatatattaagttgtataaactatcaaggccacaaaatactaatgtcatttggtcataatgactactgataaggcatcagaatggattttcagggctaccagaaaaatgtttccagatggttttagaatgtaggacttatgatccaattcaccaaaagattaaatgaaaccaccctgtgttttaaaatatatataatgttcaacctaatgtatatgcaacatttattctattctaattatttgacaggtaactgcagtgttaaattgtaaatgtgttttctttatgttaccaaaacagcaatttgaaattagaactagtggttttagagaactcaggtattctttcctgacattgttttcagaataaagaatatttttcataatattttaagatacatac

SEQ ID NO: 25908 - DNA, 440 bp, Homo sapiens
  misc_feature 5, 27: n = A,T,C or G
gggcncggggaaaccacactggggaantgggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttattttttttaccaattccaatttcaaaatgtctcaatggtgctataataaataaacttcaacactctttatgat

SEQ ID NO: 25909 - DNA, 485 bp, Homo sapiens
  misc_feature 4, 11, 75: n = A,T,C or G
gtcntcgcccnatagccgggagcctttaagaagcatcctctgcccagcaccaaaaggaaagaagaaaaagggccnaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagatcgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcataga

SEQ ID NO: 25910 - DNA, 422 bp, Homo sapiens
  misc_feature 2, 23: n = A,T,C or G
angcgccggggaaatgtcggccntctatgggccgggggcgcaatagatatagtaccgcaagggaaagatgaaaaattataaccaagtcataatatagcaaggactaacccctataccttctgcataatgaattaactagaaataactttgcaaggagagccaaagctaagacccccgaaaccagacgagctacctaagaacagctaaaagagcacacccgtctatgtagcaaaaatagtggggaagatttataggtagaggcgacaaacctaccgagcctggtgatagcttggttgtccaagatagaatcttagttcaactttaaatttgcccacagaaccctctaaatccccttgtaaatttaactgttagtccaaagaggaacagctctttggacactaggaaaaaaccttgtagagaga

SEQ ID NO: 25911 - DNA, 494 bp, Homo sapiens
  misc_feature 4, 9: n = A,T,C or G
tcangggcnacaaattaaataacaatagtatttgattataacctaaagcaataaaacaaatatccatgtgtccatacttacagaagaatttcaattaatgaatgtagaataaatgagggaacctttaaaacaccgtaataataattgttacaagataaagttagtgggtaaaggagaatcacaatatttgcatagttacaagatatctccccaaaaacacttacaaagttaaatagtaactttactgtagaggaacctgtgggacactgccttaaccaagtgatcatggttaattctaacaagtaataaaacttgtatcccctggacctaaagcactgagaaagatgcatcacctatatggaatctttccccaaaaaatgcataacgtctatccagtcatgagaaaacatcagaaaaacctaaactgaggatattctacaagataactgaccaatactgttcaaagtgtcaaggtcataaaggacagggagaga

SEQ ID NO: 25912 - DNA, 286 bp, Homo sapiens
acaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttg

SEQ ID NO: 25913 - DNA, 324 bp, Homo sapiens
  misc_feature 37: n = A,T,C or G
aattcgaagcaataacatcaacacactgttcaaaatnatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcaga

SEQ ID NO: 25914 - DNA, 413 bp, Homo sapiens
  misc_feature 21, 23: n = A,T,C or G
tatggccgggatatctcgaanantttaattaaggaattgcttattgttgagcttagcaaattaataacactatttctgtcactaattattttgaggccttttagtactaaaattttaacctgtgttctaagtagaaactgatttaacccaagtaatgcagctttgattgatttcagcattcgttgctttgctatttttacaaaacagcattgattgaagcaagtcttggttttactaaggtagggtagcatttgctattggtaaagagaataaatacacttaatttcacaatacattgttatatgtaccccagttgttgttagtggggactatgatactgtaataatatttttaaaaatttacatcaagagaggcagtcattcacgatgggttttgtgccagctctttttagg

SEQ ID NO: 25915 - DNA, 491 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctgggaggctggcacctgattttgtatccccctgtagcagcattactgaaatacataggcttatatacaatgcttctttcctgt

SEQ ID NO: 25916 - DNA, 409 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttta

SEQ ID NO: 25917 - DNA, 283 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcat

SEQ ID NO: 25918 - DNA, 382 bp, Homo sapiens
tgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcctgtcacaaaagtgccactaaaacagcctcaggagaataaatgacttgcttttctaaatctcaggtttatctgggctctatcatatagacaggcttctga

SEQ ID NO: 25919 - DNA, 472 bp, Homo sapiens
ggactaacccacagggaaaatggattagtaaaaagcttaggacaattaacaggaaaattgcattaaggttaatcccttggatatggtgccatggttaaatcacccacagatttgttattcataaatgtatttatcttaaatatttaaaatgggcatttaagaggaatttaatatacagtttgtttaaggtccacgttttttaaaacgttaattacttatatccttatttatacagaatttttggttcagtttagttacctcaactttgctttccctgtgcttataacaagttttaagaaagatgagttttaaaccttttgtttcctgactgaataccttaacattttccccgcatatatacatgaatacacacacgccatacacacacacaaaattgacattgtttaccttttgtttatttctaggaatcaagactatttggactcagtgtcagccactactaatatttata

SEQ ID NO: 25920 - DNA, 456 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttg

SEQ ID NO: 25921 - DNA, 450 bp, Homo sapiens
  misc_feature 197, 199, 267, 283, 291: n = A,T,C or G
ggggaaaatgaaggttaggatttaacagtcatttaaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctttaaatntntaaaaagaaaagataaagatgatctactcagaaatttttatttttctaaggttctcataggaaaagtncatttaatacagcagngtcatcanaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgt

SEQ ID NO: 25922 - DNA, 278 bp, Homo sapiens
gaggcaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacagaagtacgggaaggcgaagaaaagaatagagaagatagggaaattagaagataaaaacatactttt

SEQ ID NO: 25923 - DNA, 252 bp, Homo sapiens
  misc_feature 6, 12: n = A,T,C or G
tatggnccgggnacagtacatggatgtgcatgtctcatgacattcatctctttcgaaaatatactttagaacatttctcttggagctcctaagaaaaataaatggttggtggtggcccggatggtaggaagacaggttaggatgaaacaagaaatttttcttagtagttataaatctctcaaggggaaaagttagagccccaacacttgactcatttagaacaagttgaaccaacctctgaaaaataaactc

SEQ ID NO: 25924 - DNA, 289 bp, Homo sapiens
ggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatg

SEQ ID NO: 25925 - DNA, 383 bp, Homo sapiens
  misc_feature 78, 99, 105, 146, 197: n = A,T,C or G
attctaattcaattgcaagcagtgggagtaaatgacttctgtccaacagtgccaaagatgaagaaatctttatacagngcaataagtttattgcaacancccggngaaatactgggaaatgcacacctgcaacatttcgttgtgtnttgagcagaatgagtgttcagcttgggaactttggaatgtaataattagtnattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgaga

SEQ ID NO: 25926 - DNA, 182 bp, Homo sapiens
  misc_feature 75, 182: n = A,T,C or G
atttaaaaataactaaaaagtataattcgattgtttgtaacacaagggataaaggcttgaggggatagatacttnctttaccgtgatgtgattataaagtattgcataactacattaaagtatctcatgtaccccataaatatatgtgcctactatatacccacaaaaaataaaaattagcn

SEQ ID NO: 25927 - DNA, 381 bp, Homo sapiens
gtaatcctcacataaacagaaacaatgagaaaaacaacatgattatctcaatagatgcagaaaaggcctttgacaaaattctacagcccttcatgctaaaaagtctcaataaactaggtactgatggaacatatctcaaaatcataagagctatttatgacaaactcacagcaaatataatactgaacgggcaaaaactggaagcattccctttgaaaactggcacaagacaaggatgccttctctcaccagtcctattcaacatactattggaagttctggccagggcaatcaggcaagagaaagaaataaagggtattcaattaggaaaagaggaagtcaaattgtctctgtttgcagatgacatgattgtatatttgg

SEQ ID NO: 25928 - DNA, 311 bp, Homo sapiens
tcttgtgaaaataacctcaaaaagaaaaatacgactctgttgtcttacttgatatttcttgccctagtaatgtacttgacatttatgttcctaagcagtgtaagtaccagtagaatttctctgtcaaactcaatgatcatttagtacttttgtcttctcccatgtgcttgaaggagaaataaagtgtcactaccgtatttcttgttttcatcaaaaaataaaaataatttaaaaaattctgtgttgtctaggttaatttaaggttgggaaatcattaaagttatcaaatgataccagtaactatcatcctg

SEQ ID NO: 25929 - DNA, 104 bp, Homo sapiens
  misc_feature 37, 104: n = A,T,C or G
gatattccgtgaatgtatattgtcttgtaatgttgcntaatgttcactttttatagtggggcctttattctaaacagaaaagaggggttatttctatcacacan

SEQ ID NO: 25930 - DNA, 388 bp, Homo sapiens
aagaataagtgagactgaatctgcaatggcagaaattgaaacagcagcatctaagcagcttcaagaattagcattgcaaagtgaacaggtcctagaaggtgcacagaagacattgctgttagccaatgaaaaagtagaagagttcaccacatttgtgaaggctttggccaaagagttgcaaaatgatgtccatgtggtaaggcgacaaataagagagcttaaaaaaatgaagaaaaacagggacgcctgtaaaacctcaacccataaagcccagaccttggcagcttctatcctgaacatttcacggtcagatttagaggaaatattagacaccagaagatcaagtggaaattgaaaaaacaaaaattgatgctgaaaatgacaagga

SEQ ID NO: 25931 - DNA, 427 bp, Homo sapiens
gggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacgtcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatggtttagtcagcatgctcaggaaataaatgtgaattg

SEQ ID NO: 25932 - DNA, 220 bp, Homo sapiens
  misc_feature 2, 19, 28, 29, 36, 41, 64, 66, 84, 104, 132, 154, 177, 203: n = A,T,C or G
gngacgacttgttgaaatnaccctactnncgatctntacangatcactgggttcaggatctgananagaaaatcaatgaaggtnggagccgtcatctttgtacnagaacagcagcagtgtttctatgtactntttcctctaaaagaatgaagcnaatttttagggagaagagtaaangtttaatttgattgaaattattgggntttctgcagggcatttc

SEQ ID NO: 25933 - DNA, 262 bp, Homo sapiens
ggcgcaatagatatagtaccgcaagggaaagatgaaaaattataaccaagcataatatagcaaggactaacccctataccttctgcataatgaattaactagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataagg

SEQ ID NO: 25934 - DNA, 449 bp, Homo sapiens
accctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacagttaaggg

SEQ ID NO: 25935 - DNA, 172 bp, Homo sapiens
attccttctctctaataatatttactgttcctcaaagaattgtctacattacccatctcctcttttgcctctgagaaagagtatataagcttctgtaccccactggggggttggggtaatattctgtggtcctcagccctgtaccttaataaatttgtatgccttttctctt

SEQ ID NO: 25936 - DNA, 426 bp, Homo sapiens
  misc_feature 3, 129, 248, 257, 306, 380: n = A,T,C or G
ggnggggacacagaaccaaacctatcaactacctattattctcttacatagcaatagcagtagtagtgaagatgttactcattacttgagtactgattgtgtgactggtcctaattctataacagtgtntattaatcacttacaatgtctgaggcaggaatgctaaccagtttacatgcatgatatcacttaatcttgacagtaatgatgtattttgtgtccaaggaaaactgaggtttagagaaatnaggtaattnaccaaaatcataacctaagttaagagtcagatcaagattcttgtctgtntggtggcacaggccatgagattatcaagttttagccttctctgtgaatctctttttcagtatatctgataaatngccatccaacttctggtttaatttgtgaagtaaagggggttctcat

SEQ ID NO: 25937 - DNA, 339 bp, Homo sapiens
gggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggg

SEQ ID NO: 25938 - DNA, 414 bp, Homo sapiens
  misc_feature 412: n = A,T,C or G
gggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcggaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccggggggtgaangg

SEQ ID NO: 25939 - DNA, 467 bp, Homo sapiens
gacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaagggacagcaccagactattctctgcgtgttgcactgcatagtgaacctgcagacaattcccgtggatgtgggaggaagctttccttgcccatgccattaaggcattcactaaggttaattttgattctg

SEQ ID NO: 25940 - DNA, 462 bp, Homo sapiens
  misc_feature 25, 264, 268, 276, 325, 361, 373, 425, 448: n = A,T,C or G
gaatggaattttgttgactttaatngcaagcagtagttcattaccctaaagattctgttgttgtttttttttccgattctgtgaatataattttaaaattaataatcaattaagtgtaacatttagtagaaagatttttaccattgagccttaaaagaccgtagctaaagctggagggtcatgaaaaataaagaaatcattcaactttgggggttttttttccctaagatgttaatttcctttattcccatgtaacattctgtncagngaactgtnctttaattacttatggaacttttaaaaagtccacttacaatgtataggngatgacttatttcatttgtcaagatcagttatgtancagctgtttggnggtgacgtgaaatcataatatttgatggcattaagccctaaaggactgtgtnccccattagcatgcagctaccanagcctagtttttac

SEQ ID NO: 25941 - DNA, 449 bp, Homo sapiens
atagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccta

SEQ ID NO: 25942 - DNA, 400 bp, Homo sapiens
  misc_feature 365: n = A,T,C or G
ggatgggttaaggtaaaaggctgatcacagatgggttcctctcaaggttaaaatagtttaagtgccagaagaaaaggtgggcaccagtgaattaagaaccatctttgaatggtcaccttggttaaatacttaacttttgtcatcagtgtctgcatttatgaaatgaagaggaattcactaatatgctacgtgatcttttgtttgtcatgaaaagagttactgttgtgtagttctctgttccagggctgcctctgctccacaaagcactgagaagcagtggccctgtacaaccatactgcctctcaacactgtgtaataggctaacaccgcccagcgaaccttcctgggagatatagatacattanggtttaaggctgacaaaaattaagagaacagaggc

SEQ ID NO: 25943 - DNA, 459 bp, Homo sapiens
  misc_feature 7, 19: n = A,T,C or G
cccctcnatggcccggggnaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataatttgaagg

SEQ ID NO: 25944 - DNA, 102 bp, Homo sapiens
  misc_feature 92: n = A,T,C or G
atacacagttatataactgtgctattatgtatagtttgaatatatataatatgtgtgtgtgtgtgtatatatatatatatatatatatgtanacaaaaaatg

SEQ ID NO: 25945 - DNA, 326 bp, Homo sapiens
gaattctgtatgcacatacttttgatttgcttttaatgaagttcaggaaagtagatgaaataggaaacaaacatttaaaaaacattcaacctcactagatgtcattatgtatttgaaaccaccaatagtttaaaataatgagaacattcaatatatgtaagattatagtgatgataacaatatattgctggttgcaacatagataacatctttttagaaaacaattttgtaaaaggactcaagaattatgaaagatcatagcctgtgatctcatattattacttggaatttatgctctttccatgtaaaagaagaaataaagcatg

SEQ ID NO: 25946 - DNA, 401 bp, Homo sapiens
  misc_feature 358, 389: n = A,T,C or G
tatggccgggggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacatcaccattgccactgatttttttttaaatggtaaatgaccttgtatataaatattgccatatcatggtacctataatggtgatatatttgtttctatgaaaaatgtattgtgctttgatactaaaaatctgtaaaatgttaagttttggtaatttttttttctgctggnggatttacatattaaaattttttctgctggnggataaacattg

SEQ ID NO: 25947 - DNA, 441 bp, Homo sapiens
  misc_feature 50, 349: n = A,T,C or G
gttttgtttttagagtataagtagcattagtaaattagcttaatgtgcanccaagtagttgttattttaagaacaatttgtgctttaactatcaattagtattattttatctttccaagttattttactaaattgcttcatacaattgcttttgtcagtcaagtaaaatagtcatttcgattgcattgtattagcaacatagaaaacaactactgcaaaatataatgggaaattaaactctcacaggttgtaaactgtctccctttgaatccttgtctgaagaaattaatttgaactatgccttctaaataggtacaggtgagtcatctagatttcattaaacattttnttttaaggggtttttgttaccttggttcttttaaaaagttaaactttgtttggaatttatctttcaagtatttccttttcagcttgttcacg

SEQ ID NO: 25948 - DNA, 230 bp, Homo sapiens
tatggccggggaatttaagtttcaataggaacacagtattttattagaaagagtgctaagctgagattcaagtgcccttaattctatttagttttagatcatcggtaaattattctccaatcgtgttaacttctctagaaataattcctgcccctacatactttctaggtgctttgaaagaaaaaaggaacaaagtaaaatttagtctgttttgcaagtaaaatcagtac

SEQ ID NO: 25949 - DNA, 465 bp, Homo sapiens
  misc_feature 149, 308: n = A,T,C or G
ggctacaagtgatgagaaagattctttttcgaatataaccagagaaaaaaaggatggagaaacatctaggacagtgtcttctcagaaaccaccagccttgaaggctacaagtgacgaggaagattctgttttgagtatagccagagaanaaaaggatggagaaaaatctaggacagtgtcttctgagcaaccaccaggcttgaagtgtcttctcggaaaaaagcagccttgaaggctacaagtgatgagaaagattctttttcaaatataaccagagaaagaaaggatggagaaacatctaggacagngtcttctcagaaaccaccagccttgaaggctacaagtgacgaggaagattctgttttgaatatagccagagaaaaaaaggatggagaaaaatctagaacagtgtcttcagagcaacccacccaggcttgaagtgtcttctcggaaaaaagcagcctt

SEQ ID NO: 25950 - DNA, 470 bp, Homo sapiens
atataactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctcttttttttgctgtt

SEQ ID NO: 25951 - DNA, 474 bp, Homo sapiens
gactcctctagagtataacaaaaggctccagattttacagaaaaagattttaaaaatatacttgaatactggattactttcctttaccaaatggttgttcttaaattctactttgttaaaacaagaatatttgtggaggtaaaagtgaaaataagctttgcttgcataatcaatcttatcattttatttaaacaagcctgcgcttcctgcttctttagaacagtgaagaaagatcggaaaactgctaatcagcagaattgagagatgtttcttaaccgttcaatgttttcatgggaaaacattccaaaaatgatgaagacaacacccttgtaataaaaaccttagagctcacccttcctgcagattttagcaggccccatgatgagtgacacatatttactcattaccctaattgtcttggctgtgagacaagaaagctaagaatttgttttgggcagaggatgtctagggagt

SEQ ID NO: 25952 - DNA, 467 bp, Homo sapiens
ggaattagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatggaagaagttgatgaaatgatcagggaagcagatat

SEQ ID NO: 25953 - DNA, 472 bp, Homo sapiens
aatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagta

SEQ ID NO: 25954 - DNA, 466 bp, Homo sapiens
cttttggagagaagtgtttaacgatcccaaagttctcaagtcctattattatgccatctctgattttgctgtaggtggcaggtaagtaaactattaaattagtcttgaaagtgtttggagcttttgcatagaggtgaatctagcaacttgtttacaactatgttaataccgttgttagatgttttctttaccaagaataggagcggcagtccttcctgtgtgataatgcttagctgaaaagacggacagcagcctaggatattttcactgtgagatcttcttgttgttctggaaactaagcatgtaggttttccaaaaccttgtcaaatccacacatttagtgaattcttattgacaatttaagtgcaagggcactgtgaagcacttgaggaagggtaagactcaccttatcctacggagaagtcctgaccttcttggatcttacacatgaacagggtaggcaatg

SEQ ID NO: 25955 - DNA, 152 bp, Homo sapiens
agttcaactttaaatttgcccacagaaccctctaaatccccttgtaaatctaactgttagtccaaagaggaacagctctttggacactaggaaaaaaccttgtagagagagtaaaaaatttaacacccatagtaggcctaaaagcagccacc

SEQ ID NO: 25956 - DNA, 486 bp, Homo sapiens
  misc_feature 481: n = A,T,C or G
ccttatggccggggaactcggtggtggccctgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtgggaagaagtgggggngggac

SEQ ID NO: 25957 - DNA, 470 bp, Homo sapiens
cattgctgggtcctcaatgcagggggccatttcatagatgaaaatggctctcgccttccagcaattccctgcagtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcattttt

SEQ ID NO: 25958 - DNA, 403 bp, Homo sapiens
  misc_feature 10: n = A,T,C or G
ggatgcaagnagtcagcatggaaactcatctgttcatgaggaaagtggagtaatgttaaagagaatgcaggtggagcgtgttttcaagagcagcttgtcaatggtatcaaatgctgctcagggaccaaataaaatgaggaccgagaattgtgcatttggcgagggagtgttcatcgttgacactgacctgcagtgtgtcagtggaatggtggggacaaaagactgcctgaagtaagttggtgttcagatgagaggtgaggaagaggagactgaaagtctcgatagttctttggagtagttttgctttaaagagttgtagagaaatggaatgagagctggagaggcattaggttctcaagggaggggttttaaaagaaggagatagtatagcaagtttatatgc

SEQ ID NO: 25959 - DNA, 474 bp, Homo sapiens
aaggacagagaaaagagaaaatagatgccgtgtttggttaggggattatgggcaacatcctttatatgctgcttttaaactaagtcaacataggtttttattgcaggaagaagttcacatttgtgtctaccaaatgacaacatgtaaagcttggaattgagttggttttaggtttttctgtgtatcacttggaggttttctgtgtataactttcttgtattacttggagattttcaggttattggcaccacaggagcagcattattgccagcagacccggggagctggttggagagtcattgcgacttaatttaccctgagctaaaattattatgagtgggccttaatataccagttgttcccacctacacatctagccttgcctttgctgggataaatttgtatacccttcagaggttagattcagaagtacctcctttaggaattatttttagaacctagatctggggtgta

SEQ ID NO: 25960 - DNA, 422 bp, Homo sapiens
  misc_feature 8, 11: n = A,T,C or G
ctcccagnatnagataagcaattacggaaagattacaggatacaggtcaatcactttcctatatatcaacaatgaacaagtggaacaaatgttgaaatttaaaacattctaccatttatgttagcacaagatgaaatatttagccacaaatctaacaatatgtgcgagacctatgtgcaagacctctatggggaaaactacaaaattctgataagagaaattagagaaaaactaagtaaatggtgaaatatttcatgttcatgtatagaaagaatcagtattgtcaagatgtcagttcttcccaatttggtctacagattcaatacaattgaaataaaaatttcagcaaattgtatcgtggatatcaacaaattgattctaaagtttatattgggagggctgggcatggtgactcatgcctg

SEQ ID NO: 25961 - DNA, 402 bp, Homo sapiens
agtgtttttttgcatccctgcccactttagaattaatacatgtaaaattgtcaagccttccagggtgcttttaaagctgacaagcccagttgtaaacttctaatcttatacataataattgattcagttgacttataaactgtgtgtgatctgttttgatgggatgataattttgatgctacttttatatctgacgttttaaatggaatattagaatgagttttaaagataatgagttccctcagagaaacaatagagttgtctatcagcatattattttaaaataacaaataaaaattgtactagataataggcataaggtatggacaaatctcaaagtcacctataatctgaagaaaaagagacaatacgtactcataaaagaaatgtagaataattagg

SEQ ID NO: 25962 - DNA, 150 bp, Homo sapiens
  misc_feature 9: n = A,T,C or G
actaagaanagtcacgaggtagaattaggggcccttgaaaatatgacaaactctgagggaaacaaagacaatgtggaaagaataacttaattttaattccattctccagagagatttgaggtgtatttaagatgaaaaacaggatactac

SEQ ID NO: 25963 - DNA, 116 bp, Homo sapiens
  misc_feature 17: n = A,T,C or G
atactttctgaatgacnaaccgtccctggactgtggaatgttccggcctgcatttctgcccaccccttccgttgtcacgagtgccgtgccgtgtaataaagtcccagtgctcatcc

SEQ ID NO: 25964 - DNA, 377 bp, Homo sapiens
ggctataaatcattgttagaaaattgtgacactgatttattttaatcccgacaatttggctagtaaactcccattttaaaaaatatgtcagtttggccgggcgcagtggctcacacctgtaatcccagcactataggaggctgaggtggccagatcacgaggtcaggagttcgagaccagcctgaccaacatggtgaaaccccgtctctactaaaaatacaaaaattagccaggtgtttgtggtgcacgcgtatagtcccagctacttgggaagctgaagcaggagaattgcttgaacctgggaggtggccggttgcggtgagccgagatcatgccattgcactccagcgtgggcaccaagagcgaaactccgtctc

SEQ ID NO: 25965 - DNA, 451 bp, Homo sapiens
ggtaacagatgaagaaaggctatggaagagacagattctggaggatgcagcattcaaggttctatcttggaagcagagactgtgccctcaccagatgctgaacctgctgagcaccctgatcttccacttcaccttcatcagaactactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaaaatatttactatttgatttcttcaagctccaaacgggcttgtgcttagctgtagaaacttgaatatatacaaatctacatggattagaattctta

SEQ ID NO: 25966 - DNA, 471 bp, Homo sapiens
  misc_feature 33: n = A,T,C or G
ggaaagaagatgaattatagctccggaagaatnaagatcttaagtgaagcctttctgttcagatgtgatctataaaaaatcataatttggggaaagtttaagcaaatctggctttgtagtcctgatgttataagtgactttgtgatcaaactgtcaggcttgggttcttgttatagaatgcttggtatagaaaaaccatgccatcattaatggctaacaacacgtagggacttcatgtcatgtcaaagatagctctttgcaagtgccttgattaaaccagaaaactgtcatcgtttaacccaaatatctgaatggtcatctggtaactcatgggttttttggcctcataagatggtccactctgtacacaggcattcctcctgcaataatgttgtatctttgagaccgttgtcagtgtacacaactcacatccttcatattgaaaggtgactcatttttctgcacactttt

SEQ ID NO: 25967 - DNA, 458 bp, Homo sapiens
ggaacgactttatctgtccagaatcagctgaaggaattgccagaaaaaatgcccaaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctctttcccttacggaattacatcttgatggcaacaaaatcagcagagttgatgcagctagcctgaaaggactgaataatttggctaagttgggatttgagtttcaacagcatctctgctgttgacaatggctctctggccaacacgcctcatctgagggagcttcacttggacaacaacaagcttaccaga

SEQ ID NO: 25968 - DNA, 463 bp, Homo sapiens
  misc_feature 45, 52, 54, 63, 64, 70, 81, 126, 148: n = A,T,C or G
cattgaataaacagggatctttcttaaaacttattaataataaanagttggngnagtaagtgnngaatanaattaataagnttaactgttctgtaaatggcttatatacgcatatatcaatatggntttatattttaaagtaagtgcnagctgtggttaaaagcagacacttttacactgctggtgggaatgtaaactagtacaaccactatggaaaacactatggagatgccttaaagaacttaaagtagaactaccattcaatccagcaatcccactattgggtatctacccaaagaaaaataagtcattatatagacacatgcacacgcatgtttatagcagcacaattcgcaattgcaaagatatggaaccaacctaagtgctcatcaaccaacgagtggataaagaaaacgtggtatgtatataccatggaatactactcagccataaaaaggaatga

SEQ ID NO: 25969 - DNA, 467 bp, Homo sapiens
  misc_feature 22: n = A,T,C or G
actttcacatcatcataaagtnaaaaaactgtaaatcaaaccttcctaagtcagtgaccccctgtacccttaaacaatgagataaacttccatcaagcatggcagtactctggctttgttctccgtttgaaaaaccgtcactttataggcttaatatatctattttacacattaagactgtaccttcaaactgtgttgttccatacagtagccctagtcatgtgtggctaaacttgaattaacaaaaattgaataaaatttaaaattcagttcctgaggtgcactaataacatttcaatggctccagagtaacatatggctggtggctactgtattagacaatacagaatggtttcatcatcacagaaagttctgctggacagtgctgagttggaaccaggtgttctttacacacagaccacttaaagactgaggttttatttatacacctgagttttccaagcact

SEQ ID NO: 25970 - DNA, 435 bp, Homo sapiens
attaacaattgctcagcccaattctcggatatagggattcaaaagacaggatacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttagtgggctattaaacttggatttttctttttattaatgcagtatgttctttttattcaagtatgaacttgttgagaaactatagtaatatgatttttaagagatttatgttctacttaaaatgtgaattgtacttctgagctgccttaatgcaaggtcatttatatttgttaagaggaaataatcaaga

SEQ ID NO: 25971 - DNA, 423 bp, Homo sapiens
atatatttcatggtgtcatatcttaaattatggccctatttctattttgtagtgtgctttttattagggattctgaatattctcattaacagtaacaaaaccaaccagcaaaaattttgaagtaatattgactctgaaaatgtccttcctgcagcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtaagccaaaaatgtccgatacacatgtttacattgttgagctacatttagtttagtgcttgaaatagggaactg

SEQ ID NO: 25972 - DNA, 305 bp, Homo sapiens
attagaaataatcatgtctcagcatgagtaatgtctgtttccagggttcagaaaaggcaaactcatgaaatgccactgaaaagaactttcaacacagcatacttcatgtaaaagaaattgtttgtttgctttctttgtgtagatttctatttgtgttttatgtcatggaaatattccagaattaacagataatagtggtaaagtaatatgcagatagtctaaattcattttgagtttctaggtgtaagcagactaaatgttgcccagaatcagtgttgggttatcagtttatattaaatatactg

SEQ ID NO: 25973 - DNA, 375 bp, Homo sapiens
  misc_feature 14, 22: n = A,T,C or G
gatactaaaagatncaactgtnacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcattagattctataaattcttacttgtctaagacaagtaaatctgtgttaaacaagtagtaataaaagttaat

SEQ ID NO: 25974 - DNA, 346 bp, Homo sapiens
  misc_feature 13, 48, 65: n = A,T,C or G
agagcataacttnacttaaattcttcattttagcagtgatgatatgcntaagtgctgtaaggctngtaactggggaaatattccacctgataatagcccagattctactgttttcccaaaaggcaatattaaggtagatagatgatcagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctg

SEQ ID NO: 25975 - DNA, 190 bp, Homo sapiens
acagggacttcgggcagaggagaacataactgaatcttgtcagtgacgtttgcctccagctgcctgacaaataagtcagcagcttatacccacagaagccagtgccagttgacgctggaagaatcaggcaaaaaagtgagaatgaccttcaaactaaatatttaaaataggacatactccccaatttagt

SEQ ID NO: 25976 - DNA, 401 bp, Homo sapiens
gagggttggggcgagtggaccgcgcctctaaagcgcttgccagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactgggatttggttactg

SEQ ID NO: 25977 - DNA, 456 bp, Homo sapiens
cctgttaggcgagagctgcgaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagattaagaagaagaaagggccaagtgatccagttccaaactttgggatatttttcttcaattttgaagaga

SEQ ID NO: 25978 - DNA, 100 bp, Homo sapiens
gaatacatgattgaaccactcagagatcttgtgactgacgcagctggtccaattgcattttcactgctgtgcagtatcggccttggatctggctttgatc

SEQ ID NO: 25979 - DNA, 117 bp, Homo sapiens
gaaaggcaagttagaatccgcttaaggatcatataatatcgtaccaggtaagaagagaggcgagaaagatgaaactgagtatgagtacagtgggagtgaagaagaagaggaggaagt

SEQ ID NO: 25980 - DNA, 246 bp, Homo sapiens
  misc_feature 2, 32: n = A,T,C or G
cncgggcagaacctgtttgtttcaattggccntttaagtttagtagtaaaagactggttaatgataaccaatgcatcgtaaaacccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 25981 - DNA, 373 bp, Homo sapiens
ctattccgccttccttgtagcagataaggttattgtcacttcaaaacacaacaacgatacccagcacatctgggagtctgactccaatgaattttctgtaattgctgacccaagaggaaacactctaggacggggaacgacaattacccttgtcttaaaagaagaagcatctgattaccttgaattggatacaattaaaaatctcgtcaaaaaatattcacagttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagact

SEQ ID NO: 25982 - DNA, 469 bp, Homo sapiens
agactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcacctgacctgcctgtagccccagtgacagctaggatgtgcattctccagccatcaagagactgagtgaagttgttccttaagtcagaacagcagactcagctctgacattctgattcgaatg

SEQ ID NO: 25983 - DNA, 352 bp, Homo sapiens
gtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcctcagaaaaagcttttccattacactgtgaatgatacctgttttgttgtttctgaatttccacatgttctgaagacaaattttttatagccgcttatggccattttgtacaattttgaaataaaattaaaccattc

SEQ ID NO: 25984 - DNA, 445 bp, Homo sapiens
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaaga

SEQ ID NO: 25985 - DNA, 271 bp, Homo sapiens
  misc_feature 174, 199, 215: n = A,T,C or G
ggtagctcacacctgtaatcccagcactttgggaggctgaggcgggtggatcacgaggtcaggagatcgagaccacggtgaaaccccgtcactgctaaaaatacaaaaaaaaaattagccaggagcggtggcaggcgcctgtagtcccagctactcaggaggctgaggcagganaatggtgtgaacccgggaggcggancttgcagtgagccganatcgcgccactgcactccagcctgggcgacagagcaagactccgtcttaaaaaaaa

SEQ ID NO: 25986 - DNA, 484 bp, Homo sapiens
  misc_feature 120, 413: n = A,T,C or G
tatggccgggggtaggaagcctctctccctactgctgctacacaagaccctgagaactgacctgcaggacgaaaccatgaagagcctgatccttcttgccatcctggccgccttagcggnagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgcaatggtttatggatacaatgctgcctataatcgctactttcaggaagcgccgagggaccaaatgagactgagggaagaaaaaaaatctntttttttctggaggctggcccctgattttgtatccccctgtagcagcattactgaaatacataggcttata
